United States Patent 9,567,581 (SELECTIVE REACTIVATION OF GENES ON THE INACTIVE X CHROMOSOME) - sequence listing, part 47

SEQ ID NO: 4916 - DNA, 175149 bp, human
cggctgctgcagggggaggaagacggggaggaggagccgtgcgccgcggcggcggccgccaggggaaccgagcgcccggcgcggagagcgcgggagcggagcagtagcccgatccggggccgcgggccgagctgccggtgagtgaagccccgaggggcgcggcggccggtccccggggctgggcgggaggcgcgggaggttgcggcgccggggaggagggaggggggccggctttagtccaggggccggctttagtccagcccccggctggcccggcctcccgccttccctctggcttcctccctccgctgcctgcgcgaggggggcaggtcccgggcgggccgcgggctgggggtggtgctgcccggagggcgggcgtctagggccggagggtggagctgggggttcgggggtgtacccgggggcgggaggctggacaaggacggctctaaattggctggaggggcccgtcggcggcgaagttgctagctgggggcagagacggccacgcggttgcaggagtaagagatccctctgtggcgagtgcgtgagacgaggagtccggcgtccctgccatccccgtcgccctccccgcctgctcggccccgctagctcctctccttgcctccgcgtgtcccctagctctgaccccttttggctcccggttcgctgccgcagcactgccgggtctccttggcccccgccctgaccctttcggcctccggcttcccctgacccctgcttgcttcgccactgccccgttcccgttttcttccctcgctagttacccctcccgcttcctaattcccggtgcaattgcctctttgagacctcttttttttttttttcctctccttccttttagattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatgtgagtctgttgactttttcctgggcatcctaagtgataagagtcatttatgtgctcaggacactccatagtgtacagcacctcatcccggcgggcagggggacctttaaaaatgattttccaacgagtggctgcctttgtgccgatttcaggtttggctttctttcacctttgcacagtgcgtcagccccacagtggaggtgaggaaccttgtgcctgaaccctaggaacgactggcactcaccctggctgcccctcccttccagcccagcccaaccctgccgtgccctgggctttcacaagcaggaattccagccccagccaggtgccctttctgaatcacatcagtggaccatgacccagctcccttgccttctgtggtagttaatttcccaggggcctggtgacactctttcctggaggtggtcgcataaactttctcatctacactgtggtactttggggaaatacttttacaggtttctcttaatgactctttcatttgggagtgtatgctcttagagtgaggtctgcctttgcattttgaggcattggagcagcaccaagctcctactaaatgagttctgaagcaggtccccaggctgacatgtgtactttgggctggtgatcactatggtgagagggtatttctttttttgcaaacctctccatcctattactgtcattctgtctcctatggtcatagtccaagggtgcttaggaagctgatttctttacctcatcgacttccacccattagcggtgctaaggaaaacaaatgggattgaaaaggcaagttgccagatacataaaaataatctgggtgaggaccaagagtgagactgtctgtattcagcctgtgtggagagatgttctaaagctataaaatcatggaggaggaggaagaggagactgggagagcaatcagtcttttttagatttcaggctgtggaaaaccgggtgtgttttattcaggggcagttttgaaacctgtcattagcatctttactgcctttatgtttgtagaaggttattctttggagacttgtgacagcctagcttggggcaggaggttgagattattatctccattttacaggcctggaggggtttaggaatggcaggtcatttgcttgcagccagaagatgaattagtgcctgggttagaaagcaaactcatccaccttgaggttgcaagctgtcaaccccaaagtgagggtggcagtgggtggtggggcagtcctgtgggaagactcaggcagatgagcaccacactgtctacccatggcttggatacttgcttgcactgtgttcctaggaactcatttgattgcaggcttctggatgtggtgaatgaccccagccccttcccttcttgcagatatggtaagaaggtatggataactttggaataaagtggctgtttttgattgggtggctgtaagcatcggggctggagtgggcagcattttttaagagagggcttcttgggaagtgatgccattcacaggaagtccagggctgtcccagctagaccttctgtgtaaatttgagccagtcttctttctttctttttttatgaatgggctttttgttaatgataggaaacaacgcatctcagccgatgctgtgtgaggctgtcgggacaggagtgcttttttaggatggcaggtggtgagggtcaaagggtgcatcttctacaaagtggtcttgaggcctctggcaatcacatatctagaaggtcgacaaaggactaaattcagcctgactggagctgcggctgatgtgatgacgtcaagactggcaacaccatggtttttagaagcaagatttttagaggctctcagaagactctggagacctagtgctagcattaattcattgtatgactttggagaaagtactcttcctgggcctcagtttgcctaccttgtgaaatgaggcagagttgccctcctagctcttgacagtctatgtgattcttgtctccataagtcgtagatgggtatgcaacagagagctattctgaaatgcttttgacctcctgtgtggaaaaaaaggaagctagtttcttctctgtggaagtcaggtggccagttcccattcattgttttctccctgtgtcttcccagtaaagtaaactcaactgggccatgcttgggaactcatgcagaggatgatggcactttaggactctgaagccttaggatgggggcatggaacagagccatgccgaggagttcttgagctccatcagaattatgcttctttgcccttttcccctaaatcactgctttgtatcatttaaatagtaacccctggcataccaggagacctagcctctgattaatccaactttctataccctccatatggcttttcctgggaagcaggaatgtatggatttttaaaagttgatgagtcctaaaaaaaaaaaaattaacagcagatggttggaaataattttctgtcttggttgcagcaatgaccaatgatagtatgtatacccagaataccataataccttgcatttatctaacaattactgtttataagatactttcatatacattgttacttttagcttaggcctggagaaagggatgttaaaatgtttcctgcaacagtgtatattccaaagaggagatactatgtacaaagaaatgtttggcaagtgaactagctgaattaggctatgttgtagtggcaaattctgtggaatttagaagtcctagcaaggaaagagagatattagctgaagtgaaagggatagcttagcagagacatgtctgatatgtgtctctcaacaggatgactcagttttggctttataaaaaggccttcttcctcagagagtcagtgtaagtttgtaacaagggaggtattgctttaggccaggaaatagataagttggagggaaattggttagtctccgcatctctcatttttcagtctgcaacatattcattcccaaggccttgttacacaggctctcatcatagccatgctgcctttgagtgactgccaactgtagtagcataaggaagggcagtacttgtgtccaagttctgttattgattaatattcgtcctgtcagatttcattttggccttgtctgatttctcaaacgtgtcctgggactgtagactgatacaggcatgtatggttgacctagcactgtctcacagctaagcctccagccagagatatttgagtgttctcaagatcagcaagcaccaaggttaccacatggttgctaaaccccttgctaaatatcactggtgtctatcaattataccaataagtatttcttcaagcatggccagtccctttttgcttatgattttggcaggtatgggtgacagggagtgaatttatggagtgactgtactgtttaccaaaaatcacccagtaagttagtggcacaggtggctttagaactgagctgccacagtgggaatctggcttagcaggaagagattctcatagctatttaagtcttaaaaatctacagtttctcagcagaagggttaaaatgctagatagtttgactgattgttgtaaagactggtggtcttaatttagtggccctttaccctccttgagtccagttatatttgtcttagaaacttaagaaaaagatcccatttgggatgtcttgtttaattgtccaattcctgttggttctgtatgtgtctgtgccaacatctcctgattaggcacagaacttagtggggtgaagcatatgcagtttaaccctccatgtctatgcgcataaggcaggctgtatccaggctggatatttggcaaagaataattggtgctgttgaccccttagtcccaagctgttggtttttagtgagtaacactgaatcccatccttttttagagttgctgtagctatttgattttttgtcttctttacaatatattagaaatctaacttcaaccaaatatggcttacccgcttttggttcactgtttgattttcttacttcctctctccttgctaaaagtgtagaatgacacacactcagaaagtcctgagctttttgtgaaaccccttgcaactcactgaatacacactgttgcattccggttgttatgtgatgaatttgttttagagaagacctgatggatttgagaaacttggctttctgttttcccccttgacttcacaccagacacacctcctcattctccatctgttgtctggagcactgattatcattcctgcttggaattgaagttggtgggtaatgggtacaataagggatccagccatctgctgacagcttatcagatggactgcgtcctgtgtcatcagtccagggggatacaaggggatgatgtttatatgggcctcactagtgaggcatgacattcctttttagtttgtttctccccccaaggaaatttgcagagaatttttccatctttcattgttacagtcattgggggtgtccatataaagagaggtgctgtggattggtgaattaaacaacccacaggcagccccaggatttaaaattatgatgctagttttgctcatggcttgctacaggaacctcagcaaactatttaaccttttcctatctcagtcttctctgtgaaacgggccacatggaaatgaagcatttgaattctctgaataattatgtggtcacttaaacagagaagctgggcaaagctggtcaaagatggcagatgaccaatacagtttcaacttcagactcagaaaccgacaaagctcaactccttatacctttcttgatagcttctagaaggcattcctctaatcatttttgttacttttctctggatccttgcctgtgtctggatacctttctgatgcatggcatataaaactggacactaactcttaccagaggtccagcctacaccaagcagagaggaagtatttttttcccagtcttttcatgccttgcacctgttaatacaactcagcttgcttttaaataacagtatgttgctggcccctactcagtggatgatccacaagctcacagaatttttattcctttgccacagatgggccaccttcttctcagtctttgtgagacttgtttttagtttcctccccctctgtaaatactcccctgaagattctcctctacgaaacctttccataggagcctgacctgactccagtaacactttttgtcctttcccagccgtctgaatacatgtcagaatgttgggctctttaatgaatacctttgtatgcatgtaggtaatctggtgtttggccagatcatttttttttgtttgtttgttttttgttttttgtttttgcatgtttctttaatgtttctccaccattagtgggaacacttttttaaagtaaaggagtagtggatttttcctttgtaactccttgcagagctgaatataatactgtatatgcacattaattgtttaatgtgtacctggataatggtgactgaatgattgatggaactgactttttgctttccttttttctttctccactggtggccctatgttcctattaagagaatcttccagccaggcatggtggcacacgcctgtaatcccagactttgggaggctgaggcaggcagatcacgaggtcaggagattgagaccatcttggctaacacggtgaaaccctctctctactaaaaatacaaaaaattagccaggtgtggtggcacgcgcctgtagtcccagctactcgggaggctgaggcaggagaatcgcttgaaccgaggaggcagaggttgcagtgagccgagatcccgccactgcactccagcctgggtgacagagcaagactctgtctcaaaaaaaaaaaaaaaatctttctgcctgttttttgaaatagccacaggagtgaggcaatctcagctcctgctcacacatctttttgtagaatttccatcacaaagaatggttattagaatctctactcttggcccaaagtgtctgtttgcttttctcccaatcaggaaatcacactgttggatcttgatcttaatctcttggacatgccaactttcttgcttcttaatatcatataaataaaaaatgttattaagccagagacttacttttcctttttctcccctcttctctttttcagtggatacctcattgttatgcctcattgaaatgaagagctaggtttctctgcttctcctggtctttcatatattttgttaaattgagaatgtcttgtctcacgtgctcctctcctgccaggaactggctgagtgaatgcgaagagactctggatgtggaaagcggtgattgtcaaactttatttgtaaaagagtctcttggaagcttgttataatgcggataccttgttctctacatggtgattctgagcaggtctagggtgaggattggaatctgcatttatactcgctcttgggtgattctaatgctggtcagccttggaccccacttttagagacattatctagtggctgaagtaattaggtgggaagttggtttcagtgcccatcctaattgagcatgagtctgggtgatctgtgggcaaggcattaagtgttctggcaccatctcaatacctgttaaatagtgtgattcagattagaggatgagggccccaagttattgtgaagagggttttaaggtagctgtagagttccactggcttgtttggtgactgttagttatgtcaatggagtatttcaaccaggccacctttattaccttccagtgatatatggaatatatccctccagtccttctatatccccccgctttccagtctctaagatctgcagggactaacaagagggaatgttgacacatggtttgttgtatgctaactctctgtttgcaggactgttgttttagatgttcgtgggagtttattctttcttgcgttcactcaacagatatttatcgaatgcctattgtgtgccaaacattggtgccaggtattggagattcaaagagaaataagaagcagtcattgttgatgtactttcaaaaacaaaaccaaaaacaaaaaaaaaagaagaagtagcctttgccttcattttgttcacagttttgatgagatggacaaggaaatagatcaactaaattacaacattacatgtatagtaacagatttgaacaaagcataggggacaggggtctttttttttcctaatgcaattaaggaaagcttcctagaagaggtggcatttgagctggctcatgttagctccatgaaagcaaggacccttggtttttgttctcttagtgcctagaacagggactggctctagtaggtgctcaataaatgtatttgaatgcgtaggaattcattgggtgatggaggaaggaaagcaattctaggcataagaaacaataagtgcaaaggctatgtgctatctccccatttctcctatttaatatctattcacttacccagggttcaagtagacaggaagaggatggatgtggagagcagtgattatcaaactttatttgtgaaagaatcccttggaagcttgttataatgtagatgtctagctctcttcatagcaattctgagcaggtctaggatgaggatgggaatctgcatttataagaaactcccagatgattctaatgcctgtgagcctttgacctcactttgagagatcctaccataagttcgcagagttgcttcctccttcacagaaaagtgtctcaactgtaacctggaattatttgcttattattatcaggggtagatgtcttacttctcccttggccaactaagtgaaactctaggaatgctctgtcatttctaggctgttgataaacgacctgcagatgcccttgaatcctcgataggggatgagatagaaaattgtgttctctgtgctgtcccaaggagggcccacactgtcaacaacagaggcacacaacattggggtaagtgaacagacattaaatgtgagaaataaggagatagcaggcatcccacctgcaaccagtagatgctttttagtggcttgtggatggttgctgctctaaagtccacagcagcactaatgaagtgtggtgccatctttctacctttctttttcatatctcttcttccctgtttccaagtctgtccacctgatccaccccacacaagttccaaaacaatcctttctataattcaaaatgcccatctcatcagaggagatgatagccatgggggattaggaagaaagcagttttatttcagaggttcatactgaaatgtgagtggacagactccactgggcgtcagggagaggatgagttttaaaaaagggccttgttaccctaacattatatctaattggtagactgtgtctagtgtttttaagcagatgtcctttctcatgtgccttgctcaggttttggcctcttctctcccgctaaagcccctgatcaggagaactggagttatccatgccttgccaccctacatgctgacccccagggtttcatattaatgtaaatctccctccacagtgcttggatgcagcagttaatctgaaggcctggcgaggacccctcttctgggcaccagtcagtcctctgtgtttactcagctctttcctggctacacagggcagcgcttgcacatctgtcagttcatgggcatcaaggcacttggacctgttaccagcatgagatcctgaagggaagggtttgggggatctcttgattggttttggttcccgtctagtagctgctggaggaaatggcagagggaggaaggataatatgagttttattctgagctgggtggtgttgagggaagggaatggattgcaggagccaggaggtcagacaggattggcctgtttggcgaaaacagtgcaagctctgccctgtggccatgtgtttaggtgggtaggagagggaggagtgagatcatctggaggggaaaggaagcatggtaccatcctaattctagcccagtgccttcagtctcctcatgtccatcacatgccagtattggtataaagtcagggtgtattttgcctgtgaattgaattgtctttgccaatcgaccagctgtgtttgcagaaagactctgactgactgtgttctggctgttgctagcaaagagacatttcattcaggtgctgattaaataaggtgcagagccagattgcacattaaggcccttaactatggctctgggagtcctgggtaaacacttattagatgttctgggcagagcacaaaaaggctggtagtcaggtgttctcttcagaaatcaggttgaaggaaaatggggtaaagagagacttctataaagagttttgatcttcttttcttaacattaatcagatctgagtggctggtgtgtacacatcagggccagataagtttcctcattggcatttacttgccaaattcttgctgggacattgtaggcttggactgggatacagcggggatcctgacttaagtagggcagtaggaatgcttcattttcctaatgcaagttcagcttggtggatagagcctttggaccatatttcctgggtttgggtttgagctccatcaccatgtaaccttaggcatgttacttagctgcatctgtaaaatgggaataataatagggttgttgtgagggttaaataaaataatttaaatcaagtatttagcagaatttctggcttattgtgtgcactaaataaatgttagcagtttttaatagtaatagtattacttaacatttcaagatcatagtggtgtattgggtaagagtacaggctctagggtggtaaaagcctagattcaaattctaccactagctctgtaaccgtgggcaaattacttaacctctctgagcctgtgttcccacattcataaaatgatatgatcaaacttgaacattaccagagttgttgtgaggattaagtgagaaaaatgagaaaatattaataaagcatttaagatagtatctggcacataagacacattcaatacatttaaatgatgatgatgatgatgacgatgatgtcggcaactaagatggtgagggtgatgatgacagtcatcatcattctcactatggctgctgcttcgagcctgggtgcctgttgttgcaataagatggtagggatttgatacaggaaagcttttccaagaaaatcttccctggcatcataatttcatgcagtgggcaaaggtattggttccatgaagttagcacccatgtaataatttctgcgggacagggttgtttggctgtttgaggcttaaggacgtgtttgtgggtaatgtgaaggtactttaaattatccagtcctttctgggtgactgggtgattctgtttaaaatggcaactcttcttacatctctaagatttaaagaatttagaaggtggctctcattgttaggaagcttagctttccggggacctattggcttaattattattgctctttatcaatgggctggctccatggtgcaaactctcttgagattggtagtctaggaaaccagtgagtttgtgacagaagtatgaaaggagtgagcttgggggaatggggtgggcatagactggtgaatgggtttttttttttggttgtttctttttttttttttttttttttttactttttcatttatttcttttgattaaggggagtgcaactttctccagtgccaactattaccagagctgggtaactgttggaagagaaagggccacccccagagctcctgggtgaaaggcaggttcaagtgaacaagtatcttagctgaaggagaagcacagtatagtggaaactgtgctgctttcaggagaagacttcactgtgccttggctttttgcatcagcaaatggacagaaaaaaaccaattattcttacatctccgggatatggtaatcctctctccttaagaccagctctcctccttttcaagactttgctctggggcctcgttttcaagactgaggtctggggcctaagccaccaatcactagagaaggatccccttaagagcagccttctggggcctagaccttgatcatgtgatttcaggccttgggatgtggggggtgtgctgtatcctgccaaggccattggaaggcctctgggcatattcccaagcattgtgggtaagaaggctgtttcttagtcttggaggtgggagaattgagaaagctaaggtcatgttttctataacctggttcctggaagaggagctggtttagagggcatttctaaacaaacagcaacccaaataaacagcagcgcttggaaattagttatgaaagttcacacattctaagacctagggaagattgtaacaaagggtcctcttcatatcagcacttgttcattgttggtttgcatttgttaagagtttccttttttaagttccaggaacttgagtgtgtgtgtgtgtgtgtgtgtgtgtgtgtgcgcgcctgtcactttattctctgcaccctgcaggaatgttgctcagagtcatgtgcacaagtgcctcattatcagcagcgctttcacacttggtcccttgggctgccactgctactggctgctgcttcatgtgggtatttctacctatttcctggagccccagccccacagggaatgttggcaccctgaggaaagggaccgcctctacatttggatctcccttctgctgcagggcagctgactttactctgctttcaagttcacctttcctcagaatagccctgcaagctagcaccaagccaaggttatgtttccttgcttgcatgtggggtttctggccagtcagccaagtgaactgattgacccccagccctgtggggaatttcaggggggtattgtcttggtcatcggagtcaggggtggcctttaggccaaggctgcattagctttgtggagaagaatgtgaagcccgccgtgtcacagggtctgctgaccggctgggtagtgtttggccatatctcacagccagtgctgtgtttgctcagatggacgcacatggaaaccaggctaggatcatcttcccaaatgtcttactccctgctttgggtctgtcctgaaaaacaatttgcaaagtacattgtggtctgcacctgttgttttttcatcccccttttccacagtcagtttgcagtgaatggaggattaatcctggctcttgccacttgtattttctctttcccttctttccttgacgttgggttcttgcttttcagttataactgtctgtggacattaaggacagctggtgcccctgatcatttaggacctcccttaggcctttaaaacgctggaaatgtgtaacagggccggatgggcaaaaaagagtcgaatttaggagaaaactcactataatttctggttatctttgtacactctcagaaaagtgaggagtggtagtaataacacttgtaacatttttgaatacacgttaattatgctttaggcatggtgcttagtctactgcctgtgtattacctcatttgcagccttccagaaaggttgttttttgtttcatgtaattttttgtttttttgaaacaacgtcttgctctgttgctcaggctggagtgtagtggtatgaatatggctcactgcagccttgaccccttgggctcaagcgatcctcttgactcagcctcccaagtagctggaaccacaggcacgcatcaccacgcccagctaatgtttttgttttttgtagagatggggtcttgccatgttgcttaggctggtcttgaattcctgggctcaagcgattcttctgcatcagcctcccaaagtgctgggattataggagtgagccaccacacctggcctgttttatctaattcttcttttctttgcttctagctgatttcccctttggtagactataggcactggatgttctagctgtactttctcaggttgttaaaatggcagagtgataccaaatcagagctgaaagaaacctctgagaacaactaatttgtttctttttcatcccttgttttccagatgagcaaactgagacccagagaggtgaagtgatttgcccaaagtcacacagctaaatagaagcagagctgagtctcctgactcccatttcaatatctctctataataccacacatggcctccttctatccttaaccttccagcatgaaaggaactagacttttcttcttgctcactattagagaaatggaaatcttgtgctttttgagcatcattgtttattgccttcttgaaagtgaggatctcctggctgcaggccacctccttcctttctttctttctttctttctttctttctttctttctttctctctctctctctctctttctttccttccctccctccctccctccctccctccctccctccctccctccttccttccttccttccttccttccttccttccttccttccttcctttctttctttcattttttttttttttgagacggagtttcactcttgttgcccaggctggagtacaatggcatgatcttggctcaccgcaatctccgcctcctgggttcaagcgattctcctgcctcagcctcccgagtagctgggattacaggcatgccccaccatgcccggctaattttgtatttttagtagagatggggtttttcaatgttggtcaggctggtctcgaactcctgacctcaggtgatctgtctgcctccacctcccaaagtgctgggattacaggcgtgagccactgcgcccggcctgcaggccacctctttacctggctggtatagcaactgtttttttcaatttactttcctgcccttgcttcctgtcttccacagaggagtctggccctggtgtcaccattacttgctgtttgccctggacagacagttcacagggatgtgtgtgctcactgagcctgcatgtagagccagtatgggttgcttgcagatgttggttgtttggaaatgggacccactcagctgcggatataactgaggccatcatttcctgcctccaaatagaggcctgcatctaatcctagtaaacagttgtatggggctccagggcaagggatcaaaattagaaccttagtctagcagaggtgacaaaggccaaagaagaaaaacgtcagaataatctgtcagcccagtagtagaggttagttcatcttggttgagtagtagaaacagcactggattaagggttagccagacctgggtcctggttgtaggttcatcactagctggttgacaaaactgagtaattttggccattcaggtagcctctctgtgcctcagtcttcttatataataagaaatagagtgtggtagttaaaagtgcaggctctggagccagactagtcaggttcaaatcccagttctgctgctttctagctgtgcaactctgggaaagttaattgacatatctaggcatggtttttgatttgttttgttttattttgtttgaggtcttccaagttcattatttttcttgtttattgctagaccagtatacctaaagcctctgggtctgttttcttatctgcaaaatggggattaatagtagtatctactttatggggttcttgtaagaattaaatgcatgactacatgtgaagtgtttagaatagtggtgcatggcaagtgtttaataaatatgagtatggctgttatcatctgtaagacagagatgatctttgcccttcttaccttatagggtaaatatgagaatcaagtcaaataaggtatgtgaatgtgctgtgaatatatgaatgtgctgtgaatataagaaagtgctatcaaaatgagaacaatcatcatgtcttgagagcaggaacatttaaacattccctaggccacctgtttctagaatcagatattgatgttatttccttggtagcctggcaaaagggagaaaggtaggtttgtatgtagggttatataaatgctggggccatcaagcaatgtagatcctgcttttttcttcccagtgtactcaagagggcttgaaagccatgcatcctaagtaaagtggttgggggatttggaatgaaacagtatcatctgccatgatactgttccttcagtactcttatcttatttaacagcatcacaatccatccagtgacccaggttaaatccctagaaaccttgatacatctcaattccaccctcttcctccttttcatcatcatagtctcagtcatcttgattctgcctttcatgatctcttccatttctcttccttttcttctttgattcccctgccctggttcatgttgttgtttatcactgtcatcatcatcacctgtcttgttagagcagccttgtgattgatcttctctcctctatcctttacactactctatcctttactctatctactactcgaccctttacactactgccagaatgatacaagtaaaatacatgttggatcatgccattcccttcctccaaaacctttgataactccttaatgccttcatcagggatggtaaacacatagatgcatacactttatattgtccctggccgactgtgctaatcaatcataggcacgctttcccagggagagtccaagtagatttaaaatctgtttagcatagcattctaggtagccacttatcaatcagtcagagctggtattaatatatagactagggatggcacatagataaagcctgtagagaaatcttaatctccttatgataggattcggtatcttctgtgattttggtcccaaccttttttttcagccttgttatttagtatattcttccatgtgttctctgatccagccaccagcaccatgcacttccattcttctctgagtttatactttgtttatgctgcactgttagacagaaatattctttcttttctcttcctgttgaaatgctagttatcattcaaggctcagcccaaacactccctcttgtgaagctgtcttcaagcctctaagccggatttagcctctcttgtctattttagcatgttattctgccttgtattatgtaattgtttgtgtatcttccctactccttagattgtatgttcccaaatgtaaggtctatgtttttattaatttttgtatcccccgcacagcttctggtacattctagattcctaattttttaaaaattaagtctagtccaatccctttgttttccagatgaggaaactgtggcttagaggaaaaggtcattagttcattttgggatttgttgattttcagatgtttgagatgttgaggatggattgtccagcaggctattaagatgtggtgaaggctagaaatgttgatttaggaggtattgccttcgagaagataaaggaggagaagaggagagcatcatgcaagctagagaagagaaagaagaaaagtattctggggaatgtctcctttgggagcagaaagaagactctgacggagcagccatccaggaagtggaatgagatccaggagaggaaggagtttcagaaggcaggagctggtcctctatgtcatgaaatgtagagggtgaggccaaggaggacctgagagaaggtaattagatttggtgtttacaggctggtccctgtggccagccaccccacccactttaaaatatttactctacaaatgttaatgtgtgaagagttgcatgccagaatatttatggcatcagtgttggtggatacagaacattgggaaacaacccattaatagcagaatggtaaatctggccagtgaatagtatagctttttaaaaggaggctgatgtctgaattcactttcaaagttgttcacaatgtattgctaaaatacaaaaatgttgcagaaccatatgtatgagagaaacccctttttctaaaaaaaaaaaaaaaaaaaaaaaaaaagcccaagcagcctctttatatgtgcatgtttatgagcacattttaaaaatctggaagaatgtatactaaatagcacttactcctgagtgattagggaaagaggggaattctcattttttaatgaccacatttctgtattatttgaatttggtttaagtgtagattcctttagtaattaagagaaatacttatttaaataaagaaaggatgattggcagcctgtgagaatagctttactaaaaaagattcaatggacaaaggaagccaactcacgagagaacatttggcaactgagaaaacatcatgtgttttggaggctgtgccacaggtgccttgctgtctgtgtggctggtgggggtgaggcagggggcatggagagattatggctggaatgaggcagttaccccattgccaggaagttcagtggaaagggaggggataagtagaagagtagctaagtggccaagaggcaggcaggggctgattaagaaggaattaaaaaagcaaatctgtgtgtgtgtgtttgtatgtgtgtgtgtgtgtcagacagtcagattcagtgctgagctgcagagggagaaggaaggggacactcattgctatgaggaaacatcagtgtgaagcggggagcagggtagttgagaagggacaaatggaataccaattttagtagtagggaagcttccagaaaagcatgagatctcaggccaattaagcctctgatacatgtaatggttggggactaggctggactagctaatcgccttctctaacggtaggttaagaaagctcctttttgtttatgttttggttacaaaaaatgttttggcagtagcagacttattgtactggctcagagaatagtctggtgagtgactgaaatggaatttttgtgagcccttgaaggcctttaagtcatctggacctgctaaagtttgggactagaagtggagatggagaacagtggaggtcagagtcctcaaccctggctgcatctctcagtcacctagggcagcagataataaaacacaaaccaatgcctgctcccacaccctgttcttagataattgattacacttggggcctggacataggcatttaagaaaaaactcctcaagtgattctaatctgtagccagggttaggaatcaatagttgagaagactggattaaatgtgttctgagcctaaactgaccactagaaatgtgtgtgtgtgtgtgtgtgtattgagtgatatctcaatatagttatttcctcctctttattcccaaagccttgggagtggactgcttgtaaagtgttggtcccatagcctgctagttagttgtttacttgtcaagagagatctaagatgtaagattctcaataatagtaactacctttattgggccttttcagggataggttttcagacttactctgaatcatacagcttgtaggatgggtgccagcactaggacccatatctgccccttttgagcagagtgcctggcatataggtatttgatcattgtcacatgatgtgacaaggagctttgtttctttgtgcaatgcttctttttattaaaaaacccagcggtggtaaaatctgacgtatttgaaaagtctggtgggagagaggtttgaggagaactgcctggcattcaaaaagcttatgatatgttagatagtgtgtggtgaatctagatcacataacatgtattaagcaattactccaggcctagtcgtactagagagatacaaaagtattagatgtggtttctgcccccagggaacttattatcaaggctcattaacagtctgactactgtattttcaggtggcaagtatgtacagaatttatgaccagaaaatgctagagatcagagaggctttcaagttcctgaagttcaagcccgtcgttttgcagatagagaaagaagcccagagcagaaagctgcttgctgaaggtcacaccacttgggaatggcagagccagggctggtgtatatggccttaccctttgaggtcctattacactctgttctgtcgcccttgaaggacaggtgaacctaatggcctgtgttaaaactttaacgatatgctttatgcctccaggcctccttatggtttgggggaggggaggttaaattttagtctttcttaaaaccttgagtgggaagggccagcactggttacctctggctcaagcccaagagttctaaagatggctaattttccctttactgagacaaccactgattctagtctaattagggcactttcctactcctcctaagggtctttcccaagctcagtgtgtttatgacttttctacttcagttcctcatttttttttttcctttttgtgaaactcaccttaaagacaagaggtgcctgtccttatgggtgggcctgagagttagaggagtggggccagttcctagtgatactagcatcaggctggttcttttggccttgtcccctgctacttcccaagccagaaatttagatccaagtttggggctttctcagaaggttcaggtataattcaaggtagaggtattcttccttccagacccctctccccacacagttagtattagggtataattctagtcaccactaacatctattgaacgcttaccaagtgccaggcatcctgtggaatagatgctattatttgcattcccattttatagataagaaaaataagggtcagggaggttacgtaacatacccaaggtcacacagctagaaagtgaccaagctggtatggatgtgtagatctggctgactcgttactgttaggctaatggagcctaacatgaaaataagttactaattatatttttgtattgacgaagaaccatttgccaattttctgcaagccaatttaaagaactggttgaaagagaagcatcctacctatagttctgttccactgtggggtggactgtatcaagaggcttgccagtcacctgcatttgtcaagtaagtcccttcccttctctgagattcagtttctgcctctgtaaatgagagggtcagaccagatggtatctaagaccttttctggcttcatttgctacttcctggtagaatggaaaaattgtagaattggatgaaggacacaatgcattagaaacacaaatgtggagagaatacatagttcatcacggatgggttagttagccagttacacactgtttctgttttcccttgtgaatttataatgaaacattttttttttcttttcagtgagcttcttgctaacatcagaaagtactagctttccttttttgttgtttggttcttttgtttgttggagacagggtcttgttctatcactcaggctagatgcagtggtgtaattacagctcaactgtaacctcgaactcttggactcaagagttcttccacctcagcctctcgagtaactaggaccacaggcacatgccatcgcacctggctgatttttaaattttttgtagagacagggtctcactgtgttgcccaggctggtctcgaacttctagcctcacgtgatcctcctgccaaagtcctgggattactgttgtgagccactgtgcctgtcctctagctttcttaaaggagctgttatttaatttcagggcttgtagtctctaaaactgttggtaaacgttgaataaaggctgaagggtaacagggcacttaaatacgagatgccatgttttatggctctgtgtgagaattagtaaaatttgtgttctgttttacaagagggccttgggagatgatggtttctagaagagaagcaattgaaacaacagattgtacatgtaacttttatctccttgcagggtttaagagcaggcagatacataactaggtctagtgtatggtatcattcatttatctgtgtgtcgtgaaaagatcttgtattcaggaacactaggttaataatctacaaaatctaatactattagaatggtaggcttgatcttaaaatttttatgttgttgttattgttgggtgtgtgtgtgtgtgtgtgtgtgtgtgttggcatatgtgttcttgaacccagtggcctttattttggatggtttgtatatcagcttgcatcagggaaggctctgagggcttgtccccaaagccaggctctttcctcctctcctgctggctcacgtatgtctccaggttcttataaggcagaatagactaggtactgctattagaaggaacaaaattatttaccttgggacaggaaggagaagccctaacaggtgggctctgatggcagtgctgcttggcatacagtcagtgctacacaaatgttaagcattctgctcactggtcctaggtcaaagcccttgggatgctcatcacttgtgggctcaggtatcagggcagctgagttagaaagcccaacaatattgctatacagagggagttaaaaaccagatggcatcaaaacccaagctgcacacacatcttgttcttcagctgccaactctgcacctcaatctgattttaccttattctcacctaggtctgggtaagttcatgtaattgcatgttcctgccatgaatatcctggttttcagaaaaagagtgagtgagatgaggccacagtgtggcagtatttgttttgtttgtttgtttttgtttttaatgttgctcagtcatgccacgaaatgggtacctcctaaacactaacttggataccctgctggtttgctgcctttcagttttctattcacataattattgtttgcattcccattctaattttggcctctggtctcagtaagaaggagaattgaaatactcagtgtcacactcattacacccacgaccctcattcatttcacaaactaacctcctgtatttcttctcttcttctggcttggcatagggcttttgacttagatctgagctcaaagctaatttctattactcatgagctgtgtgcctttaggcaagtcacccaatcactgtcattatgtttttcatttgtaaaatggagctaaaaattctatctacctcttcaagttatttagagaattatgtgagttaatatttctaaagctctgggaacactgtgtggtacatattaggtattcaaaaaatattagttacagtcttcctccttgctccccaagaaatagagccagtaacaacaacctttcttctaatacctcatgaacttctcctggcattagctgtctgaaggggctgaggtttgccttttcttttgacgatggagattagtcattagaaactctggatttcatcctcacaggaaacttgaagttgttgacttttgttccttgttaaagagttggtacgactggggcggaaatctccagagaaaagggcgtgttcctctactaattactctgtagacggcagagggtgtgtgagtaatgagctgtatgctgggtgtgggagttcagtgcccagccttcgggaaaacatgggtaggtttcattggctcttatagcagtttgtggctccctgactctatctaccctggagatgtattggagtccaatagttagaacctcagagccgtgggtaataggcctattacctacttcttcacagtaatgataacagctcacatttattttgcccttactttgtgccaggcattgtcctaagtgccttatgcgcatgaactcatttaatcctcacaagaattctaaaaggtagggtgcagagcaactaaatagcttgcctacagtcacacagctagtggggtggagctcggattagaaattaggcagttcagagaccataaacttaaccaactgcttggttgagtctctagtcctttggtttccttttttaacttaacatgttataattttgtaactgctggtctttagaaatgcagctgatctttgtgcatcatttttgtatccagcaaccttgctaaatgcttttaagttaattataattaatacatctgaggattctttgggttctctatcttggcaatcgtacataatctgcaaataatgagaactttgtctcttcctttgtggccattattttttttaatatctttttctcaacttactgttttagttgagacctcccgtatagtgcttaatacaagtgacaatgttgagcaactcttatcttgttttctgccttaaaggatatgctttcagtgtttcatcataaagtatgatccttactataatttttttgttggtattatttattagattatagaagttccctcctattctaagtttgctaagattttttaaaaatcatgaatggatgttgcattttatcagaagctttttcttctgttgagatgatcatattgcttttgttctttagtctttcagtgtggtcaattatactgattgattttctaatattaaattgtctctgtacttcccagaatcaagtcaccttgatcatgatatattatcttttttattgttcctggatatggtttgctagtattttacatggtattcttaaacactgtgagtgggctgggcgcagtggctcacatgcctgtaatcctagcactttgggaggccaaggcgggtggatcacctgaggtcaggagttcgagaccagcctgaccaatatggtgaaaccccatctctactaaaaatacaaaaattagctgggcgtggtggtgtgtacctgtagtcctagctactcgggaggctgagacaggagaattgcttgaatccgggaggtggagattgcagtgagccgaggtcatgccactgcactccagcctgggcgacagagcaagactccgtctcaaaaaaaataaaaataaaaataaataaataaataaaataaaataaatctgtgagtgaatctggctctagttttcacttttcatactgcctttgtcaggttttcttattaagtttgtgctagcttcataaaatggattggccaatgctgcttcctcttcttctaagctttggaaaagtttgcatgagatcagagtgatttgtttcttaaaggtttgttagaacttgcctataaaactatctgggctttgatattgtctttgtgggaagattatggactactgattcaatttctttaatggttataggaattttcagacattgtatttttctttagtcagtgtctttaatttatgttttgctaggaatttgaccattttgtctaaattttcaaatttattggtttaaaattgttaatagcgtcttaactataaacactacagatatttaaaagatttcttccttttctctcatactattatttgctactaaaaaatcaatctcactagtagtttgtaagttttatttatcttttataggaaataattgagactttgttgatggaactgttacatgtttgttttctattttgttaattgctgcttattttaaaaatctgttttctccttcatattttctttggagttatgtctcttgttcttttcctaacttaggtgggatgcttagcttatttatttttagactttcttatttgactatatgaattaaaaggttaataatttttgctacctactgtttagctacattccactaattttgatataacattttgttattgctcagttccaagtattttggaatttccattgtgctttcttaactcatgggttgtttagaaggattaacagttttttcctaaatgttttaaaagtcatctttttgttgctgatttctaacttaataacattgtgatcagagaatgtgatctgtatgttctgtttctttgaattttgttgagatttgttttgtggcccagtatgatacagtgtccactagatcaaccttgttaattttgctgctcttcaatcaccttaccttattttttctctgcttaatctatcagttactgggagattttttaaagtttaccaccacagaggtagatttgtctatttcttcttttagtactgttaacctttactttatatatttttgaggttgtgttattaggtatagtatgttaatttttgcatttattgttacatctattgatcaaaatgttcaatataggggtcccgtggcaacttagagtgtggatagatctacatgctataagggtggcttggtaatggtgaaagcatccctctgggtgggctgggtaaattggattttcagctccagggaagaaacacccttaaaatcaaaattgcaccttcttgaagagttcttaaatttgacattgccaaacaaaattaacaccctcatatcctcaagtgccagaggcttttgtcgttattgaaaacactcttaaaagctgcattccttctgggatgcatgaggggttgggaaggaaagctttatttttcatgggccttacagacattacttctggttggtcagacatgtttcagacccttggactttcttcttcttactgcctagtattttctatgagacttgagccaaatcctgttacctctctgccttttaggttcaatgactggttcccttttcccctgacagaagtgaggtgtggagaaattgaaataatagttgcatagggattctaaataatttattagttccctcacttgctctgcaggaaacaaaaataaagtctatagaagacagtgttcacgaggatcaagcaacagaaatgatgtcagctattcccccttttattagattttcgaatggaatcagactatgtgaagctggaaggcatacagagagacaaattacatttggtcacatatgggtgggaatggaacttttcagtccagctcttgagcctatgtggtgctgtgaaatcttattttcatgctctgttagggcagcagctcctgattctgattgcgtttcctaaataagcactctgagctagtcctctttgctagcccttccttgctactcagagagtttcaatgaagggggagcaggtgacccagttagggtcccttgtttcaggtgttctttcatttgaatgtaacaatacttctctgtctctttttttaaaaaaaactttattttttgattatagaagtagcatatgatcataaattaagaaattagaaatatagaaatatagaaaacaaaagtgaaagtttctggtaatctgtctccctgacctgttctcttctctccctttttctctctctttttctctgtctgtttttttttttttttttttttttttttttgaggctgggtctcactctgtcacccaggctggagtgcagtggcatgatcatggctcactgtagccttgacttccctgggctcaggtgatcctcctgccttagcctcccgagtagctgagattacaggtacatgccaccacacctggctaatttttgtattttttgtagagacagggtttcactgcgttgccgaggctagtttgaactcctgggcttaagcaatccttccatctctgcctcccaaagtgatgggattatgggcatgagccatcgcattcggcctctttttttttttttttaacattttttttcgtgtttttaaatgtgggttttattattgttcagatgtgaaaaggccaacggatcaagagacagttgccatttaaaagatagtacattcactgggtgcagtggctcacacctgtaatcccagcacttttggaggccgaggcgggcagatcacaggattttgagactagcctgaccaaaatggcgaaaccccatctctactaaaaatacaaaaattagccaggtgtggtggtgggcgcctgtaatcccagatactagggaggctgaggcagtagaattgcttgaacccaggggacggaggttgcagtgagctgagatcgcgccactgcactccagcctgggcgacagagcaagactctgtctcaaaaaaaaaaaaaaagaaaaagaaaaaagaaaaggtagtacattcttttcaaaaggaactattatgatacattgtgtcttataatttttaaaaattttaaaattttttattatactttcagttctgggatacatgtgcagaacgtgtaggtttgttacataggtatacatgtgccatggtggtttgctgcacccatcaaccctttgtctacattaagtatttctcctaatgttatccctcctcttcccctgcaactgccgacaggccccggcatgtgatgttcccttccctgtgcccatatgttctcattgtttgactcccacttatgagtgagaacatgaggtgttcggttttctgttcctatgttaatttgctgagaatgatggtttccagcttcatccatgtccctgtaaaggacattaactgattgttttttatggctgcatagtattccatggtgtatatgtgccacattttctttatccagtctatcattgatgggcatttgggttttaacattttttaaagagttgaggtctcactctatcactcaggcttgagtgcagcagcacgatcagggctcactgcagcctcaaactctggtgctcaagctatctacccacttcagctttccaagtagctgggactacagatgcacaccactatgtccagctaatgttttatatattttttaagagatgggggtctcactatgttgcccaggctggtctcaaactcctggccttaagtgatcctcctgcctcaacctcccaaagtgctagaattacaggcatgagctgcagtgcccttccctagtcctcctttttataataattttaaaaaggtttttttgcttattgttattatttttaattaatccataatattttatatatttttgaagtacagtgtgagattttgatacacgtatccattaaccaatgtctccctaatccctcctttccccctacctttccccacctctagtaactactactgtactctctacttctatgagatcaacttttttagtcctgctctttttttttctttttattattattattattatcattatactttaagttttaggatacatgtgcacaatgtgcaggtttgttacatatataaagacctcggctaatgtgaaagaatatctccttctcactctctgatcttttcctttaaatttgcatttctcacaaaagtgtagtgtgaaaaaaaatccagcttgatgggggagagggctccagattttacagaatatggctgcatgaagtaaaggtcaggggttgaaggaactggaattaaaaatgccaattactcatctttatttaaaaatgggtaaatataaggcagaaaataatattttaggtacacacatcctgatctagctatgtttatgtgtgttggggtgatggatggacaagaggtatagttcaaatgagatcatttttgtgaaatggctttgtaaactgtaacatgccctataaatatgagattagctttaatactggccctgactctccagtgtggctttgtgtgtttgtctaaacacttagttaatatctgtcagtggtccattgcacaaggaactgacacaatggtatcctgtgcctctgttgttgttgttgttgtttttttttgcagttctaaaagcttagttaattgccttcattagcttaatatataccacgtgaaaagcatagaaaagcagaactcaaaactcagagaataaaggacagaacataactaactactgatgtgcaccttagttacctgatgcagggaattgaagcatataagcttcatctagtactacctcaaatacagtaaagtggatgacagcactcgataaactgtaaagctgaataataatgccaaggattgttgtcatcatgactacttagattggctgtcacccagtgacttagctgtgatatgcttccaggcagttcctgagaggtcctgcaagcccctttcctgtacaggtgctagaaagtgccatagaaatacagtctcctgatgactgtaaaagccaggcagctaaatttaataagacatttgtcaaggagatggaagattatggccaattttggtagacagatagttgccggctaaaacaaagcatgtattgaactgttttggagtaggaagaagcattgctatgacaacaaattacttatatttgatttagaagaaggagagcagtgtagcttaatggtttagaaagctcatgagaacaattgttggcacgggtttatgttaaaatataaaatgttaagtaggatctgttaaataattgagcacctcagtgcattctgtctcttctctcactgtctctaaccaatagaagacaatataaataaattcaaagaaaaaaaagctagcagaattacatgcaaattgttccattttataaggtgcccaaatgaaattcacagccaaaatttgctggaatgcaaaaaatgtcgtttctttacaggaaaaaaagaacccagagacctattcactgtgttttcatgccatccaaacctgatgatggtagtttggagtttctcattctgtaggtgattaatcttctttgtgattggtagtatgttttatttgaaaagaaactacacttcagaccatttctatcctttggctgtgttcatgcctgagagaatgagtaaacagtcatttgtatgaactggttatttgtagttcccctggggaagtaggtatcaggcaggtagcaaaggcatctagcatctggaggaagcttgtggatatagaggctttctcttagaaagatagctctttccttttcctaaaggtaaaaccaaacagatggcccatattcactggggataggtctcagggtcttcttcatcgggttctgagggtgggtagatctaaggactccttgagggctcttgaggcagagaatcagatactttctaatctctccttttttgcttttccctgatccccacttttacccagtaccatcttcctgttttccccttatacttccagaacagtacagtaaagtaggaaacagggaaaagcttggaaaatggaggactgactccaagaggacaggaataactaccctcagcttttaaactgcctctgcaggcaaaactcacaaatttgtattcccccccgccccaccgcccacccaacttctttggagggaaaaattccattggtcattaatactgggaggaggccatgtcatagagttcattcagaggcggaagactgaaaataataagccagatcttaggctaaccttctcctgtaacagagaagtgacccagaatcacagctgtttgatgaataatagaatttgcctggcatatagtttaaatttcaccttcttatgtgacttggtgttctgtgttttactagttggcatcatgtcagatcatgttctaccctcctcggaaacttctagtgctctcagttacttacaaaataaaatccagaattggtgagctgttccttaaggctcttcatgatgtggaaatagacctcttagaaaaaggttgcaaaagcaatgcatactcattatagaaaatttggaaactaaagaatttggcaaactttttctgtaaagggccagatagtaaatgttttaggctttgtgaaccatgctgtgtctgccacaactactcaactctgctattgaagcacaaaagcagctacagataatgccagtatgtgagtgaatgtgtgtggcagtgttctactaaaactatatacaaatcagtcagtgggccacgtttggttcgcgggttattgtttgctgaacactgctatagaaaataaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgtagccataaaaaatgatgagttcatgtcctttgtagggacatggatgaaattggaaatcatcattctcagtaaactatcgcaagaacaaaaaaccaaacaccgcatattctcactcattggtgggaattgaacaatgagaacacatgaacacaggaaggggaacatcacactctggggactgttgtggggtggggggaggggggagggatagcattagtagatatacctaatgctaaatgacgagttaatgggtgcagcacaccagcatggcacatgtatacatatgtaactaacatgcacgttgtgcacatgtaccctaaaacttaaagtataataataataaaataaaattaaaaaaagaaatgaaaaaaataaataaaaatcactcatagtcttgccacaaaaatgttaacatttttgcttattctccttcttctcttcacattattttacatgcttgtgtctatactgtatattgccaattttatacctgatttttttcactaagcatcctcataaacgtttcctgtgttatttaaaacttgttggcataactcttaatgcctatgtggtactccatcctgtatgtaactggatcataatttacctagccatttcctttttttttttttaggggggatggattcttgctctgtcacccaggctggagtgcagtggcacgatctcagctcactgcaacctctgcttcccaggttcaagcaattcttgtgcctcagcctcccaagtagctgggactacaggctaccatcaccgcggccagctaatttttgtattttttagtagagatggggttttaccatgttgtccaggctggtctcgaactcctgatctcaagtgatccgcccacttcggcctcccaatgtgctcctatttttttttttttgcagttataaactttaaaaagtttactcttgtacaaatctttgtgtttcacattattttgtaggtcactttccttgaagtggagttaccaggacaggggtatggatgtttttaaggagcttaatatctctttttttgttgtttttttttaaaaaaggtagtgcttatgtacattcctactagcagtggggacagagagagcctcttccaactcatcctcaccaacatcagatattgtcactaaagcaaaatcttttttttaaagcaaattttaaaaaaatggcatctaagttaatgtgtaattctttgttaaggtgattggagaaaaagtttcaaatgattgttgaatgatgaatgggatcacatagttcttctttggctcagtttttcataaatgtaccttgggccctaacttgcttctccttttcctcatgcagttaccccctttcatctttctggctccttctgttaaaattctacttattctttagggctcaatcctatctgtattcatgtacctgtctgtggagtcctccctagttcctcctactcgatatgatctcttgcctttgaatccctgtagcactgtgtacctctcttgtggtatttatgtctttctgcccctttttttggttatctctgtactggctttatgcctatggcatggacactgggtaatgttatctttgcattgactcccagagcctagtagagagcttagtgtacaatgggctgattagcctatcagagctatgttgaaaggtgcctaaggtctgctgcagatgacctttcaaaatattcgatgttgcaattacctgtgatgtttacagaacggattgggatcactgataagagatgctttgctggttacttaagatgggctgtatctataagtcctagtcactcttttttgtgaaatttgaatcatcaaattttccaagtagtgataaaaaacaattttagcatatgttaggctattctcttgtgtatctggtagaagtttatgtgatgatggaaatgttttatatctgcactgtctgatatggtagtcagtggccacatgtggctattgtgcactgtatatgtggttactgcaaatgaggaactgattttttttttcattttactaattttaaatactttaaatagccacatgtagctagtggtaaccatatgggacagtgcaggataatgtagaatatttaaagttatggtctcttttttatggccaaaagaagctgggtatgtatagtgacccacagtaacattgacattgtagttttctggaattttggagaggcagtctagaccctggtagagccgtagagagagagagagagaggggaagccataagtttggttcaaaatggaaactgattccagcgggaggtgtatgttgtgagaaaagggagatgatgccagattggtaggataaaggcagagtacaataagctggaatacctagaggagacatatggacatgatacgattggtgatagggaaccattaaagattcatgaaaagaggagtgatagatgagtgtggtgttgcaaggtcacctttgccaggcgtatgaagctgctgggaaaggatgtgagttattggcccctccttcagtggatagggttgggcagtagtgattcacaaactccatcaaaacccagccacatcagaaaacacaaatgatttatttttgcattagcttccagttattgtgtgccttcctgtggttcagatatacaccaccatatattgtggagggcttgtagctggggggctgtggagaatggccgcctatgtgacaggaggcaggccagtcacctctgcttagccacaggcaaaattgccatctgtgaccctggtaccttgaaaggtgtgtcttgaatggctctttgactcttcagaaacaatctgggagcccattcattctgttctcacttgcctgcttcctttaagggccgatagcaaatttctaattttactgttaggagaatattttcaatctcattttttaacctttaaattaagttgaacctttcaattaagttgaattaatatttcttcccactacctactccttactgccctcactccgtcctttattagattgcttatatttccataactgcatcgtgaccttagcacatggacttaatcattaactatcgtattcctaaagaacagcctttggactcattttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagaacggggtttcaccgttttagccgggatggtctcgatctcctgacctcgtgatccgcccgcctcggcctcccaaagtgctgggattacaggcgtgagccaccgcgcccggcctggactcatttttaagaaaaagaaaaacactattaaagggattctctctcttctcacactctcccacatgcccagctaacccagccaccctcattctctaccctacctgtactcccaccctccatgcccactttggctcagggagatggtccagctgaggaacagcctcccttttgggaaaacatgctccatttaaatcatacgtagtaagtcttcagaaaccctgaccctggaggggctttgggacacaactgacaattaaatctcctggtgtcaggagatcttgcaactgagaactgagtgccccttccacctcactcataattgacaggggccagtgccttgtgtgggcctcacctcacctggcatcaccactcctcacccaaccttacctcaccttaccccaccttaccccaccatacctcacctcaccttctctcctgctcttgagagacaactaggtaactgtgagtagcacttctcccttggcatagtgaagcagcttcctcactgatgctcaattcaaggaaagagaaaagttcttgtcttgagttaccatggggcgggggggaaggggaattttttttaaaaaactactttgagcttcacacttaagatttttacaaaaatcaattatatttggtttctcttttgatcatgaaggtggtatagtttaagggttgaggcatggatactactggaatcagacactagtggactagaattttggttctatcacttgctagctgtttgaacttggggaagtttcttaatttctttgaacctcagtttacttgtctgtaaaatggggataataatgcttgccttgcatggttgttgtaaagattagagagtgtctgtacagcatgattcctgggacccagtaaggactcaataaaaggtagttgttattattaaagcaggtcatttatgtttgtaacaaccacagggttaagctcattgtcccaatatccttttatctcatccctcagcatgcttgcttttgccttcctgaagctgaagatatttatcctcagggcaagagacattgggtgtgagggatttaaggagacagattttcttgacagagggattcttaggtcaagatgagtaaggaaaactcgagagctggatgagtaaggaaaactcgagagcggcctttgccaaggaaatctaaagcaattgccaccctgttggagaggtttctgtcctgtctgaaggtaggaatgggggatagatggatgaatggatgacagccttctgctagccttttgaagagtacattcccaggaaaatagcctctactttctgcagtgtgggagtgagggcgggggatggatattgtttttgagtgaaggaaaccttgtgttccatacttaagcatcatgttcccccaccctgggatgctctgttggcctgatttaaggaaagctttccagttgatcttttaatcttcagaaataacaccagaaatcagttatgccatcactttccttataaaactaactagctttcatttagcagattttgttctagggattcagtgtgtctggatattgaatttttgtactgccggggcaaggttttctgagagtggtatgtttgatgtgtgtggataaggggttgggggtggctcagagggtgagggtgtggagcattgtcttcaaaatccctgagcaaggctgagggtgtttccatgtctactgccctaatgaggattctagcgaataggggcagtgctggctcattcatagatattaaaataaaatgttaagtgggcttccttctaagagtcaactctaaggcattctctccaaatttacttgtctctgttgctatctcttttgttagaatgagaagatactcttgaaaaactgtttatgatacaaatctatatgttaaatcctacttttagtgcagagaggcagcttgcaaaaagtacattccacggagagccttttagacaaactcctttggtaatgtgaattgtagcctttgaatttcttggttgttaaatcttgatttttatgtataggtttgcttcaagcagtttacctattttttacattttagtagaacgactgggtatgttccttttataaaatactcagggaaatggaaccagtgtcatggtctcccttgatctaagttcccagagacttaagacctcagagctgtagcagcaactcagcgagttccatcagcataccggttcccagcagcttttctttatctgtattttaaggagttgtatacagagtcacttttcatgatgacaagatgcagggtaatatgatttgaaaaaagaactgaatgaatcttttttttcccctctgtattttaatggaggcaaactgaatgaattctttccttagtctcttctgctggtctttgccttggttgaaacctccttttccctttgctcagccaccctctggggttacctgctgcttgggctgaagtcctaaggcttagcgacaagtaaccatgtcatgttgcctctgaggctagtgggcacagctgaacactaatatttgggccctaactttcagcttgatttgaagaaatgccactgctaaatgtcatctttttttgtggatccctatttgactgactctttggataaaacaggtgggcaggcaacaaattaagtgggaaatgtttctgtgaaacaaatccgtttaatagtgttacctcataaataagtaacaaacacaactctaccccctaacccgcactagcccatatagccagaatggaaaagtagattgtttctttgtcgcttctgttatggttttacttaaatgaattatcagatcagacccctgtttgtacagaagtttcaaaaatgtttgttgtaaattgatctgagccaatttgattttccacagttaattagattctattctggtaggtatcattaatctccaatagtcagaggtaggtaagtgctataggtttttcccccacaaccagtagattacagtgaaaggaattctgattaaattctgccacgtaactttattaataatcaggcacaagacagttatacagcctgacctgtacacccagagacattccagtactttttttgcaaaccaccatactgtgtgaagggttcaccggagatagatgtgacgatattttagcagtaggactcagcttaccttctaattagagggcacatctgagtcctccattaagtgtctggacataagatttgttgggactcctgagcctaaggtgtcattttaaaggggtgaagaatgttgggctaaccagagtcttatatccaattcatgcaaaagtgggagcaactgaatatttctaaatgatatacctgtcctgaacactagccagtttccctaatgaaatatttctagtatccattgttgtaacgaacaaacgatcagaagtacttcagagctgaggcatgtaagtgtgacttttttccccattagaaaaaagttaaggtatatttaacatacagtaaaattcacccttctaatggtacagttctgtgagttttgacaaatgcatacagttctatgaacactccagtcaagatagagaatatttccaccacccccaaagattccgctgtgccttgattgtgggattttttaagagcagctttactgagatgtaattcatataccataaaattcacctacttaaagtgtgtaattcagtggttttcatatactacatttaaaaaaattagttaaatatatacatataacatacaaaatttgccattttaagcatatttaagtgtacacttcggtagcattaatttcatttgggatgttatgcaaccaccactcctatttctagcacttttttttttttttaaatcacaccaaacagcagctctgtacacattaagcaataacttccaattcttaccttccccaggccctggtaaccactgttctactttctgtctctataaatgtgcctattctaggaacctgttatcggtggaatcatataatatttgtccttttatgtctggcttgttttacttagcaaaatgttttcaaggttgtagcatgtatcagaactttgttccttttttaagggtgagtaatattatattgtatgtatagatcacattttatttatctgtcagtggacatttaggttgtttctaccttttggctattgtgaataatgctgcagtgaatgttagcatacaagtatttgtttgagtccttgttttcagttcttttgggtatgtatatacctaggagtggaattgctgggtcatatggtaattctatgtttagctttttgaggaactgccaaactgttttccacagcaactggccactttacattcccaccagtaatgtacaagggttccaatttctacatatcctcaccagcacttgttattttctatttttaaaattatagccatcctagcagtatgaagtggtatatcattgtggttttgttttgcatttccctgatgactaatgatgttgaagtttatttcatgtgcttattagccatttgtatatcttctttggagaaatgtttgttcaagttctttgcccattttttgaaaaaactgggtttttgttgctgagttgcaggaattcttgattgtaggctttgattagaaatttcagttgctaactaatatcacccctggagtttgtattctcaattaggggtcttcagatgttaacaatggtgtgtggtaaatgtttaaagctctgatttatggcatttgccaatttccatggtcaattccaagctaccagtctgacccctcactaaggtagcaaaggagttgggaagagatgtacacaatcaactctttctagccagtgctattgggcttccagcatgcaacagaatgttaactcaccaccctatggtgtagaataaaactaacacagaggcatatttatcacagtgtctacactgaaactatttaaattaaattagacataactaaataattttcaattacaacactttagctccttcaataaaagcaagaataattatttgttgagcacatcatatgctagatgtgctccaagtattaatagatattattagtaaatagaggaggaaatgtagaataagttagtagtaggctgggacttgaagtcagactccaaagcccatgtgtttgatctctttactgcactgtcttctatcccattagtggaatttacttactgaatgttgactactataaacagagtagactactttcttctaaccccagggatgcttctgtgttactttgtaccctccagcctctctaaatcctgttcaaattggaattgaaaactaaagctgtggtggtaccacatatcaaagaactgtaaggggttaaaaatatccttttcctcgttgcaaaaaaagcatgtgttgtaagaaaaatttaagcaagcgagaaatggcaaaaatagaaagtgaaagtcccccataaacccatctgccagagataatcattattaacaactagcatttattctttcagagctttttctttacacattttttttaaaataacaatgggatgattccttataatctgagtctcttttcacttgataatatagttaggctattttccatgccagtgtgtatagctctactttattcattttaacagctttgcttcattcattttaacagctacataatatcccttgtgtgaaggaaatgtaagggattttgaagggctattttgaagaagtgatgataggtggcacatgggacaaaaaggttgaaaactactgttgggtaccaacaatagaggcactatactttccatttctccccccagaggctactataacttacctgaaaccataagacgaaaatccatgagcactgggaagagttacaggaaaactcaaactaagctagtcagggataattgagagataagactacatatcaaattccttcacatgtctttagggctttacagccctggtctttgaaactctatttggaatctttcttaatctccagtaggccctgctttgagtttgggaaacattgttttccaggaaatacaaccttttaatttcccctcatctgttcctcatcttgagagatggccaccatcatgttttcttgctgtgataatctgtcaggttttttttttgttgttgttgttgtttgtttttgagacaaggtcttgttctgtcacccaggctggagtgcagtggcgtgatcatagctcactgcaaccatgaactcctaggctgaagcaatcctcccaccacagcctcctgagtagcggggactgccaccattccttgctttttttttttttttttttttttttttttactttttttctacagatggggtctcactatattgcccaggctattttggaactcctgggctcacatgatcgtcctgccttggcctcccaaagtgctggacttacaggcatgagctgacatgcctggcctgatatgtcagttttcagtggttgtcagtgtttctttgttttctcctctgtcctaggcacttgtcactaggaaagtgcctaatgactccatcaggtgtggcatttattattgttgcaacagggaattgataagagaaaagaaggctatctgggggatgagttagccaagaagtggaagaagacagctgttattaggttgctgtcaaaatagcttgctttactctctggcatgtatcactccagggaatgaaataatccaagaatgataagctctcaattgccatctgttggtttgtgatgctgcttgccttgttctagttaacattgaacactgacctcacatggcacttggagaaacttagaggaggataagatgatcatagggtgtaaagcaaactgactgaacgcttgcagagagatgggctaaaggccagtggtatcagtttatcaggatttgtctgccttacactctcttatccttccctctttaccccagggagctggcagaatggtgtttcctctgtaatatgacatatttagattcttttaccagtttaaagaagttaatttaatgggggtaaagggggctaagtttttagggttggggtcaggtactatcctttataagaaagattatgggtgtttgaagctcatgaatggacatgtcattatctttcaaattacatgctaaggatcaggtttgtatcgtatgtattttactatgccttctggtccatatctcagacaaaccactctgtgccagctgtgctaggtgccagcagccatgaactgtgccagagaccctgcctccctggcttaggttgattggactgagtggccacctgtcaccaagacagcccatctgtcacctagcaggtaacatgggcttgacgagctgagagctgggccttttgtattcctctcttaggaaattagaattgggaagctgagagcctaaggcagtttgtaacggaaaagagccaaaagatgatggggagtggagcagtcatgacagttcatgtcctagctagttttttgaagggacagaaaccatgagcaaacagagggaccttgcaagggaggaacagagatgccttgagagacagaagagctgtttcctacagacaccatgaacccagaaccactttccagttctcctgaggcccagctttatcctaccctaggattcaaatgggatacctgtattctttccacaaacctcccttttcttgagccagcttgaatgagactctgttttcccacaatggaaattatcagaccagatctaggctcctacctttacaatcgacttctgggttgagtcaacaacagttggtttacatttaaggctgacatgaagtgctgaagactattctaggtattacggggaacagtggaaaaacacagatacctgattatttctgtcaagctcagtgctgacgttatgggctttgaatccgtgttcctggcaaacagtgagaatgaaaagaggcagggatcctgactgttcatttatcacttcacagctctcaaccaacagggggccttctttatcctatttaacctctcagtagagtatttgccttttgcttattcctctttccagtcaactcttgattattcatgtaatagaggaaagcattaatgtgaatgatagaagactgccccaccttggcctctcttctctgccacagcagcatccagtcacagaaatggaaacaactagcaggagaggtaaggaggctgaaaaaaggtgggatggggccaagcaaattaacattgtttcttctacttttataccttctttctgttaataaatgctgcctgtttgagtttctcttctggtgtcactaggagattgctggaacagcaatgccatttgcttgatttaagtcaaaatatgggatcttttaaaaaactaaaatagagttgggggcaattgactaggctgttagtttcctctcccatctattgtacccccttttgtcagtgccacccagctttcttgttggctgagtttaatgttgggccactagcaaccattctttgttcaggatttgggactcagctagccaaaatatccacaatagcatttctcaaagtatggttcttgacccacttgcatcagagtcaccatgtgtgctttttaaaaatgctgattccttccaccttgaatccattgaaggaaaaatgctaattcctgggccctatcccagaactattgagtccggatattggagtgggggacagaaatggcttggcttggaaatatgaattttaactcacccacctccaggtgatatttatgtgctctcaactttgagaaaggctactctgtaaaatggcctgaggggatttggagggtagctctgggaaattatcaacccttctctttcactcactatttgtagagcaagtgagtgggtggggagaggaaagtggggcattccaggtgtcagaaggtatttttcaaagtgcagatagttaaaggctgtctactgaaaggaaagtgaagaaaaatagagatgccagcatgctaaattagatgacacttaacactcaaacatttgttgaattaatgcctgaataattaagagttgattgggcagagacacaggaagattgtgtttaagttacagacttggcttgcatccgtgtttccttctaaagagaccaccttctccatttctgcattgtctttctttagagtgaaaatagctagtcatccccaacatatttggggttttgtggtaatttaaatatctaataggcactgcataatgccattcaatggttgtacctaaatataaccctactaatcaaaatgaggatattgtgtttaagagtctggctatatagtctctggtctgattatagtgttgagtcttttttcaaaaactgtctctatggagtaaagcagggtcctgtgtttcattgctttccagacattccccaacaagtgctgaatggattttgttgcaaaagtttctttggaagtctatttagaattcagattgcattttcccaaggacacaatattcttcttgtggttcaggttcccagaccagctggcaaaagcctatttaatgtgaagtagagtagaagtccaaccccaccagccccttaccagaatgcctaaaaatatttttgatggggaaaagcctcagggttcagacctgtgatcctaggcatacatcccagcttcattctctgagcagcatcatagggatttattgttggagggaacaattcaaactccttttctaggtctcctaggctttgtgtgagctgacctttctgctcatctctccagtatcatttcttaccatgtttcctctggcactctatactatccaggcaaaaggaactactttaagttccctgaacgcatctttgtaacctctatactatccaggcaaaaggaactactttaagttccctgaacgcatctttgtaacctctgggtcatttaagcctttagctatgctcttccctctgcctggagccttctcctcttgcctatcccttctcactggtgttttgtgttacagctctcaaagctctgatcatcgtttttattatagagtgatttgtatgctttatgtcatttatcttcccttctgccagactgaatactccacagaaacaaagaccatgtctgtgttactcactgtagtatgcccagcacttagcatagtgcctggcaagtagtaggttcttaataatgatatggccggtaaatgaatgatgttgtccaggggttcccgccctcttttacagatgtggaccctgagatttagaggggccaagtttttttttttttccaagtccatagcagctgttttggaattagaacttaggccttctgacttccaggcaatggtattttcttccagaggtatacatttctgtaaataaagtctgaatgcattggaataacttaccctgggggttatttgtagcagtctcaaatcatttgatcagggtcactactggtgatatatagagggaaataggagagtgaagtaatgcagaacataccttctgtaatttagatttggatcatttttgctgggcctggagaggaggagctaggggagtacagcttacccatggcgctgcttacggaatttagacataagagatggctgttcattattctgggattccacatctgtacagagtgtagaacataactgaatactcagtaggtatttcttgattatgcgatttgctaaaatcactctgctagtgtgttaaaaataccatttagagttttctataccatttaccatttaattgataagcatgtggtttgataaatgttgttgttattattgttattagaagtagttttatgtagttcttatagagatataagggcctttagatcatttgatttggggccctgcctcagctattaaaaattgcattgtaccttaaatacctgttgcctaatattgtttgccttctcattgtgactcttgggggtttctgctgctcagaatagaatggaatctttcataagactggattaaagggcatacggcctaatgcagcagtctctaacctttttggcaccagggacaggtattgtgaaagataatttttccatggactgaggtggggggtgggggaggatggtttcaggatgaaactgttccacttcagattattaggcattagattctcataaggagcatgcaacctatatccaaagcatgcagcctagatccctctcatgctcctatgagaatataatgctgtcactgatctgacaggaggtggagctcaggtgatgatgctcactcatctggcactcacttcctgctgtgtggcttggttcctaacaggccatagattggtaccattctgtggtctgggggttggggacccctggcctaatggatcatcttagtaaagttcagaggcatttaggaggaagacccatctgatgacatgcaaggaggaaatatctgtagacccctggagaagagggaaagcagtgcttttccatgtgtaagcttgggactgagggttggatttttgtggtaggtacatgactgggtggagaggatgacattcctcagttctccatttggctttcagtaggacacacttcaggagtcccacatcaggatggctttttttctccctgtggctaattaaaaccatcgtaagcccaaaagctaaactcaaaggcctttgagagccttccattgggctgcccaaagtccttagaggctggttggccaatgtaatgaataataaaggaaattcattgaacaccgttaagaaaagataatgcatgttttccttcaaaccatcaatgctttgccccgtcactgatttgcttgtgcgacccttcttttatgtcactctgaataaactcccctttgtctttctgggccgagggaaccaaatgactatagagggactcttattggagtcacacatttctttcctccttgtgactgccaaaccaccaaactctgggccatttgcatgtgtcttaatttctcctcataatgtggcaaaacacgttttggtgctaggtacgatacaacccttcctggagtgaaccaaatgtggaaagtgctgtaatttgagggagttttcagaaaagagcctcttctggtacagaaaggccctttttccttttttctttctcttttttcatttatgcctcatcatattttgtccactttcagctcatctcaggctgaattttccctttgatgtctgctttatagaatagcccttgcctgagaaaagagaacaaaaggccaactctgtggctttcaatttgcagcgtccccagcccttttatccatctcagtgcttccctggttgggaacaaaacccaagctccagggtcagagcacatacggaggaagaaccctttttgaaaatccaagcacatgaggaattcatgtttcattgtcatcctgctttgcaattgggtcaggtacatatgtggggaggagagagtgggcttggaagaaaaaaaattggtttgttacctccacaaaagcagacattctgattttcccccagaagttccattaagaagaaagcaagtttttaagggtttaattgctaattcagggttgctttcagccattagggcatctgtatcaaggcgcctagtttgggaggtggaacagaagtttgacgtgctaacatttgggaactttctcagacaggatgtctttgttatctaatttctttccatttttcagtacctgctttcagatttctactttttctcttctgcttcctttggtttcaaatcacagaagacctatctctttgtgctcccagcttgttgtcttggttacaggcttcttcagcttgccttcctttgaggggaatatacagtgtaaagaagattttttaaaatggtgactaaggtccctttctctaaggttactgggatattaagcagtgggtagaacagtgacttgtaaacccggctgtacattgaaatcagctggagcactttaaaatactgatgcccaggccccaggcccaaccagttgagtaggcatcttgaggagtaggccccaggaatttttttttcttttatgaaacaataaactgcctacgtgagtctaatgtgcattcagtatttagaactgctgggttttacagcaaagccaaacaacttggttctggctgtttgagccaggtgaaggaaatagaatcaacttttctgtaccttagttttacctgcctagaacagagaagcactaaagcttaagaatttaaagaggcttactgtgacccccctgtcattattgttgcatacaaaagagaggtaactttctttcaaaaaaaaaaaaagaaagaaagaaagaaagaaagaaagaaaatccagttattcagctggcttggcttctgggctgtaacagtggcttgaggattaaaagaaatctttccagttgcttgaagaagggttatctgtatggaggaacagcagcttcattcccagtgtggtttggacagcgcattccaggttttcaaacctgcctcagcttccagctgactcccttctcatgccccaggtggttagcagagttaggcaccatacttatatttttagtgaaattgccttttaatagtattttcctaacataaaagcaacagatgttcatgattcaagcccggaacattataggaatatgacacatagcaaacaaaagtcccctagaagtcggtctcccagacatatccattgtaagcatgtttttccttctgatttttatctctgcatatgctaaacattttatatttttattctaaaaatgggatcattcaacaatgtttgtatttttttttccttaatatcttagccatcagtccatgttagtacatataaatcaacctcattcttaaggacccctgattcttaggattttagtcacacaagggcacaatctccttccgcttccctccaagattttgctttcctatggaaaggcttgggttttgtttgtttctttgggcttcaaatagagcaaatccattatatctggtatatttatgtttggttgttatttaaaaattcatacaattttaaaggaatagaatagcatatatgattccctccaacctctgacccctgatccactagttcttctccccagaaacaaactgccattaccagattcttggaaatcctgagaattactgcatgcataaacaaggcttgaatattctaaaatggcttttgcttaggtaaccaagtctatccatattgtatggagacatcttgtttcatttattcattcagcaagtacctgatgagcatctcatatgttccaggcactgtgttaagttctggacctacagtgaggaccatcacacagctcctgctctccagaagcttatggtcagcagggaagatcaacatttaatgaaaacatagctaaatataaatgagaaatggtgatatgtgttgtgaaggaaaagaacagcatttacatgcatctgtttttttttttttttttttttttgagacggagtcttgctctgtcgcataggctggagtgcagtggcgccatcttggctgactgcaccttccgccttccaggttcaagcgattctcctgcctcagcctcccgagtaggtggggctacaggcatgcaccaccatgcccagctaatttttttgtatttttagtagagacggggtttcaccatgttggccaggatggtcttgatcttttcacctcatgatctgcccaccttggcctcccaaagtgctgggattacaggcgtgagccaccatgcctggcctacatgcatcattttttaaaacagtgattaatggagtcccctttcccaattttttaatacaaaggtgtggatgggagatttgcagcaaagataggaaagcaaagatataacccacaatctttactcttgccaacagctcttaccttctttcccaccaaaattttcctttgataaaatgtcttgctgagagttaggctaactcaccaaccagctttaattttggttgacagggtgccgtagaagacctttgctagccagactgtgagcttcttgcagacaggaattatgtcctgcatcactgtgtgctcagaacctcaggaagaacaaactgatgtaggcaccaggaaataggtgcttttattacattctcattttatgccttagaagcactgcaaatggtaggtattcttatttctgttttaaacaatgagaaaactgaggcttaaggaggtgtaaaaaatactttcttttaaaaaaaatacacctctcccccaccatcataaaaaccccaactttggccatagagttcattggtggtggagcactgcaaacattagctgtcccatgtggctttgactctgacacaattggtcctcttgcttcagggaactggataccatccatccctcccatgggttggcctaggctctgttacttcagagttttcttgacgagtttcaaggtaaccaggtcatcctgttctacatatttttctgggattgaggtcaaggagcagcatgatcctctcttaaatgggtcagaggaggaggactcctgtggctccctgaaaggtcaagccccttcatgctaactacaccgtcttcccttctcttccagcttatgtcctgggctgggctctggacagggagcagaggcagatgtgcgcatgtgttctggaggacttttatatgtccgatggtgtgttaggcactatgtggagtggaggcagagggaactccagaaaagataaattatcttatggtggagacaaaaggtagtattggcaacaaacatgacctctggaatcagatagttttgggttccaggcctgactctttgactcacttattagttgtgcgaccttaggcaatttatttaacctttctgtagctcagtttccttgtatgcaaacaggaggaaaataataatctcttacataataggattgctatgaagaatatatgaactaatatgtgtaagacattgactgtagtgccaggcacctagtaagcactcagtaaggaataactactgccattattgttgttactaacaacagtatgagactaataagtgattagtgtataagtaccaacaaataccaatggagttcagaaaaagaatgcttaatttttgtgacttatccaggaaatctctagaggagacagaagaagtggaatgaaatattccaggtggagcaaatatgaaagtgggaggctgaactgaactggagtggggaacaaaaagaagaaacaaacgcaacatctggcacccttgagctctaccaccagctcacctgttgtcactaccaatatgtccagtcctttatggctctccattttggagtgccctgaattactggctgcagttttgacttggccagctagttggccagctgctctgactgagcttgagggtgtctgtgccttggtggagttgacacgggtcctaactctgcaacttggtttgtaggttcaaagcctaatttttatcagcttacccagggctgttggtttctagtggattgggtcacactccccaacattacaaaacacttcttaataaatcaccaggctgataagtcgattgatgatgagagagagacctttatagagatgagaacacttgtgtgtatcagccctttctgatatcaaggtacctgaagccaaattaaacagggactgttttataacctaaaatcagaacctaatggagttgaaaagtctcatgagcgagaccatataggctttggtagtccatggaaaactgtacctttttgcatgtctgtcatagctttgtagtgtgaccagaatgtgtgtcctgttctctctccactgctggagaaacatcagtaacaatttttctcttggatgttcctgttttcaattccatgcaaatgctgtttgtgtgctatggccatgctattctcttgaatttcttttttcttgacaagatttttgagttgcctacttctcagcgacaacatagtgattctctcattgagtgttctttttggctttgttctcaaacactaggaatgtttccaagcagggccgccacgaatggctatgcactgcacaaccctaggagagggtgccattcacatagactataattgaatggcgccactagggttgtgcagtgcacaacctacacaactgtactcggcggccctggcataatgtaatgtcagtactttcttcatcaaggtaccagtttgggattgtcctcagggtaagggggctgaagcagtgagctgctgctgtgaccaggaaaggaagaaagaagtaaagttgtggctttgggagaattatcttctctgtaaatgagagccatcatataggagaactacgtaccttcgttctttcagtaaatagttttttaagtgcctactatgtgagggttgaagaacagggaggggtttgcataggagggagcatttgaactgggctttgtgaaagaagtagaatattaacatgtgaagatgagtcaggaggagagaatctcagggggaaggaatagcgagaagaaagacagatgggagaccacaagggatatatgggtaatggtgcataattcatcttggttggatagaaaagcatgtaaaagggagtagtgagcaatgatgctggtcgggggtcaaatgatgatgcaggaggggagggagttgaatgcccaattaaggaatttggacttttatttatcaagcaataaggagctatccaaagtttgttttttaaacagctttattgggttataatcatataccatataattcattcatttaaagtgtacaattgaatgtttttagtatattcacatatatgtgcaaccaccaccacagtcaaatttagaacattttcatcatccaaaaaataactccatacgatttagctcacccccctccctacctttcccccactcaccagccctaagcaattgttaatctactttctgtttctatagattttatctattctggacatttcatagaaattgagtaattataatatgtgacctttttccactggcttctttcacttagtatgttttcgagattcatctgtgtttagcatgtatcagtacttcacttatttttatggccaattaatattccattttaaggatatgccacattttatgtatccatttgtctgttggtgagcatttgggttgtttctgccttttggctattacagataatacttctgtgaacatctgtaagttttcaggtgcacataggtttttatttcccttggacataggttttcatttcccccaggtataggagtggaattgctgagtcatatgataactctatgtttaacctctcaaggagctgccagactgtttctctaaaatggcagcatcattttacatccctaccgacagtataaaagggttccaatttctccacatcctcatgcacacttgtgtttgccttttatattttggccatgctagtgggtatgaagtgtcatctcattgtggatttgatttgcatttccctgatgactaatgatgttgaacatcttttcatgtgcatgttgagtacccgtgtgttttctttggagagatgtctgttcaaggttatttatctttttattgttgagtttttttaatactttagctatttttaatgtatatatttaaggttttcaacttaatgattatatatatatatggaaatcaccacaatcaagataacacatgcattacatcatagagttatcatttatgtgtgtatgcgtgtgtgtgtgtgttggaaatacttaggatctattcttatagcaaattttaagtatacagtacagtattttcacctatagtcgccatgctgtacattagatatccaggacttacttgtcctggaaaactaaaactttgtactttttgactaacatcttactttcccagcaccagccccagctaaccatcattttatactcagcttctatgagttagactaatttacatttcatatttatgtgacatcataagatatttttctttctggctcatttcacttaacataatgtcctttgggtccttctgtgttactgcaaatgataggatatccttctttttaaaggctggataatataccacattttctttattcatgcatccatcgatgaacatttatcttgtttctatatctttgctattgtgaataacggtgcaaggaatataggagtgcagatatccctttgagatcttgatttcaactgttggataagtattccagaagtgggattgctgtgtcatagaataggtctttttttttttttttttttgaaactatactatttttgataatggctctattgatctccatcagcagttttccagggttctgttttctccacacccttcccaatattgccatcttttgcattttttataatagccattctgacaagggtgacatgagatctcactgtggttttcatttgcatatccccaatgattagtgatgttgagcaccttttcatatacctgttgtccatttgtatgccttctttggaaaaatgtctattcagatcctttgcccattttaaaattgggttatttgtatttctgctattgagtttatgagttctttacatattttaaatattgacatcaaatttgtggtttgcaaatatttgctatatagctttttaggttgatgtagtcctaattgtttttgtttgtttgttttttacttttcttgcacgtgcttttgatgtcatattcaaaaaatcattgccaagaccaatttcaagaagtttttcctatgttttcttctaggagttttatggtttcagatgttacatttaagtcttaagcccattttgagttggtttttgtgtgtggtgtaagataagagtctgatttcattactttgcgtgtggatatccagttaccccaacatcatttgttcaagcaagcatcttttcccccattgtgtatttttgaccctctaaggttctttattccttttcatccttttttttctttttctcttctgatgaggtaattttaaataactgttcttcaaatttgctggttctttcttctgcttgataaatctcctgtttttagttgagtcattgtattcctcagctccagaatttgtttggctgttgtttacagtttctatctttttatttaacttttcattttgatcatacattgttttcctgatttcattgagttgtccatctgttaattttcttttttattgttgagtcttaagagctatttattctgaatactagactcctattagatacatgatttgcagattttttctcccattctttgggtcccctcccctcccctcccctttctttcttttttttttttttgagacagagtctcactctgatgcccaggctggagtgtgcagtggtgtgatctcagctcactgcaacctctgcctccctggttcaagcacttctcctgcctcagcaggagaagtaatcccaagtagctgggattacaggcatgtgatgtgccacaacgcctggctaattttttttttttttaatttttagtagagacagagttttgctgtgtgggccaggctggtctcaaactcctgacctcaagtgatctgcctgcctcggcctcccaaagtgctgggattacaggtgtgagccaccatgctcagtctgggatgtcttttcactttcttaatagtgtcatttgaagcatgaaatattttaattttggtgaagtacagtatatttattttttcttttgttgcttgtgcttttggttacatcttagagtctgttaccaaatcctaggtcatgacatgtatccctatgctttcttttacaagttttatagtttttgctcttacagttaggtctttgattttgagtgaatttttgtatatgggttatgaggtaggggtccaacttaattcttttgcctgtggataaccagttgtcccagcatcatttgttgaagagactgttctttctaccattggatggtcttgataccttagtcaaaaatcacttctgaggatttatttcagtactctcaattctattctgttggtctctgtgtctttccttaggttagtaccacactgtctttgttactgttgctttgccataagttgaaatcaggctgtgtaagtcctcccactttttcttttcaaggttggtttggctgtttggggtcccttgcatttccatatgaattttaaaatcagcgtgtcagtttctacaaaaaaaaatgtcagctgggattctgatacgtactgtgatgaatctgtcatttaaaactttcaaggaggagtgtaacaggatcagaatgctattttaagaataggaacctgacaatactatataaaattagagcaagcttgtccagcctgtggactgcatgtagcccaagacagctttgaatgcagcccaacacaaattcataaattttcttaaaacattatgagatttttttgcaattattttaaaaagatcatcagctatcattagtgttagtgtattttatgtgtagaccgagacaattcttcttccagtgtggctcagggaagccaaaagattggacacccgtgaattagagtgatgaaggaaaaacactggatacttggagatcagataggaaactgctgtagtagtttaagaaaatgatagggaccaaactaggaaaagatagtgagggtggatttcagatgtattgaaaaggttgggctgggtgcagtggctcacactagtaatcttagtgctttgggaggctgaggtgggaggatcacttgaagccaggagcttgagaccaatctgggtaacaaaatgagaccccatatgtacaaaaaataaaaaataaaaatagctaggtgtggtggcacatgcctgtagtcctaactactcaggaggctgaggtgagaggattgcttgagcctaggagtttgaggctgcagtgagccatgatcacaccaatgcactccagactgggtgacaaaccaagaccctgtctgaaaaaaaaaaaaaaaaaagaaaagaaaaagaaaaggtctaagtgacaagacaggatttggggactgaatacatgtggggctgagaaaggtgggggatcaggggtaactctgaggtgtgaagagaggctaatggattagattatagtaccttttaaaactttgtattattttgaaatgacttttgacttacagaagagttgtaaagatattacagagaattcctgtatatccttcacccagcttcccctaatgttaacattttacataactatggtaaaattattaaaactgaaaaattagcatttatacaatgcaatatgaacttaactacagtctttatttgggttttaccagtttttttcacaaatgtcccttttctgttgcaggatctatttaggatccttaattgcatttagatatgatctctctttagtcttctctaatctgtggtagttccttagtctttgcctttcacaaccttgactattttgaagagtactgttcagtttactctgtagaatgcccctgatttgggtttatctgatgttttttcatgattccattgagattatacaatttgggcatccaataaggacgatgctatcaatagctcatacttattttattccctacagtgtgccaggcatttgaactaggtacctcaagcatttaaattttacagttaccctatgaaataatactattgtaatcctcacttgacagataagggaactgagcctaaagggttaagtattctctgtaggcagctggacaagggaagttgagtaatatgtcagaatgttgttattgcaaacatggaattaaaacaagtgaagttagaggaattgaaaatttaatatgatttgttgctgaattggctcatagtagggatgaattttctattgaaatcaggataattatagctattatgtattgagtgctagctatgtgctaggcattgtgccaaatgcttttcttgctttgtttcattttgtcctctcccaaaccttgtgagacatagatactatttttgtctctattttacagatgaaaattcctctaatctcttgcccaaggccagagtgctggtgagtggcagagccaccatgtggatccaagtttgtcttaactctaaagcctgtattctttaaccacttggcaatgctaactgtcctccttccatcttcttagtagggatgaatttgccaatgggactagaaaacatgatatttatgggcttggatgtagacactgcttggttgtggacattaccaaatacatgtttgcaactctccttattttatacctcagtggttggtcaaccccattctttctttgggtatatttcaagcaggttacaatctggtctttcaagtctgggattttaacgcttaactcttagtaggcactcttatttcccttttattcaaattcttgagggaagcttctttataaactccttagactgacaaaaatagtaaaatctcagaaataggcaaatcaagggagataatgaaatcaccagaatgggcgtttaaccgtggagtgtaagggaagctttcctggagaaaatagtttaattttgcatttgaagggtagataagagccacaagaggaaagttggaaaaaccatctggaagagggaataggattagcaaaggcacaatttcttgatgttagagatttaaatttaaaaaataaaattatgaaaatgttaagaaaacaataggtgactctgtaatcccactgttataaaagattttcaaagcgtgatatcaaagacagaagccataaagggaatgacaaatacatctgattacataaagatttaaaaagcttccataaataaaaacctatcataaacagagctgcaacaatgacagcctgggaaaattttttgcaataaatttcagtctatattagctgtcattaatatataaatagctctttacaactcagttgaaaagaacacaccagctgaaaaacagtcaaagtgcacagatggtcacatcccaaaagaagaaatatggctggccaatatacctgttagaaaatagtttaacatttctggtaatctgaggcatgcaaattgtgtgtgtgtgtgtgttttgcctgttaaacacgtgataattaccaaatgataatgacctgtttgtcaggttgcagcagaaaacagatccttgtatattgctggagggaatagcaatttaaataatttttctggagggcagtttagcattatgggtcaaaagccttcaaatggatattccctttgaagatctagactgtcttctatcaatgtgggctaaggaaatagtaaaggaactgaaaatttagatgtaatttacatgtgcaaccagaggatattggttgagtaaattattgcatatccatataattgaataaaatgaaggtattggaaaatgagatagtagaagtgtagtaattgacacaaatacgttcagggtacagcttgacataacgcgcaaggctgtcatgctggagaggtaggcaggatctagagcaaagaaggccttgtccgccatccgaagaaccttgagcttttttggtaggtagtggcaagccatggaaggatttaaaatggcagatcagaggggcattttagatagatccctcttgtagcagtgtgcctggaggcaggagaccagtaaggaaattattgcagtggtcctgaaagagatgatgagggcccaagggtatgaagtagatggagtcataggaccaactttgggcagcccagagagttaatcttccttatggtgggtaacagtcataagcacttggcctcagcgatccccagatagctatgtgccatcccaggaggtgctgacaggagaactggagcttggggagattgtgtgctaggccaaacaccactctcctgtacctctctcactctgtttccctttcatttagtttgcccatatcccttcattgcttaccctggctagcctctcatttaggatggcctgtggtcactggccctccttcccaattacatttctcatagtactaacacttgctccagtgtacaaaagctatcttctttaagtgctatgaaaatgaggattgttgaatgtaacactggggtggagcagaagtggatgggaggctgaacaatggtggcagtgaacttggggctgatatgactgggggaacaggaatgggaagcaggccaggtgttggctgagaggttcggtagagaaggtgggaacctggaaccagagaggttcgcaggtagaggatgaactgggataacagctgatgcctagattggatgcttaggaaagaactaaaggttagtacagggatctttcctgaggaagctgagagagtgtgtggttttgaatggaaccgtggattttttctgggaaaaccagccaaaaaagacctcagttttataaggattgcaagtgcccaccagacctggggatgaggcaggtgggagctataatgaacctgtctttgggactctgaaactcatctatgtaaatgcaatttgctgtccagttgagtttgtgttttgagatgtctcacactgtagagagtagatcttatgagctggctgatggcacaggtgtggggctgttggggtgactccctgtgtgccatgtggtcaagggccagggctagagtctaaagaaaaggagctctcatgagccctggtatgtgtcaggtgtgaagtggaaagtgcattgaactgggagttaagggacctgggctctcatcagaaagcttgtcagaaccttttcccctcagtttcctcatctctgaaatggggtttaataacatggttctgcctgcctcccaggtgatgggaaagtggaagtgctctgtagcacttctctatatgctacctgctcatgccttttgtttcaggtgctgagctgggcagatgtcagcatgaatgcaaagtgccaagttggtactggggtatgctcagatatattctcatctttgtaccatccttgtttgaacttctaagtctcatctcttcctattctatttgcagccaaagtgatagtttagcttttcacctcctagtctaaaaatgcatgccaccaaaattttcaggcagttggaagccaagcaaagaagaaagcaaggatattcagaccaaggctgggggcccttgcacctctgaattaaaatgttagttccatgtggctctgttggctaatgttgaatatgaatgtgactctagcatgacagggtgaagaggttcagtatcagaaatctgagaagttgctaaaggaggccatgagttttctggaaatgcaatatgaataatcaggaatccccagataactgtgtaccatcataggaggtggaatgtaatgtaataaataatctttcaatcagatacatttagttatatcaagtcagcagatttgaaaaaggaccctagaggccaggcacagtgataaacctgtaatcccagcactttggtaggctgaggcaggaggattgcttgaggacaggagttcgagaccagccagggcaacatagtgagactctgtctccacaaaaaaataaaaataaaaataaaaaataaaaaaattagccagatatggtggtgcacacctgtagtcccagctacttgagaggctgaggtaggagaattgcttcagcccaggagttggagggtacagtgagctatgattgcaccactgcactccagcctggataacagagtgagactttctcaaaaaaaaaaaaaaaaaaaaaaaaagataccttctatgctgctatgctgatgatagaaataggcaagacagaaaagatgaaacgactaaagttagaaccatgactgatggaggataacaggacaaccaactgggttgaaactggaggcttgttctctttaatagttttctgggcttctagcctagggaaattgtggatcagaaccagccaaatggacttataagggaaatttgtccccgaaaatcagcttacctcctcttgtctgtgggtatagaaaagtaagatttaactgtggtgcccagtgttgcatttttacatctctgtttagcatgttggaagtgtcttgggtattccagaagctcaggaaggctgctggcatgactctggtgactccagaagtattgaggacctttctaaggtggttggggccccttcctcttctctgtgtactgtagcttctgagtgtagcctttgatgggcctgatgctgggtaactatgtgcagcctccaacttggtcccttacctaaggtgagtaactttactgctggatcaagggtaaaaaatattagctttgtttatttcttggactgctcctgaggggtgggatggggagtggggataagtcgatgtttggataattgaaatttcaagtctgtaatccttatccaaaaccattaagatcagatatatttcagaaatcagaatttttttggatttcagagaggccgtacagtgcatgtagagtcttttacatacactcccagtggggtttgaggcagtaccccgcaattaaatacattattatttttatgggaaacatatgaatattcaccgtaagtggaagaaataaagtctataagtagcctaacctcaattcaagtcgtattttgctgtaacattagctttgaagaaaacaaactttcagtttttagagctttttggattttgggattgccaacaaaagattgtggacctgtaattatcatcggctttgtatgtttaatgaaattgatcaagggaaaaggcacattcttgacagatatttcctttgatgaggtatcatgcaggtgatggactcctgactgtgttctttttaagaccctttctcattttcattcttcttcctcttcttattggcagggattcatgcaggtgtctttccttatagtgatttttcttataatacccttttcttctaaatatggactccgagagaacagaagaaccacatactaaagaacatacaagtgataaagccaacaagtccataatgcagatatcctatattaataagagctctcaacaatatagggacacatgtcaacgatttctaaaccacaccattaagtcactacaggtgaagaaactctacaaacatgagtttcattcctttgtcaatcctcagttctgctgaatgtttttgactcctgtagtagttcagtccaagggcaaaaattcagcatctcaggctaccaggagtgattgaatctcctgggacatttgtgaaacatgaggatttctggagtcccatacttggggaatcagaattcttaatgggggaacccaggaatttgtatgttttacaagctctgcataggacttttttgttcctcttgatgtttgagcaccactgcatgggggaaggtcaaactgccacagctgcaggtttccaaaggctgtaatctgggcccatgccacaccaggtatcagggaactgatttgtctgttaggacaaggttctttttgtttggttttacctgggaggagaatggaagagtaaaaccacctagacgtgcttagaaacaaaagaatcaatcaaagggaggcttggaacctgcgggtggcagtttgatagggttgccagctaaaataaatacaggacatatttatactaaaactattcattgtttatctgcaattcgaatgtaactgggcatcctgtatttttatttgctaaatttggcaatgttgagtattgataaacccaccttctcccctgggaggcaaaccagatggcatggtgtgtgcgtgttccatgctcagaatctatttttacctgccctgggttaaatttaagactgactacttgtgtcgtattgaaactgaagcattgaaatattgagtcttctcaccctccttctccctttctcatgtgtgcgcacacacacacacacacacacacacgcatgcatgcatgcaagcacaaacatgtacctgttgcctttaaaaatttttatattacattattgtgttagagttttggttattttttgttattgttaaagtaacattgtctcactctgtctggcattttttcttgctaaccattcttaattcttcttcaattgcagatctttctcctggcctgccctccatgtcggggagctatcgtcgtcttcaagtaagagaaaattggcttttgctctgttgctcttcagagtatttttgtctgtttgctaacaagactgataacacattgctgtgaacaccttgggattgtaccattttgtctttgcacttcccaaagggatgaaggtctgtgagggcctactgaaacagggaaatattgtttgtgaagacctggtttttgtcaagccgtcaaatcctttttagcaaatccttccagtaggggatgtatggccaaggcatgctcccttggaaggttgctgccctgctaaaatttctcttgagagcatgctaggggccagacagcttcctttctctcaagaatctttgctttgtgagcctactgctccactgagcatatggttcttcacattgaagggcattgttcttatgtttttatggggttttcccccctaaagtgcaaattaaagtgaggagaggaaaatgtccactattacaagttcagactttcataaaaatagcaagcatcaaatctattaaagtatattgcaggcaaatagtgtttctctgaaggcaggtttatttaaatgaaattatcaagagtcctggaaccctcattttaaccgtgagttgtgaccacctcacttatcaaaccttttattagagttgctaatgagaagccaaatcgactgaattaatttcatctcttttctccttccctggccccgattctggagatgttcctgagcagtgaaatggctgcaagccagaggaagggaacaggaaataaagagcccagcagattcttggataattgagaatggtgtaaatggctttctgatttacttaagtcattaaagtgttaggtaggggaaaaaggaccccatttgctgcttcaaatagctccctgaaatagccacttagtctcttgccttaggtgagtaactttcagctgcgtgagggataatggatcctgatttcatgtatttcttacttgaacagctcctaaaggaaaggggtatttaaccctgttttccttccttgattttccaaaatgagctcaattattcagtgtaatgttttaaaagtaacatttattggttctatttcattatgaaagtaacaattctcattatggaaaacacagggacacataaggaagaaacatcatccatcccaaatccaagcaccaagagataattttgcttattacctttcttttcttaagaagcagagatcatattgtatattgaggtgtttactgtatcttttctaaatttaacttggtttattgatacattcatataggtgtgtaaatcataaatatgattgctggatttttttttgtagtggtcctttcttttccctttttttcttcagctcctagttctacctttccacactatccctttgtattaccaaaacagtatgtatcttttcacattttactccatgtgcatagatatacacatgcatacacacatacacacacaagttttggaatgttttgttgttgttcattgtttgttttacagaaatagaatattatatatactttaatatatctttttcattctacaatatctcatagaaatctatcacagtctattgatgtagctcttattcttttataatgttgtaaaatattccatgaatgcacaataagttattcagccattcccctattaatgaacatttactttctttgcacatttctgccactacattcaatgcttaaatcaacatgattttgtatatacccttatatactgttgctttcagtttagatatagatgtaggtagaggtatataggtatatgggaatgtttaaatatatatttatgttaatagatatcgccatattgatttataaaaacaggctgttatgctacactttttgcttttgtatgtaatatgtgagattattattttcttcttatccctatcagcaacaggtgttaatggttcttttgtaattttgacaacctaatggatgcagtttcttggctactagtgagtttcagtattatctcaattttttgtccaattaaatttgttcctcgagttgtctattcatattatctgcacattttcctatgggttgtttatatttttctaatttctaagacctctttgtatattttagattttagccctttgtctatcatcattgttacagatacctttcccaaatatgtttatattgacttttttttttttttttaattatttttttagtagagatggggtttcaccatgttggccaggctggtctcgaactactgacctcaagtcatctgcccgcctcggcctcccaaagtgctgggattacagatgtgagccactgcgcccagcctatactgactttgttgatggaatatatttccatataattgtttgcatttttatatccaaatatgactcttttcttatatagcatctgaatttcaagtcttggttaagatagttttcttgaagataggtagccagttgtattggaataatatattaaatgatccctattttaccctgtgatctctttgcagctattaaatgttttatatgctaggatctacttatggattctctattctgtttcttctttttgtctatttgtgtacccaaatctcatatatttgattacattaggctttaaaaaatatttttctggggccgggcacggtggctcacgcctgtaatcccagcactttgggaggctgaggcgggtggatcacttgaggtcaggagttcgagactagcctggctaacatagtgaaaccgcatctctactaaaaatacaaaaattagccaggcatggtggcacatgcctgtaatcccagctactcaggaagctgaggcaggagaatcacttgaacccaggaggcggatgttgcagtgagccaggactgtgccactgcactgcagcctggggaacagagtgagactctgtctcaaaaaaaacataaaaaaaattcttggctatttgttgtcacttgttcgtacacacaaattttaagatcacttatattcacctacctctctcaaatactagtggaattctaattagaattgccttaagtatatatttcagtttttaaattatatggctccttttatctaagaaatggtatttctttccatctgttcacgtcttattgtttcagttagatttatctttttcttcatatctgctctatgcctttcttgatgcatttattcctcaagaattaacagcttttctgccaggtgcagtgactcacgcctgtaatcctagcactttgggatgctaaggtgggcatactgcttgagctcaggagtttgagaccatcatggacaacatgatgaaacctcgtctctaaccccccaccaaaaaaaagaattataaaaagaatagaaaaagaattaatagcattccccctctcccccaaccacgccgtaatgagtggaatatttttcccctttctattcctaagtgctttttgctagaataggaaaagattgttgatttttaaaaatatcttatatctggctatcttaccgaattctcttgttcttgtaaattttattttagttttatctcttcttttccttagttataccagttatttcattttcttgttgcatttgctagaaattcagagttaaataaaaattgtgctgacgggctactcttgcctaaaactgattttaaatggaaatattttctgtactcctccatatttgctgttggtgtttgttaatagtctattatacttaagtagtttttacatttatgtagagatttttaaatatttatttatttatttatttatttatttatttatttagacagtgtctcactttgttgctaggatggtcttgatctcctgacttgaagcaattctcctgcctcggcctcccaaagagctgggattacaggtgtgagccactgtgcccagccaagattttttaaaagaaggaatggtagctgtattttatctaatgctttttctacatctattggtcatgtgggattttttcatttaaatttttgatataataaattacattgatagattttctggttttgaactactcttacattattgaaatacacccgctgatcatagtatattattattttgatacattgctgggttctatttgtcaatattttatttagaatcttgcttcaatattcccgagattagagtcatgtttttcttagtgtttttttcttcaagtttaaggattgaggccaggtgtggtggctcatgcgtataatcccaacactttgggaggctgaggtagaaggattgcttgaggccaggaattcgggaccagcctggacaacataccaggactttgtctctacaaaaaaaaaaaaaaaaaaaaaaattaaaattaaaattagcagggcatggtgttgtgtgcctgtagtcccagctacttgagaggttgaggcaggaggatcacttgagcccaggagttcgaggctgcagtgaactatgattgtgctgctgaactccagcttgggctacagagcaagactccatcttttaaaaaaaacaagtttaaggattaaagttatggtggctatgtaaaatatactgcagaatgttccttctttttctcttgtctggaatactttaactaccgttagaaattatgtatcctggctgggcgtggtggtgggtgcctgtaatcccagcactttgggaggctgaggtggtcagaccacctgaggtcaggagttcaagaccagccttaccaacatggtgaaaccccttctctactaaaaatgcaaaaattagctgggtgtggtggcaggtgcctgtaatcccagctactcgagaggctgagggaggagaatcacttgaacttgggaggcggaggttgcagtgagatgagatcgcaccactgcacaccagcctgggcgacagagactccatctcaaaaaaaaaaaaaaaaaaaaagaaattatgtatcttttaaaggtaagataatctgtgaagccatctggtcttggtgccatttttcaatgggtaaacccttaatcacctttctgatgtgttctgtggtaatctattcaaatctttttgggtcaattttggtcgtttgtgttttgctgggaaattatccatttcttctaaattttcaaatttgttgccaaatatttagttgagcatgtagtatcctcttattttataatttaaaaatatctccttatctgtagtcatgtattttttcttggacttgatcttgtctgtttttgtgttctctcctctgtatattaatcaggttagtaagcacttatctgtttttggttgctacatagaaccatgttttcaatttatttattctttctaccttatttattttttctacttaattttcagcttttatcttcattaattccctcttctgtttttttcttaatctctcaagcacaaggacaagtatttattcctttatttattttttgtctttttttttttccaatttttcttctagatccaagggttacatgtgcaggtttgttacaagggtatgttgcacgatgctgaggtttgggacatgattgaacctgtcactcaggtagtgatgagcatagtactcaataggtagtttttcagcccttgtcatcctccttccctcccctctcttgtagtccccattgtttgttgtttttattttatttttattttttgacaggttctcactctggtgcccaggctggagtgcagtgttgagaacgtggctcactatagcctcgacctcttgggctcaagtgatcctcctgcctcagcctcccaagtagctgggactacaggcactagctgtgacacctagctaggtaattattttagtttttgtagagatggggtctttctgtgttgcccaggctggtctcaaactcctgggctcaagaaattctcccacttcagcgtcccaaagagctgggattacaggcatgagctactatgcctggcttgttttaactatctttatgtctatgtgtatctaatgtttagcttctactcacaagtgagaacatgtggtatttgattttctgtttctgtgttcgttagcttaggataatggcctcagctgcatccatgctgctgcaaagggcatgacttcattctttttatggctgcatactattccatggtatacatgtactatattttctttatccagtccaccattgatgggcatctagattgattccttgtctttactattgtgaatagtgctgcgatgaatatacgggtacttgtatctttttggtagaatgatttattttcctttgagtatatacccagtaatgggattgctgggttgagtggtagttctgcttttaattctttgagaactctccaacctgctttccacagtggatatgaactaatttacattcccatcaacagtatatatgcattcctttttctctacagcctcaccagcatctgttatttttcaaatttttaataatagccgttctgattggtgtgagatgatatgtcattttgttgttgttgttgttctttgagacagaatctcgctttgttgcccaggctggagtacagtggcctgatctcggctcactgtaaactcatcctcccgggtccaagtgattctcctgcgtcagcctcccaagtagctgggactacaggcacatgtccccatgcctggctcatttttgtatttttagtagagatggggttttaccatgttggccaggctggtcttgaactcctgacctcaggtgaactgcccacctcagcctcccaaagtggggggattacaggagtgagccaccacgcttgacctgattgtggtttgatttgcatttctctgttagtgataagagattttttcatgtgcttgttggctgcttgtatgccttcttttgcgaagtgtctgttcacgtcctttgcccactttttagtcaggttatttgttttttgcttgttgatttgtttaagtttcttatagatttgggttattagatctttgtcagatgcgtagtttgtgaatattttttcccattctgtatgttgtctgtttactctgctgataagtttcttttgctgtgcagaagctctttagtttaattaggtcccacttgtcaatttttgtttttgttttagttgcttttgaggacttagctataaattccttgccatggccaatgtcaagaaggtattttctgggttttcttctaggatttttacagtttgagagcttacatttaaatgtttaagtcatcttgagttaatttttgtatatcatgataggaaggagtgcagtttcattcttgtgcacgtgtatagccagttttctcagcaccatttatttaatagggagttctttccccattgtttacttctgttgactttgctgaacatcacatagttgtaggtgtatggctttatatctgtgttctctatcctattcctttagtctttgtatctgtttttgtaccactaccatgctgttttggttactgtagccttgtagtatagtttgaagtcaggtaatgcggtacctctgggtttgttctttttactcaggattgctttggctatttgggctgttttttggttatctatggattttagaatagttttttctaattctgtgaagaatgactttggtagtttgataggagtagcattgaatctgtagattgcttcgggtagtatggccatttgaacaatgttgattattctaatccatgagaatctaatacttttccatttgtttgtgttagctatgatttcttttagcagggttttttagttctcctcgtaaagatctttcatctccttggctggatgtattcctaggcattttatgtttttgtagctattgtaaaatgggattacattcttgatttgattctcagcttgaatgttattggtgtatagaaatgctactgatttttttatatgattttgtatcctgaaacttcactgaagttgtttatcagttctaggagccttttgttggagtctttagggttttctaggtatagaattatatcgtcagtgaagagaagatagtttgaattcttctttcctatttggatgccttttatttattcctcttgcctgatttctctggctaagccttccagtactatgttgaataggaatggtgagagcgggcatccttgtcttgttccagttctcaaggggaatgcttccagcttttgctcattcagtatgatgttggctgtggggttttcttagattactcttattattttgaggtatattctttcaatgtttagcttgttgaaggtttttatcatgaagggaagttggattatataaaaaacctttttatttgactattgagatgatcatatggtccttgttttaaattctgtttatgtgtcgaatcacatttattgatttgcatatgttgaaccaactttgcatcccagaaatgaagcctacttgattttggtgaattaactatttgatgtgctgctggattcagtttgctagtattttgttgaggatttttgcttctatgttcatcagggatattggcctgtagttttcttttttcactgtgtctttgacagattttgttatcaaggtgatgctggctttgtagcatgatttagggaggagtctctcctccttgatttttttttttttttttttgtaatagtaagattggtgccagctctttcttttttatccatctgatagaatttagctctgaatctatctggtccatggctttttttggttggtaggttttctttttttacaattactgattcaatttcagaacttgttatttgcccaaggttttagtttcttcctgattcattcttgggaggttgtgtgtttccaggaatctatccattttctctagattttctaatttgtgggcatagaagtgttcatagtagtctctgaggttctttcatatttctttgggatcagttgtaatgtcacatttgtcatctctgattgtggttatttgggtcttctctcttttttctttgttgatctagctatcaatttatagatcttgtttatcctttcaaataaccaacctttttttattgatccttggtatggatttttttgggtttcagtttcattcatttctgctctggttttagttatatcttttcttcttgctttggagttggttcttgttttctagttcctctagacacaacttcagcttgttaatttgagttctttctaacttcttgatgtaggcatttagcactataaattttcctcttgatactgtttttgctgcatcctatagattttcatatgttgtttctatgttttcattaatgtcgaagaattttttgatttctgccttaattgtatggtttatcccaaaatcgttcaggaacaagttgtttaatttccatgtaattgggtcttcttggtattgatttctatttttattccactgtggaacaagagtatgcttggaatgatttctagctttttgaatttattgagacttaactttatggccaaacatatgtttgatcttagagtatgttccgtgtgcagatgagaagagtgtttattctgtgattgttgggtggagtgttctgtagatgtctattaggtccaattggttaactgtcaaatttaagtccagaatttctttgttcattttctgacttgatgatctgtctaacaccatagtggagtattgaaatccccattattattgtgtggctatctaagtctttttgtaggtttcaaagtatgtgttttatgaatttgggtgctccaatgttgggtgcatatatattcaggatagttaagtctccttgttgaattgaagcctttaccattatgtaatactcttatttgtccttttttactgtttttggtttgtagtctttttatctggtataagaattatcgacccctgttcttttttgtttttcatttgcatgatagatttctctctatcccattactttgagcctgtgggtgtcatcacatgtgagatgcttctcttgaagacagcaggcagttaggtcttggttgtttttatccatcttgccactctgtgccctttcagtggacatttagactgtttacattcaacattaatattgatatatgaggttttgttcctttcatgatgttgttaattggttgctttgtagtctcgattgtgtagttgctttttggagtctatgggctgtgtactaaaatgtgtttttgtggtagcagatattattcttttgttcccatgtttagaactcccttaaggagctcttgtaaggctggtttagtggtaacgagttcccttagcatttgcttgtctagaaaagattttatttctccttctcttatgaagcttagtttggtgggatatgaaattcttgtttggaatttattttttctaaggatgctgaaaataggcccccagtctcttctggcttgaaaggattctgctgagaagtctgctgttagcctgacgggattccctttgtaagtgatctgacccttttgtctagctgcctttaagattttttctttttcattgtccttggaaagtctgatggctatgtgtcttgtggatggtcatcttgtatagtatcttgcaggagttctctgaatttctgtaatttgcatgttgtcttctctaacaagattggagaaattttcatgaactgtatcctcaaatatgttttccaagttgcccactgtgtttccttctctctcaggaatgccagtgagtcttaggtttggtcttattacataatcccatatatcttgaaacttttgctcatttttaaaaattcttttttctttattcttgtctgactgggttaatttgtaggaccattctttgaggtctgaatttctttcctcagcttggtctagtctgttgttaatgcttccagttgtatttgaaaacttgtgtagtgaagtttttcaattccaccagttctgtttggctctttcttaaaatgtctatgttgtcttttaactcttggatcattttactggctttcttcgattgagtttcaactttctctggagtctcattgagcttcttgccatccagattctgaattctgtgtatgtcctttcagacatttcaatctggttaggatccattgctgtggagctagtgtgatccctcggatcatcacattttaaaattaaactttaggttgggcgcagtggctcacaccttaatcccagcactttgggaggccgaggcaggtggatcacctgaggtcaggagttccagaccagcctggccaacatggtgaaaccccatctctactaaaaatacaaaaaattagctgggcatggtgatgggcacctgtaattccagctactcaggaggctgaggcaggagaattgcttgaacccaggaggcggaggttgcagtgagccgagattgtgccattgcactccaacctaggcaacaatagtgaaactttgtctcaaaaaataaaattaaattaaactttatactttgagataagtatataatatgaggagatttcaaaaagttcacagaaaatggaattaaagataaagataaaaattataaacttcatttctcaacagaagctccgtgaacgtcaatttaattcatccctaaagaatgcaatttaattcatccctgaagaactgagggtactgggaatgtaactgtcaatgtattcttttttacattattaactaaagataaatgagggcctttaagatatatatttttttaagtttaagaaacaaaaagaagtcagaaagagccatgtcaggactttgagatgattgcctaatgatttcccgtcgaaactctcagagaattgcccttgtttgatgagaggaatgagcaggagcattttcctggtcaagaagtattccccggtgaagctttcctgggcagtttttcactaaagctttggctgactttatcaaaacactgtcataataagtaggtgttattgtcctttgactctcgaaaaaatcaacaagcaaaatgtgttgagcatccccaaaacctgctgccatgacctttgctcttgaccagtccacttttgctttgaccggaccactttcattgcttggtagacattgctatgattgtactttgtcttcaggatcgtgttccatctcctgttataattctttgaagacatgcttcaggatctttatcccacctgtttaaaatttccattgaaagctctgtcctcatcttcagctgatctgggtgcaattttgaaacccatcatggggaaagtttgctcatctttaatttttcagtcagaattgtgtaagctgagccaattgagatgtctgtggtgttggctatcgtttctgctattaatcattggtcttcttcaattaagaaatgaacaagatacgaattgatgtaggtagtctgccactgcaggcttcatcatcaacatctcaccctttcttaaaatgatgacactctggggactgctgtggggtagggggaggggggagggatagcattaggagatatacctaatgctaaatgacgagttaatggttgcagcacaccagcatggcacatgcatacatatgtaactaacctacacattgtgtacatgtaccctaaaacttaaagtataataataattaaaaaaaatgagttatcctgtaaactgctgatttcttctgggcattgtctctgtaaactttttataaagcataaatgatttcaccatccttccacccaagcttcactataaatttgatgtttgttcttgcttcaattttagcagaattattgttgttctggtaggggctcttttcaaactggtgtcttatccttcttagtgcctcaaactagatcctgttcagacatgttagaataagttagcacgagtttattttggtgctgaaaatttgaaatccatgcatagttttttgtaataatatgtatttcccattaacttattgaagacctgttgtctattaagtataataatgtagaaaaaataatataggaaaaaacacaaagaaatcccatgtaccttttacctaatttcctccactggtaacctctggcaaaactatagtacagtatcactgccaggatattttcattgatacggtctgataaagcagaacagtcctgtcaccatgcagatctcttctgtcattcttttatagccatacccaccatctacatatctaaaccccatccctgatccctggcaaccatgaatctattcttcatatctataattttgctattttaggaatcttgtgtaaatatagttataccttatattacctttgaggctgactttttaaaaatcacctagcataattccctggagagttatccaactttttataatacacaacatttttttctgttttcgagaccacgttttgctctgttgcccaggctggagtgcagtggtgcattcacggctcactgcagccttggcctgcttgacttaagtgatccttccacatcagcctctcaagtagctgggaccacaggtgtgcaccactatgcctagctaataattttttttttttttttttttttttttttgtagagacggagtctcattatgttgttcacactggtctgaaacttctggcctcaagtgatgctcctgcctcggcctcctaaagtgctgagattacaggaatgagccaacacggtggctgatacacaccatctttaatgggtgcatattattccattgtgtggaaataccatgttgagttaaaaatcagtattttaaaaagtagagagcccttaaaatactttaactttacattagtattgttctttactgtttaaaagttctttgctttaaattttctcatctaatctttaaaatagtattgggggatagcgaatacattatccatactataaatagagcagtaggggaccaagaaatattatataacttggctaagattacttcgtggcagagtcaggattcctattctttcttctcttgccagtgatcataacataatcaggtttactgtgtgcctaggcatggtgggaaacacttaacattgattattttatttaatccttctaacaaaactgtgtgggaagtactaatagtagtactggtactattaatagtagtttggtcaagagaactggggctcagaaagtttacatgactggatgtggcttgcatgtggtacatgcaggatttgatccaaagtttctctcactccagagcccatgctgctaatcatgaccttgtgttgctgaagtgaatattttctactatcccattgttgtttaaattgttaaaagtatgaaagcatcttatttaaaattccctatgtctcagtatacatggatgagctctgttgtgatctttatgcccgtgtgttctttgggtttgttgactagcatcatatacctatctctcttgctttctctatgggccctttgctgtgccagccacacatgagtttaccagcttcccagctaaccaggggccagcatgttcttcctggaggcatgcccagccactataggaaaggggtatgacgtgtgcagcaggctgcatgtcctgtgcttggcaaaggctggcaactcccactggggtggagaagggacaggattctccacatggttcccatggtacacttgacaagagggaatgatagtaccacagtgttatgtctgggtcctggaatgcttcatttatatgtacctcagttgacatgtgacttgctcagtcctgctgctatagcctgctgctggaagggctgcctcagtggaaagcatgcatccagggtgtggagccaaaattagaagggccaaaattctacctggcccactaccacagcaaccttgggcatcgttttcttttgatctctagtatctccaactcctagaattccagcctggcagtcttctgcctctgaaggcctcttatccttcctgttcttggctcctcttctctgtgaatgcttacatagcagcgtcagagttgtttgttgtattgtgtctgtacatgcagtgctgttctgtatctctttgaatctgagccattttcttttgactcatttggctgatgtgaatggtactttcctgaagagctatctaccagtgccgttgacatccaagccacagaattcttttcctcacttcggtttgaataaaaccaacatatccttagggatggttttgcacttactatcctgctactaacttggaaaaacgttacatgtctcattcatcttagggaaccgacccagtcccaaaatatgaactagcctgcctcaccagttattaacaaataagatttccttttgaaaacctcagggataggataaaggactgtgttgcagtgtaaccagacctccccctcaccccccagttcccccaacacatctcacatctcactggtggcttctcttttctttttcccttgccttttgtgtcagtttttttttctttcaaatatcattatgggtaatttggaacatatacataatatggtggttacttatatctattagctatttacatattttattctgtagattgtcagctcatggtctctgctgaattttgatgtacaggtgtttcccttgttgatttgtatgagttttacatatataaagagtgttaatcttttatcacttttgcagtaaatgttttccccagattgtcttctaactttttaatgatgcttttgataatagatttggtttacatttttattggtcaaattgattgatttctaaacccccttcagatcatggtaatttcttccattgcttttacacttgaaaagacatttcccattctaaggttagaatgggatttaaaacaatccagttttaaaatagttttaaaaatatttaacttgtcagtccatcaaaaattcattttgtgactagtatgaagtagagtatagcttatattttcccctagagagtcatttatttgagcaccattcatcaaataactattttcctatgattattgctattatacttttatcatacataaattcttctatatgctaggattttttcagcttgtattattcattgatctctctcttgggttttccatcagtttcatacccttatatatgcaacagctggtaaaccagatttcttttgctttctctgcagcctagcgcattacccacacttttttcttagctagtctcaaccattttttcgtccaaatgaacttagaatgtttctgtcaggttctcctcaaaatcctaccaggattttgattggaactactttaaacctaaaatttcattgacatcatcacaacacagagtctgtcatccaggaaaagacatgatatgttaatttattaattttcttttatgttccttagttgctcacatgcatgtgtgtgtatctcatatatttctcatcaagatcatccctggatagttgatagtttatgatatttattatattttcaaactagttattactggtaggtaggaaaatttttgattttgtgtgtctatgcttaattcttatttctaatagtttttcagttgcttctcttggattatttttgaaattaatcacaccagctcccatatgataactttatttccttttaaagaacaaaactgctgttttgctttcaaacctgattgtattggctagatcttttgggataatgttaaataatagcagtactagcaggagtccttgtcttgcttctgattttaatggaaatgtttctagtgattcacttaatagaaatgtttctaatggttcatattagttggctctgatgttgtctgttggtttaagttagatgttttttataatattagggaattaccttattcttaaattatcaagtcctcacaaaaatcaagaatagttggccaggtgtggtggctcacgcctgtaatcccagcacttcaggaggctgaggcagaaggatcacttgacatcaggagtttgagaccagcttggccaacatggtgaaatcccatctctactaaaaatactatatatatatagtatagtatatatatagtgtatatatatatagtatagtatatatatatagtgtatatatatatagtatagtatatatatatagtatatatatatatagtatagtatatatatatatagagagagagagagagagagagacatggtggtgcatgcctgtaatcccagctactcgagaggctgtgggaggagaatcgcttgaacccaggaggtggaggttgcagtgagccgagattgtgccactgcactcagcctggttgacaaagtcagatctgtctccaaaaataaagaatagttgttgagtttagctgatgttttctaggaatctattaagaggttcatttgtgttttctactttgatctccccatttggtatattatattatagatttcctaatatcaatctttgttagctttctaagataaattttccttttcctttgcatgcttgggagagcctcagatttggcttccatactattaatttgattgattttgctctctgctgtctccaatgtgaaatttatttatttttgttacaatgttaatttctctgtatttctttctagctctgttgagctacttaccctaggttgtctttccttctcaatgttttattctagtggctttctatacctgtttcatagagtccatgttttctttcattctattgaggatgtaaacagttttctaaaatatttcttctggtttatacacaaaattaagacgtttttgtttcctctgagttgtcagagtgatatgcattttccttgtgctgccagaggttttcatatgaactttttttttttttttggtaaagcaacagggtcttgctctgttgcccaggctggagtgcagtggcatgttcatagctcatggaatcctcaaactcctgggctcaagtgttcctctcacctctgactccaaaatagctgggactacaggaaaacaccaccatgcttggctaattaaaaaaaatatatatatatatatattaaaacagggttttgcggtgttgcccagtcttgaactcctggcctcaagtgatactcccaccttggcttcccagtgttaggaataaaggcatgagccaccatgcctggtcaggttttttgtatggtttatgaatattcaaaaaaggatctgtctttcatcaaatacagggtatgtagattgcctttgactatcctcaagctcagattctctctcatattggttagaacccttttcagctccattgttggcaggcaggttgatacacatagcttttaacctgtttcacagtgtctgtcagctactcatctagtgggttctgctggacccatatggaatcgtctacccctactacaatgttctcagatgctctgaaccagataaactatgtgaaacagtacagcctcccacatgtgttactacctgagtgttacttgtgagggctcccactcctagcacacagtgtgccagtaccaattctgccatttctgcccttttgattttggggaattagagtctccatgtgaatgtagaccagttttgagaattgctgatttcctctgcaagtagtaaccacgtagtccaaatggatgtccggtttgccagtttctagatgaactcttggcttctaagccatgaggctgacagttgtggaaggactcaatgtttcctatcttcttttaggtttctgtgggctgctgcatgaattggccagattgttttttctcatttcagtattaggcttattgttaatggagatttctcccagatcctggtaataagttggccatcagtttaagttttcagtgtttggggaattttatctttttctatatcttgataggtatttgagtgggaaattgagagaggctatgttagtgattgctagccaagtgctattttaaagtagaaatccagtgtatattttagattagagcagagattggcaaccatttcctgtaaagggccagagagtaaatattttagactttgcaagccatatgatctctgtgttttaactatttaactgttgttggagcatgaaagcatcacagaaaaatgcaaacaaattagtgtggttgtgttcaaataaaactttatttacataaacaggaggaccagatgaaaaagttctggagatagctggcagtcatggttacacaacagtgtgaatgtacttaatggcactgaactgtacacttaaaagcagttaagttggaaaaaattttatatatatatgtatatatgtgtatatatgtatatatgtgtatatatgtatatatgtgtatatatatgtatatatatatgtgtgtgtgtatatatgtgtgtgtgtgtgtatatatataaaatcatgccaataaagaagccaaaacagaaaaaccatattttgctgactctgagtttagaggaattagatctagcataggcagagagagagaggaagaaattacatatgtacagtaggacagtgactctgttaataagctagaaggcagtgggagacatttgagtatttaagaggaataccataatggggatggtgagatcttggaaagctacaattcatcctagtgatgtcatcttatgatctttacagatggagatacacaagagttcacattcacattctttgacataaggatcagagtagggcttttctacttctctagaggcttgagaaacctctgcagctgtcagaagtgttcatatcagaaacaaaagctaaccagtcatttctttttgcttgtagtacaaatggtgactagtgatgcttctggtagttgatctgagctcttcccaggactagaagatcctagcattttagttattaaccacagcacacttactcaataaaagagcagtcatcagtctgagtcaactgtttatacagcctccagcctaagattcttccttatcagctagagacctgggcttaagaatttcacaatgggctgggagcctcttagagaaactagccttttgagactttctctgagttgggctctcttgtttgttgttgttgtttttgaaactgtctcactctgttgcccaggctggagtgcagtggcgtgatcatggctcactgtagcctcgacctctgagttgggatatcttgaaggaatacatgaaggaaaagggaacagagattaaggttttccaggctttgggttgtaatcagacagtttagctgtattctgaacacccagcacttaatgtgcttggttatccatgtgtatgtatcaagggtgggggaactcatggagtgagtcactgagtggtatggtttaaatggcaggaaactcttccctcaccccgccttgggtaagaaaagggcatagcagagcgctgacacacatccctctgctccagaaagtgtacagtacccctctgctccccactgaaaccctaaagttgttcatcttcatgtgtgccaggaaaggagtggatctgtgatgcaaataggattatttggtcatatctgctgactcagtctaaagaagcttttgaaggggatgagatgaaatttcatctatgctgcagagagcaggaggtgcattgctggatggagagaggactgtaggctgcatgtgagccaaggtagacgagggaagcatgggggtgggcatgaggaactggggcagcctgacacgtgatcttggcattgcaaaactgatatcctgttggcctttgggccacatgatatgatgacagtgcagtatccccatggccctttctttttctagatttcatttatgatactctcagatttttaaatagcatgactttccccagggagaaattcagacctcaggtctctaggactgctctgaggtcatgagatagactcagtttgaacctgttgagtttaaatgtcttggaatgattttagcatctcagtaccccctttcccagtgctcatctggtcagctgctctggaacctgagggattctaaactgagacttagtttggggtcatatgcagttaaaaagggacagtcttttggcaccttcacctcggaggtggctgctttttggcttagcgttggactcatcactgaaaaagatagttgagaggttgtttttgacctgagcagccttattaagactcagttattggcaaaggagagaaggctctgcttataaatgttgcagatttaaaggggaaagaggaaaccacagtaagtaaagagcgattcagggagaccagtttctcttttttattcagaatgctgctcaggtatctgctttcctaggagccaccttattgtcaggttctgccttcggtttatgtgtattcttcccttaattcttagaagagggaagatgctttggggttgttcacaggttcccattcgacataaaatagaagctgcctacctttacatatactcagttttatcttctccaagtctcccagaagttctctttgaaagttcctagagcagggactgcttttattttttttccttctcctaggctttaagcatgtatttagatgtatgtcaccattgggtaaaagaaaggctaaagattcagataacttttcccatctgtggaaacatggaaagcagtactcagcagaggaatgaggactgattattttgggcctctttttactttatccaagtgaagaatctactgtgctatatatttgtcaaaagcaattccaaagggcaggggttgggggaaagcagtacggcataataagatttgggcaagttagataggagctgtgcagttggtaatgaagaagcagaactgtttctttctcattataaaagtaatccatgctaattgtaaggaaaagaaataaaatattatagaaagcaataaagaatacaataataataactgataattcctgttaatatgttggtataatttcttcttagttttctgtaggtatagatttcggctcactgcaacctctgccacccaggttcaagcgattctcctgcctcagcttcccgagtagctgagattacaggcactgccaccacacccggctaatttttgtatttttagtagagacagggtttcaccatattggtcaggctggtcttgaactcctgacctcatgatccacccacctcagcctcccaaagtgctgggattacaggcgtgagccaccatttttagaaacaaaataaagatcattctacatatgatactttgtaatatttaaaatataacgggattgtttacccatctaattaagtattcttaacatgatttctgatggctacatagtattccattgtttggatgaacataatataatgtatttaaacactgttctgttcaattcagcatttgatttatcgggtagacatgttttgaagggatcttgaatagtacagtggaattagagttatagttgcggttctgcttaattcttagctctgtgatcctgagcatagattaaagtcttagcttccatttcctcatttgtaaaagaatgctattaatagtaatgaccctcctgagtaaaaatggttagatgacatgacccatgtaaatttcttagcatgaaatctaacatataccaggaactcaataattgttagtagtagcgtatagcattatccttgtcttgacactttgtcatctgtgtactcactgttagaatttgggtctcaaggaaagaaaattgctttcatttagataagtaaaatttcagaatgaaaattgcctttagataggtagcctcttttaccagttgagtaccttccagataggggcatttgccaacttcctgaatttcacagggaaaaaaaaaattctgcagtctctgtggttgtgcggccccatttggttcagaacaaggaagtgggaaaccaccagctgcaaccagggaattatctttgtgtccgcaggcaaagccagccaagcccccctgttctacttatctttttttttttctttacttgcttgttttttatgttcttttagtctgaatttttttttttttgagcagagtcttgctctgttgcccaggctagagtgtagtggcacaatctcggctcactgcaacctctacctcctgggttccagcgattctcctacctcggcctcctgagtagctgggacttcaggcacatgccaccacactcggctaattttttgtatttatttatttttttagtagaggtggggtttcaccatattaaccaggatggtcttgatctcctgactttgtgatccgcctgtctcagcctctcaaaatgctgggattacaggcgtgagccactgcacctggcctggaaatttttaaacatacggaaaagtgaatagcgcagtacatagaatacttgtatagcttctgcttagtctcagcagttgtcctactttctttatttttattttttattatactttaagttctagggtacatgtgcacaacatgcaggtttgttacatatgtatacatgtgccatgttggtgtgctgcacccattaacttgtcatttacattaggtatatctcctaatgctatccctcccccagccccccaccccatgacaggcccggcgtgtgatgttccccttcctgtgtccaagtgttctcattgttcaattcccacctatgaatgagaacatgcagtatttggttttctgtccttgcgatagtttgtggagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccacaataaacatacatgtgcatgtgtctttatagcagcatgatttataatcctttgggtatacacccagtaatgggatgactggctcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcactgtggttttgatttgcatttctctgatggccagggatgatgagcattttttcatgtgtcttttggctacataaatgtcttcttttgggaagtgtctgttcatatcctttgcccactttttgatggggctgtttgattttttcttgtaaatttgtttaagttctttgtagattctgcatattagccctttgtcagatgggtagattgtaaaaattttctcccattgtgtaggttgcctgttcattctgatgttggtttcttttgctgtgcagaaactctttagtttaattagatcccatttgtcaattttgtcttttgttgccattgcttttggtgtttcagtcatgaagtctttgcccatgcctatgtcctgaatgctattgcctaggttttcttctagggtttttatggtttcaggtctaacatttaagtctttaatccatcttgaattaatttttgcataaggtgtaaggaagggatccaatttcagctttctacatatggttagccagttttcccagcaccatttattaaataggtaatcctttccccatttcttgtttttgtcaggtttgtcagagatcagatggttgtagatgtgtggtgctatttctgagggctctgttctgttccattggtccatatctctgttttggtaccagtaccatgctgttttggttactgcagccttgtagtatagtttgaagtcagatagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatatcgatacttcctatccatgagcatggaatgttcttccatttgtttgtatcctcttttatttcattgagcagtggtttgtagttctccttgaagaggtccttcacatcccttgtaaggtggattcgtaggtattttattctctttgaagcaattgtgaatgggagttcactcatgatttggctctctgtttgtctgttattggtgtataagaatgcttgtgatttttgcacattgattttgtatcctgagactttgctgaagttgcttgtcagcttaaagagatttggggctgagatgatggggttttctaaatatacaatcatgtcatctgcaaacagagacaatttgacttcctcttttcctaattgaataccctttatttctttctcttgcctgattgccctggccagagcttccaacactctgttgaatagtagtggtgagagagggcatccctgtcttgtgccagttttcaaagggaatgcttccagtttatgctcattcagtatgatattggctgtggatttctcataaatagctcttattattttgagatatgtcccatcaatacctagtttattgagaatttttagcatgaagggctgttgaattttgtcgaaggccttttctgcatctattgagataatcgtgtggtttttgtctttgattctgtttatatgacgggttatgtttattgatttgcatgtgttgaagcagccttgcatcccagggatgaagccaacttgatcgtgatggataagctttttgatgtgttgctggattcggtttgccagtattttattgaggatttttgcatcgatgttcatcagggatattggtctaaaattctctttttttgttgtgtctctgccaggctttggtatcaggatgatgctggcctcataaaataagttaggaaggattccctctttttctattgattggaatagcccctctttgtacctctggtagaattcggctgtgaattcatctggccctggactttttttgtttgataggctattaattattgcctcaatttcagagcctgttattgttatattcagggattcaacttcttcctggtttactcttgggagggtgtatgtgtccaggaatttatccatttcttctagattttctagtttatttgtgtagaggtctttatagtattctctgatagtttgtatttctgtggaatctgtggtgatatcccctttatcattttttattgtgtatatttgattcttctctcttttcttctttattaggcttgatagtggtctatcaattttgttgatcttttcagaaaaccagctcctggattcattgatttttttgaagggtgttttgtgtctgtatctccttcagttctcctctgatcttagttatttcttgccttccgctagcttttgaatgtgtttgctcttgcttctctagttcttttaactgtgattttaggtgtcaattttagatctttcctgctttctcttgtgggcatttagtgctataaattttcctctatactcagctttaaatgtgtcccagagattctggtatgttatgtctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgttcagaagaatgtatattctgttgatttggggtggagagttctgtagatgtctattaagtccacttggtgcagagctgagtttaattcctggatatccttaactttctgtctcattgatctgtctaatgttgacagtggggagttaaagtctcctattattattgtgtgggagtctaagtctctttgtaggtctctaaggacttgctttatgaatctgggtgctcctgtagtgggtgcatatatatttagaatggttagctcttcttgttgaattgatcccttttccattacttaatggccttctttgtctcttgatctttgttggtttaaagtctgttttatcagagagtaggattgcaacccctgcttttgttttctatttgcttggtagatcttcctccatccctttattttgatcctgtgtctgtctctgcacatgagatgggtctcctgaatacagcacactgatgggtcttgactctttatccaatttgccagtctgtgtcttttaattggagcatttggcccatttacatttaaggtcaatatggttatgtgtgaatttgatcctgtcattatgatgttagctggttattttgcttattagttgatgcagtttcttcctagcatcaaaggtctttacaatttggtatgtttttgcagtggctggtaccggttgtttctttccatgtttagtgtttctttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccattctcttctggcttgtagagtttctgccgcaagatctgctgttagtctgattggcttccctttgtgggtaacccgacctttctctctggctgcccttaacattttttccttcatttcaactttggtgaatctgacaattatgtgtcttggatttgctcttcttgaggagtatctttgcggtgttctctgtatttcctgaatttgaatgttggcctgccttgctaggttggggaagttctcctggataatatgctgcagagtgttttccaacttggctccattctccccatcactttcaggtacaccaatcagacgtagatttggtcttttcacatagtcccatatttcttggaggctttgttcgtttctttttattcttttttctctaaacttctcttctcattgcatttcattcatttggtctttaatcactgataccctttcttccacttgattgaatcagctactgaagcttgtgcatgtgtcacctagttctcatgtcatggttttcagctccatcaggttatttaaggtcttctctacactgtttattctagttagccattcgtctaatcttttttcaaggtttttagcttctttgcgatgggttcgaacatcctctttagcttggagaagtttgttattaccgatcgtctgaagccttctgctctaaacttatcaaagtcattctccatccagctttgttccattgctagcgaggagctatgttcctttggaggagaagaggcgctctgatgtttggaattttcagcttttctgctctggtttctccccatctttgtggttttatctacctttggtctttgatgatgatgacgtacagatggggttttggtgttgatgtcctttctgtttgtcagttttccttctaacagtcaggaccctcagctgcaggtctgttggagtttgctggacgtccactccagaacccgtttgcctgggtatcaccagcggaggctgcagaacagcaaatattgcagaacagcagatgttcctgcctgatccttcctctggaagcttcctctcagaggggcacccggccgaatgaggtgtcagttggcccctactgagaggtgccacccagttaggctactcgggggtcagggacccacttgaggaggcagtctgtccgttctcagatctcaaactccatgctgggagaaccactactctctttaaagctgtcagacagggacgtttaagtctgcagaagtttctgctgccttttgttcagctatgccctgtccccagaggtggagtctacagaggcaggcaggcctccttcagctgcagtgggctccacccagttcgagcttcctgcctgctttatttacctactcaagccttagcaatggcagatgccccttccccagccttgctgccgccttgcagttctatctcagactgctttgctagcagtgagcaaggctctgtgggcatgggaccctccgaggccaggtgcgagatataatctcctggtgcgccgtttgctaagaccattggaaaagcgcagtattagggtgggagtgtcccaattttccatgtactgtctgtcacggcttcccttggctaggaaagggaattccccgaccccttgttcttcccgggtgaggtgatgccctgccctgcttcggctcatgcttcatgggctgcacccactgtccaacaatccccagtgagatgaacctggtacctcagttggaaatgcagaaatcagtggtcttctgcgttactcatgctgggagctgtagatgggagctgttcctattcagccatcttggacgggcaagtgtcctactttcttatatgtgaattctgaaacgcaaggtcctaactgcactccctgccacaagacagacaggattgcgctacagcacctcacaaagtgggaaaaaaatgtatacactcttagatccaggggtttatagaaacagaaagtcagtgcagaaggactctggactccgggatggtagaaatagattttattttttcagatggagtctcactttgtgcccaggctggagagcagtggcatgatcttggctcacttcagcctccgcctcctgagtagctgggattacagacgcatgccaccatgaccagctaatttttgtatttttagtagagatgggatttcatcatgttggccaggctggtctcgaactcctgacctcaaatgatctgcctgccttggcctcccaaagtgctgagattacaggcatgagccactatgcccagccagatcttttgtttttataatacaaatcacagaaagtaaatcttagtgtctggctgaaggaaagaagtagatccagatgtccatcaacatgacaatgggtaactaccttgtggtatattcataaaagtgaataatattcagcagtgaaaaacagatgaagtagagctacatgtataaacatggataattagaagttaagtgaaaaatgtaatttgcctaataatctttctctatacaatgtaccatttatttaagggtataaacatgaaacaacactatatgtgatttgtagatacatacaaacataataaatgtataaaaacgtgggcaacaaggaagtcaactactttagagtagaggttccccttgtagatggttgggtgagatgaatcgtattcaggaagggtacatagaggacaactgaatcaataatattcaaatttattaaagctgtatggtaggtgcagaggtgctaatttttaaaatattttactgtatgtttaaaactttaagtgtaaagaaaaaactagggcagaaaaacgttgtttaaaatgctcagaatcctggatcacttattttgtgagtgtgaaagctgagactgggagagttcagtgttttgcttctcatatacatttttgaattttgttcaattatcatacagccaaattggcttttttgggaataaagttctatgaatcttaagacatgtatagattattataattactaccacagacagggtttagaactgctccatcacttctaaaaacttctcatactcttcctttagtgtgacacccagatttctaaaccctggcaaccactgaccagctctgcaatcactgtagttttgtcctttggagaatgtcatacaaatggaaccttacagtgtgtaacctttagagagtgggtttgtttacttagcataatgcctttgagattcatctgagttgatacatgtatcaattgtttattcctttttatttctgagtggttttccatggtctgtaggtaccacagtttgtttatccattcagccattgaagggtacctggactgcttccagattttgtctattatgaatagagttgctgtaaacattggtgtagagggttccatgtaaacataagttttcatcttagtagggagccaggagcagaattattgagttgtagggtgagtactagtgtttttaacttatgaaagttttttctttttctttttttattaaaaaaaacctttataagataccatcaaatagttttccaaatcagtgcttttacatttacattcctaccaacagtgtatgaaaattccggtttctgcacattgctattgtcttttttgttgttgttgttattatagcaattcagatgagaagtggcatcttattatcgttttagtttgcatttctctaatggtagggaacatttttatctgcttatttgccgtgaaaacaacaacatattcaataacaacttcttttggtgaagtgtctgttcacagttttttcagccctttttttttcttctttttttttttttgagagggagtctcactctgccacccaggcgtgatcttggctcactgcaggctccgcctcctgggttcacgccattctgctgtctcagcctttcacgtagctgggactacaaggcacccgccaccacacccggctaatttttttttttttttttttttgtatttttagtagagacggggtttcatcatgttagccaggatggtctcgatctcctgaccttgtgatctgcccaccttggcctcccaaagtgctgggattacaggcgtgagccaccgctcctggctgagttgtgtgttttcttattgttgaatttcaggattctttatatattctggataaaagttctttgttggatatgtgatttgcaaatattttatcccatgttatatgttatatagcttatcttttcattgtcttaaagtgtctttcacagatcaaaagtttttcattttgattaatgtcagtttatcattttttttttcttttatgtattgtgtttttggtgtcatgtctaagaactgtttgcttaactgaagatcacagattttttcatatatttccttctaagacttatagttttatattttctatttagatttatgacttagcttttatataagttgtgaggtttaggttaagtttgttattttacatatgaatgtccaattgcttcaaccgcatttacactattttcaaaaatcaaatgattatatttgtgtgggtcaaattctggactattatgtttcattgattgatgtgtctattcttgggcaatactgcattgtttcggttgctttaactttgtagtaagccttaaaatcaggcaatgtgactccttcattatctgcttcttttacagaattattttagctattcctgtttctttgaccttccatatacactttagagtcagtctatctataaaatatcctgttgggattttgatcagaattgctttgactctatagatcgttttggtgagaaatgacatctttcctatgttgagcctttcagtccttggacaaggtatgtctttccatttatttaggtcttttattttatcagcattttgccattctcagcatatggatcctttaaatattttgttagatttatacttaagcatttcagttttttgaaacattttaagtggttctttcaaaaatgttgcttttcaattgtacactgctactgtgtagaagtgattgatttttgtgtgttgacttcgcatcctgtgacctttaaaaactaatgtattttttaggagcttttttgtagattccttgggattttccatacatataatcacgtccattgcaaataaggacagttttacttcttccttttcgatctctattatttttgttgcctgatttcctcgctaaagttgccagtctaatagtagtggtgagagtggacatccttgtcctgtttctaatgttgtcggggggagcatttagtctttcaccattaagtattagattaggcatagtaattttaggtgccctttatcaggctgaggaagttccctacatcaggttgaggaagttccctactattcctagtttgatgataatttttatcatgaatagatactgaattttgacaaaataccctttctgtatcagttgatatgatcacgtactttttagtcttttttagtcttttcagcactgatttggtgaattatattaattgaatttcaaatattgaactaaccttgtgttaccaggagaaaacgcacttggtcatagagtattattctttcttgtttttgagatggagtctcgctctgttgcccaggctggagtgcagtggcacaatctcggctcactgcaagctctgcctcctgggttcacaccattcccctgcctcagcctccggagtagctgggactacaggcgcccaccacctcgcctggctaatttttgtattttttttttatttttatttttttagtagagacggggtttcaccttgttagccaggatggtctcgatctcctgacctcgtgatccgcccacctcagcctcccaaagtgttgggattacaggtgtgagccaccgtgcctggccaagtattattctttctatactgctactttagatttgctaatattttactgaggatttttgtgtctgttgttcatgaggaatattggtctgtctgtccttccttccttccttccttttcttcctgcttccttcttcttccctcatcttcttctttttcctctattttcttcttctcttcctctccttcctccccactacccaactcctctagttttggtatctgggtaatgtagtgatggaccattctgtttaattgattgatgtgttcattctttcccctcttcaactcaacatgagaaatgtttccttctcttttattttctgaacaagattgtataaatatttggtagaattggtcactgaaactgagtctggagatttcttattcagatgattttaactatgaattcaatttatttaatagtattattcaggttgtctttttcatcttgggtgagttttggagtttgtggtttttgaagaatatgtccatttcatctaagtggtcaaatttatgtgcatagagttggttggagtattcttttataattttaattgctagggttctaatatcttctttcattgctgatattgttaacttttttccttctctctttttatccatgtcattctacctagaagtttataaattgtattgacttttttcaaagacaaacttttggttttattgatttttttttttttttttgagacagtgtctcactctgtcgcccaagctgaagtgcagtggcatgctcatggctcactgcagcctcgacctcctgggctcaagtgattctcccacctcagccttccaagtagctgggactacatgtttgcaccactacatccagctaattttttaaattttttttgtagagacaaggtttcaccatgttgcccgggctggtcttgaactcctgggctcaggtgatctccccgccttggcctcccaaagtgctgggattacaggcgcgaggcactgagccctgcctctctattgtttttcttttccatttcattgatctctgctctttattatttcattttttctgcttgccttgggtttattttgctcttattttttttattcttaaggtggaagcttagattgctaatttgagaccattctttttgcctaatataagaatttccagctgggtgcagtggctcatgcctgtaatcctagcactttgggaggccgaggtgggtggattgcttgaggccaggagatcaagaccagcctggccaacatggtgaaaccccgtctctacaaaaaatacaaaaaaaaaaaaaaccaacacaccaaaaactgggcatagtggcaggcacctataatctcctacttgggaggctgaggcaggagaatcacttgaacctgggaggcggacgttgtagtgagcccacatccggccactgcactcccgtcctccagcctgggtgacagagtgagactgtgttaaaaaaatttttttcctgttactagcatatttttgttgttgttgttcagttcaaaatattttataatttcctttgagaattcctatctatgaatttgcctttccagccatccagagaatttgtcatctgttccatatctttttgttcttggttgttatcaagtactaaattaaaatagaattcatctcgtgaaggatcataatagcttcatttgttatgaataatgtgatattcatttacattgatctgttaaggataatacagccactgtatattgagtgcttattatattctaggcactacattgatcactttacatggtcttattttattaaattctctaaccctttcagtaggtactcttattagttcaattaacaattgtgaggcaattgacacatattttaagtgatttgtctgtagtcacttggccagtaaatggtagggatgggatggaatgtagacttgattccaaacccccttaaccattttactacatttcctctagttatttcacttcttgccttctcataaaaattgttagctttttgagggcagatactgtgtcctacttatacttatcttcttttccctacaatacctgcaacaatgttaggcacacagtaatggattgactaatgtttgtggaactaaattcaacaaaattaactgatctagaagagaatcaaaaccatggtgcttgccatattgcctcagattcttaccagctaagcagactcagtgtagcatcctatacaaaaccaaaaaagcttataggaaatatttgtgtcagtaataatggctatcttgtgttcttttgtgatgatcagtcagatgtggccacaagagtagacagaggagagggtaaggaaaaaacaaagtttattatattcactggtcccagagacaagaggctcaggatactaggcaaggccacttgggaaagacattagggtggtcaggaggcaggagataggagcaaggaggaagttttagtccactgcctttattggggtttccacagaaaaagcagggcagggcaggacagggtgaatagttaaggattggctagtttgaatagtttcagcaggcctctaagctgtagggctgcaccctagttgtctggtgtctggccctggggcaattaaggaagaggaatatagcctcctggggtataaggggcagatagaggaggtctggctttggattggttagtttgcatatcaaaggcatgtttctgggtgagtacttgctgtctctaagaattggctggaggatgggggtcggggtgggggcaggctgtctctagccagaaaggtttttaaagataccaaaatatcacaatatacagaaaataaaatatatgctgcatatcaagcaattcaactttttcttgtaatatcatgacttttctttgcttcttgggagcacttccagcatgactggtggcacttcatctggatcccctggtgttattcaggggttacagtatcacactaaacaggatggaaaacatgagggaagggtcgacccttgaacaacatgggtttgagctatgcaggtccacttagaagcagattttttcaataaatatattggaaaaaggtttgggggtttttgacaatttgaaaaaatttgcaggcaagtcttatagcctagaagtattgaaaaagattaagaaaaggttaagtatgtcatgaatgaataaatacatgtagacactagtgtattttatagtttactactctaaaatatacacaatctattacaaaaagttaaaatttatcaaagcttatgtacacaaacacttatagactgtacattgtgccatcgtaattgagagatgtaaagatataaagatgcactattaaaacataactgcataaaattagctgtagtacatactgtactcctgtaataattttatagctgcctcttgcagtgagctcaggtgttgtgagtatcccttagaatgccctgtgcccctgatcatctccgaatgggctgttctttctccagtaaatggttgatcccaataaaaaagtgatccttgtggttctcgcatttttcatggtgtttagtgcaataccataaatgttgaataacaccagaggacccatacaaagtgcactagtcatgctgaagtgctcccaagaatcagagaaaagttaagacattacaaggaaaagttgaattgcttgatatgcaccatagattgaggactgcagctgcagttacccactattttagacgacgattcatcttgtgaacagatgatgcaaacttatggtattgataaatgtagtacagtactctaaatgtattttctcttcctcatgactttcttaatattttctcttctctgtaagaatacaatatataatacatataacatacaaaatttgtgttaattgatctcagtaaggcttctggtcaacagtaagctattggtagttaactttagaggagttaaaagttataggcagattttagactgctcagggagtcagtgcccctaacctccacattgttcaaagatcagctgtatatacaatacaaagaccaatactctgagctggtaaggaggtttataagtatgactaaccaaatataagtctgccccaagctctgctttttggttctggccttcagtctgtccatctgctttctctggacctccttctcatactttgaattttttaagtagtttgtccctcatatgattttttttctattcctttttcccttcctgtccttccttcactcctttccctcccacctccctccctcccttcctctctcccttccttccttccttccatccaaccatccatccatccatccatccatccatccatccatccatccatctatccatcttgaggctttaggtgagttcttcaccatttatttaacaaatgttttatatgagtcttactatatgccatgcacattttaatgcattttttaaatataattcccataacaatcctatgaattgggtactattatggttcctattgtacagatgagggaactccctcacaggactttctagtggccctatagccatttgccacacccattacaaatttttgtggcaggctggaggggggtataaagttaaaacaaaggcctctgcttctgagttggtcagtcatttacctgtagagctgtgctttgtcggtaaagggcaatgtagttgtgtgatcaggatagttgccacagaacacacaaggggtttaggcatgaccttccttgccccattggcacgcaagaactttttccttcctggcctgcagtctgatacatacacacatagaaacacagacacacacacacacacacacacacacacacacacacacacagacacacacacagagagagagagagagaatgagagagagagagagagagagagagagagagagagagagagagaacatatgtaacattcatgccatggatttaaagcagagtacaatggcaaaaatacaatcttgaaacttggcgacatctgagcgtgacttcagcctctgccacttattgtctgtttgatcttgggcagatcacttaatcacttggagctttggttttctccactatgaaatgaggaagatgatggtggttataataaaaactctgatgactgaatgagatgatatatttgaatccttagcccagtgatttgcacatagaaatgttcaatacatgttagaaatgtttgtgattattaatatgcaaggcttctttatgtattaaagataattcaccctctagcatatatatagcttgtataaactgaattttgagaacccagagcaatgcttgtctttatctagggacttaactgttttggatcttgatgttagttttatcttcatctttggccgtccgtaggtcctgatcagttccatcaacctcaagatttaacttttggtgtccaaatgtctaattggccctgtgcaaatgctgacatttcttttgaggtccatggcaaagcctggcaccagaatccagcttttttttttttttttttgagatgcagtcttgctttgtcactcaggccggagtgcaatggcatgatcttggctcactgcaacctctgcctcccaggttcaagtgattctcctgcctcagcctcctgagtagctgggactacagacgcctgccaccatgcccagctaatttttgtatttttagtagagacggggtttcgccatgttggccaggctggtcttggactcctgacctcaagtgatcctcccgcctcagcctcccaaagtgctgggattacaggtgtgagtcaccacgcccagcccagaatccagctttcatctggactgttgatgtgatttttttttccctctcccagagtgagtctttatgttgtggctgtcacataggagggcccaggggcagggttaagccagattctacttcactgaaggcctggaatggctgttaatagctcctgctatagacagtgaggcttgagccagattttttagtactccatttgtcagacacggggtgccaccttgaatgacactgctgaaaaaggattgtggtaacctggccagccccagggaggttggagtgacattgcgttggtgtgcctcttcccttttatggaccaggccaagccctattaacctgaaggagtgtgatggccttgtttagccaaacagccttttccactttagtcatcctttgaaatcttattaagccaggggcagggaaggaagaaggaggcagacagactcttgaaactaaaaggagggaaagaggaacattctaaccttccacctgaggtcatactttggcaggaggaagggaccagggaattttatacaaggcagcaagagagatataagagtttggggtctggagtcagataaacctggttttgaattctgactctactctcttatgtgtggtgttgaccagatcacctcacttctctgaaactcgtttccttatcaacaaaatgggaaaagtaattgtacctatctcagaagattggtataaaaattaagcaagaaagttcatgtaaagcagttaatcagatacttgcctggaatattattatttttcttctggttcttgattaaggatgcctggaatatattaagtgcataccatcgctattcgcaaagttttggtgacaaagaacaataggaagaaacagcctaggggaagtgaaaagcagtcttggggtttctgtgccattctccggggtctccttgtaacatctttcagtctgtctcccttcccttcttccctttttcccttcttccctcccctcccctcccctcccttcccctccccaagtcttgctctgtcgcccaggctgtagtacagtagcatgatctcggttcactgcaacctccgcctcctgagttcaagcgattcttgtgcctcagcctcccgagtagccgaggttacaggcgcctgccaccatgcctggctaatttttgtatttttagtagagacggggttttgccatattgtctagggtggtcttgaactcccgacctcaggtgatctgccagcctctgcctcccaaagtgctgggattataggcatgagccaccgcacccagccacatctcttagcgttacaaacacatctgtgagtgccaagagaagaggtaaagttctagagagtcttcaacatgtggactgttttcccagccagggcataggaggtatgctgtgtgtgtgtgtgtgtgtgtgtgtgtgtgtgtgtgtgtgtgtgtgtgtgtgtgtgtgattgagattgacatcaacccccatctagtgttgaggtctaagaggcgtgttgcctcggtggtggttgtccatgacccatcaaatcaacgtttcttcaagaggaacagactgtcattcttttcatctctcttagtagtaaagaaccatttgcctttaataatgaaggaagctacttaaatccatccccagagccctcacaagcagggtttgttcctgagttaattgtgcttgacttatgaagggtttctaatgagtatgtattttaacaagtctggcattgggattgggaaacagtatcattaaccagtgctggagaccagtggttttcttcttcttttttctttttgttttgcttttaagtcacagagcccaatatgtaaatgaaagcctggaaggctgcccacttttgctcctgagggcatttctaagaaagtggggaaatatagtttgcaaaacactgcagttggcttcctgggttgtagcaatctttttctgtttaggtctctgtttggggaaaaggattatacatgacagtgtaaataagcagccatgttataataaataggtttctactgtaataacagaacacttacctcccgcagttccccttttctaatgccgcccaagctgtagcagttgaagccgttgattgggactgactgaatgtttagggaacacagagctcattatttaataaagtgttgtaaccaaagtatgttcaggaagtgttcaggggattctgagccagtgatggtgctcttcagaacatttcagttaatacaaaatatgccactattaattcattttgtgcaaactccagtgccattttccacagagagcaacttgtatacatagttctcttccatatgccgtggcttaacctgatgtgtcttttttctccctttgtatcagggtctgagtatgacctgaactttatctttctccccctctaggctacagatgcacatgttgaatggagctcttctggcattgctgtttcctgtggtaaacactcggctggtaagtagcctcttctaggaatgtaacagcaacatgcaaagcagtacttgcctatatgcccatgtgattttaaaaatatacatatagctggccaggcgcggtggctcacacctgtaatcccagcactttgggaggccaaggcgggtggatcacttgaggtcaggagtttgagaccagtctggccgacatggtgaagccctatctctactaataatacaaaaattagccaagcatggtggtatttgcctgcaatcccagctactcgggaggctaaggcagaagaatcgcttgaacctgggtggcagaggttgcagtgagtcaacattgtgccactgcactccagcctgggcgacagagcgagactcggtctcaaaacaataaaaaaataaaataaccagggcagaccaaagcctatacaaactcttggagaggtttaatggaaagaaagcagctttcaggtgttctaaggggctctcgttagattcaaccacattggccttgaataatttgctgtgggagcctcataacctgtccacttctccaaggacttcctagggcaagaattagattccttccccatccacccaaacccatgggccagtctggaccaaacagcccctcatggctagcagggagaatcccatggttgcagcgggctgggtgataaaccagcccagaaagaagcaggagctacgagccatgtcctcagactcccaaatgtgagactgtggaggcattagcaggtcacattgagaagctcagaaaaagaaatcacttataaaattattactactgctttctgacttaaatttgccttaaacattaagatcatagtttaaatctttaattgataatcatttttggatagcattttacagtgtacaaggtttttcgcataacagtgtttgaggtagacagggcaagaattatggcctcttgttttacagaggaagaaaattttactcagggagtaaaattccaagtggcagttaggattggagcctaagcctcttgatcctaagatcacagctatgctttgctccctctccacaaatattcctgtcatctcctccccacaaatattcatgtatacctttatgatagttacaattttcaagatgcatgtcatatatcagtagaaattatagagaaaacattcatctaaagcagcgattttgaaccctagtatgttccaggctcacctaattagcttgatttaatcatttcacaatgcaaacatacatcaaaacatcatactgtacgtaccttataagtacccacaattatttgtcagttaaaaataaaattaaaaacaaacactgatgcgctgccccacccttggagaggatgagttcatgatctgtgataaagcctgagcattgtgttttaaaaagttccccaggtgattctagcatggagtgggagttgagaaccactgatttcatgcaatgattctgaaacgtaatgttcatagcaatcaactgaagggcttgttaaacatgaggcttgtcaggccccatccccagagggtctgattgagagagtctacaagtaatggcagggactgaatgtttgtaacaagtccccaagtgatgccaatgcaggggtccttagaccattcttggagaatcactgtcccaggtgttcgtaactcacagttactccaagtgtgtaactcaaagtgtggtcctaggatcagcatcacatgggtgttgcttgttagacatgcagaatttcaggggccacctgcagaccacctgcatcagaatgtgcattttaacaggactcccaaggtagcttatatggactagaccttttctgccaaggaccccaaagcatcttacagataaagcatttgagctctcgatggaggggaacatctgtgttggggagggcagggggcacagcctctgtcttaatagtcagggtgcacttggttcaacattcccctgtgagctgggatcagtaggcacaggccgctgacacaggcactgttgccctgccttctacatctcccacagtctgtgacttgcctgacttcacctggtggactgtagaatcagaactcctgacttggtctcagagttagatggggtaattccaaagaatggtaaaaataaaccaaattgggaaacttaacaaaaaacggtgaatttcccataccacagcataagtccttcctgcctcagggttgtggaacagggttggagcagaagttacttcctgcttgtggaggtaacctgctagggcagaaaagtagatccaatgctatcttatcatctctctgctcccccttgtacctgttttctcaggagactgagaagtcaggcagatagagagctgctttctcaaatttcagcagctctatcagatcccagaaaaggaaggtgcatcagaaaatctccccctaggctaatagagttagtgatcctgaattggggtgtttccagcccacaactctggccaaacagcacctgctgaggtggatagatatagttcctctagacaggccaccttcagctctctttctagtaggacctttcccccagtgaaaaccaaatatccttcttcttgcaaagccattgaacataaacagaaattttgattctcattgtagaagcatgagaatgaaggccccaaaatgctccattacatacctgaaatcagttagaaagctggtggtgaagttttcattcagtcaatattgttacacaaaaggtacatatctccctgggtctgctgaagtatccttagtccctttatcaataacagtagcggttgctgggtgcagtggctcacacctgtggtcccagctactcaggaggctgaggtgggagtatcacttgaggccaggagtttgagaccaacctgagcaacacagtgagaactcatttctaataaaaaatttaaaaatcagctgagcctggtggctcacacctgtaatcccagcactttgggaggtggaggcaagcagatcatgaggtcaggagattgagggcagcatgatgaaaccccgtgtgtactaaaaatacaaaaattagctgggcgtggtggcatatgcctgtaatcccagctacttgggaggctgaggcaggagaatcacttgaacccaggaggtggagattgcagtgagccgagatcacgccactgcactccagcatggcaacaaagtgagactccgcctccaaataaataaacaaataaatagaaattaactgggcatggtggtgcaagcctgtagtccaggctgcttgagacttccgccctcccttctgaggtgggaggattgctttatcctaggagttcaaggctgtagtgatttatgatcatgccattgcacaccagcctaggcaacagagtgagactccatctctaaaaaaataaaaagtaacagtagcagcactatcagctgctgattcttgagtgcttactatgtgccactgttctaagtgctttacatggcttagatttatttaatcgttgcaataaacttatgaggcaaggtactgttattcccaagatcacagtgcgccagcaaggttagtttcttctgaggcctctctttggtttgcagatggccaccctcatgctgcctcttcacttggtcctttctctacacacacatccctagtgtctcttgtttagccaaatttcctcttataaggacacacatctgattgcatagagcccactgtaatggcctcctttgaacctaatcacctctttgaaggccctttctgcagatactgtacagtcacattctgaagtactgagagttagggctccaacatatgaattttggggggacacaattcagctcatagcacccatactaccctacatagaaaccattgtttcttcccctcaccctgctttccttcctccctccctcccctctgcctttccttcctccttccttttccgccatctcatagcagatgtgctggtgtatctgttacattaacagctaatactttccaaataaatgtgaggctgtagtcaactaacttatcaaaaatgtttaagtaacctctcctgacattgaaacttctttgttgggctgtctcttaactagtgattccagccaatctggtcaatctttgtgctctttttctaaagtgatgcttagaaaagctgggaatgtctccatttgcctatgtatttgcaattggtttaggtctggttcttttagatggttgggatccctcttggactactctggctttagggctttttgccttgcagccccttagttgagctcagattgacttaacatgagacacatgaggattggcaactctttcttaaacctgatgatccaattaggttgtaagccagcttttgacttttgcccttccttcttggccctttatctttttaattattttatttttttgctcattagcagtaatgaggaagcaagaaaaataaaatgaactgattagtgtgtgtactggtaccatagacatacatatactcacatacacaaagacagagtgacagggcattggaagtagttgtgacagtcagctaaaggatttggggccctcagtgaatttccatgtgttctactctgccctgtgacttactggcaccaggatttgcaaatcagctagagaatgcctaggcttcagtttctctgggttctccatctttaaagctgaaccctaaaagaaggactgtgtattccagtggcccatattacaagtaagtgctctttacacctaggatcctggaaaaaggtctttttctagattcagatgaattatattaaagggcaatttccagtgatatgcccttttgtttcttggagtgaaggaggggaagtacatgatgaacctattgattattagattagcagggagctcaaagcttgtctgatgtcatcttatcttccagagggtaaatttaggaggataaatgacgagtttcagtagtcaaggtgggtgtccccagaacccatatctcttgactgagacttcagaattatttttctattccatgaatgaaattcagggagagtttgtgtgctggtgatagagtctcttccttgataaatgcacaaacacacaattttgcagacaatttcaggagggacacagactacaacttcctctcctagcccctctcccctctgtaagcccacctattcatcccatgttaatgtcttcctgcctaggctacaaatagttcatagtttagggaatagatgtgctgtctagtgtgtgagttccttgttatagccgctggccatttgtcctgatggtgatactgggttccttatctatacccgtgactttgcaaagaatatcatccaatccaggataaaccactttcaggaaattaaagccaaggagtggaagctaagtagggtgtccatggaacctggttacagattagattttcagttacagtactcacgtgcaaagctagtgatctggccctgaaatgagacactgggcccatgctgcaacttcagcgctctgcttttcaccctctaacccccatgagagtttcttctgaatgcagaatgttgttagcaagggagactggatacagaaaagaaagtgaagatactatatcagccctcttcccagaccaaaaactctagcctggcctgcatttgtgtttgtacccatctgtcttctactaggagaagcatgataattattcttttcatcaagctcctttcttcttcaaggcctaaagcctcaagtacattattatcttattatcaaacttgcccattattatatatccatgttgatctattatgttagttcctttttaccccctttactaccactctccttttgcccagttctttctgctctgttggatgggatggttcttttgagtattcctaactttcagactgagtggaagaagatagtaatgattctgtcattactggggtgtctagcctccattcacaaacactatattgatgttcttgggatgcagcttttccactgacacaccttgtacccatgtgtgctgctggaaaaaccttgttgtcaccaatgcagataggcttgaaaatctcactctttgctaattggcacatcgaaatgtgctagttgacctagaaaagttatttctgtgactggcaaattgggctattttaaaaagttatagtttggattttggacctgaactgaggacagaatgtccctttattatcctgagggttcttaaagcgtacaaagcttggtttcaaaagaggtattaattttctaaagaattgagtgaggcacaatagtgcctcaaccttctgcaaaggccagtatgtttctgatcagatgaatgcattgtgtctgaggatgtggggggtattgagatgagtttgggattcctggtccaaaccaaattctagggactatcctagaatatgtcaacttagtagctttattttaagactaagctttgagggtcttaaatccttgatgaatccagcctagatcacaccagtcaaaccacagatttttattgagcactttcctgtgttaagtatcatgccatgtgctgcagaagatacaaaaacaaccagtgtacattcctggtcctcaaagaacttgcagtttagttagaaagataaagtataaatgcctgaaaagttatggcaatattaaagttgaaaacatgaaaaaggaaaaatcatggttgggcatggtggctcatacctgtaatcccaacattttgggaggtcaaggcaggaggattgcttgagcccaggagtttgagaccagcctgagcaacatataagaccctgtctttacaaaaaataaaaaaatagctgggcgtggtggcacatgtttataatccaagctacttgagactcaaggctgaggtgggaagatggcttgagcccaggaggtcgaggcggtggtgagctatggccaacactactgcacttcagtctgggtgacagagcaagaccctgtcacaaataaaaaagtaaaacttacaaggcattcaggcttgactgctaaattgcagttgctctatgtttcaagaaatgggaaaaagattaatattagcattcactgagcccatactattttccaggtaatttacacatatattattcaattctcataagaaacccattttacatatgaggaaactgaggttcagatcagattaaacgacttgctcagagttacatcatttgtaagtgctaaagctaaacctgtgcactttgtaccttaatacacagcctcctggagtaagtggtctggaaaggcttcatgaagaaataaagcctgagccaagccttgagggatggttagaatgtgcatgcaaattgcataggaaggaggctgttcaagctaagggaacacatggacatggaggcagaaaatagtcaactaagtattgagattctgaagagcagggtgggagtcagggattccagttgtacacagagacattaccacttatttgcaaatcacaagaagacactgtttctgtcatgtctcttaacccttacagtatttagattttgtgtacatttcctatcttttcaacctccacaaataagaatttcttatgtgtggatgggactttggaatcagaatagctcttttacacatatctcaccctagtgtagttgttaaggggattggctcagggatcagattctctaggttcatgttctggctgggccactcccttgtgtgtgtgtgtgtgtgtgtgtgtgtgtgcgcgtgtgcgtgtgtgtgtgtgtggtgtgtgtgtgtgtgtgtgtgtgtgaaggggggcaggggtgggagacagagaaaacacaaggagaacaaacttgtgcaagttacttatcctctgtggacctcagttctctcatctataaaatgggggtgataatagtgcctatttcataaagctattgtgaggattaagttagttgatgtgtgtaaagcaaatagcattgcactgttagccattattagtctttgatcctcaccaaaaccctgtgaagtgtgtattagcatgtccattttacagacagagccttagaaagtttaagtaacttgtacaggggggcacacaggaagtgacagaactagcatgaaaactttggtctttctgataccaaaggtcatcataccaaaggaaggtttggtcttcttctctcctagttatttagattgatttttaagtattcagccatatgaccgccttttggcaaattttatacagtatcgattagcaatttgggggcttaattttacttttaggatttttttgttacagaaatagtagatgctcatgactacagtagcaataatatattgtatatttcaaagtagctagaagagaggacttgaaatgtttctaacacatagaaatgataaatactcaagggcatggataccccaaataccctgacttgatcattgcacattctatgcatgcaaaaaatactcatgtgcactccataaatctgtaaaatattatgtatcaataaaaggaaaaagatttttttaaaaatgagatatgtgaaatatagtgaattatttcagataagttctaggaagaaaaataatacatggtcattgaaaagtaactcagaggactataaagaaaaagctaatcattttaccagcttttagtcctgttgcctcaagggtaaattgtgttaaaagtatctttttacacttatcctttgcttgtacatggagattaaagattttcatatttctaggattgttggtttatttgggttccagcttcttacacacttggaattctacaaataccactccagtatatttctttctcttttttttgaagtctcagtctgccacccaggctggagtgcagtggtgtgattttggctcactgcaacctttgcctctcaggttcaagtgattctcctgcctcagcctcccaagtagctggggtcacaggcatgcgccaccacgcccggctaatttttgtatttttagcagaggcggggtctcaccatgttggccaagctggtcttgaattcctgacctcaaatgatccacctgccttggcctcccaaagtgctgtgattacaggcgtaagccaccatgcctggcccagtatatttctttgtttaacttaaacactagataatcagtaatctcttcaggcatggacataactcttttcatccatagtttggttggactatatattcatatattccttctattctctgtgggtaaggacagtgtcttttttctttcaagtgagcagtttaataggataaaaatattgcggaccactgacctacttcaaacccctcatgttacacaaaaaatagacacagagagatttgttccagggtccactgttagataatggtaagctgaagtacagacttagaattcccgtttgtttacttcaaatccaggactcttttctgctttgccattctcattattcccgagttctgaagaccatagtttccacagagtgcatgtgcaagtggattatcgctggacaccaaattccaaatgttcaagtacacatcatttcagtacacacacatgtggctagtgtcctttccaacctttgccaaagtaccacctcactttatgaggcaaaatgtgtaatggagtcaaagtccgaagaaccaagcagtagattgtagagcatggatagagatcaataataaatacttcaaagttcaaaaatggcgacatttgattcattgtgaattgacttgtagaaagccccattggagctgaggacaagtgtcttttgttttgtggctgcccctacatagccttgtacttagcacctggtagatatctatagatagaataaatgaattcatcagccaacctgaacctctatgttgcttagggaaattctggggatccctctcacatatgtcctgggatcttgggtgcaaagacagaggggtgatagataatatttttttccaggagaatttttttttcaaccacctaaaataatgccattttcttgattacaacaaaagacatatttactgttgaaaatttgtgaaatatagaaaagtataaattttaaaaaaatcatcaccaatgcaaaggtgattatttttctggacactgaaaaaaaaggtggcggctttgtgccttttgtctttatacatttatgtatcatttctttacagaagtgatatatgttcaaaacagaaaaaaatggaggccaggtgcagtggctcccacctgtaatcccagcactttgggagggcaaggcaggaggatcacttaagcacaggagtttgacacaagcctgggcaacatagcgagaccccatttcttaaagaaagtaaggaagggaggggaggggagggaaaaatagaataaaacaaatcattgagcagtaacaactattaacattgtttgttacatattctggaagtctttttgtctctttatagatgttaagagtttatagtgtagtggtcaaaagtaccaatccttgaaccagctggtccatggttttatggctggctcttctacctgcagctgtgtgaccttgggtaagatacctaaccttgctgacctaattttcttatctgtaaaatggtgcttggttgaacggagatgatgtgtggtaagcacttagcccagggcctggcgcataggagataaccaataaatgtcagatgctgttgtttttactactattactactattatcctaaacactgaggaggtgcatgcccttgttgatgttagtctttagagctttgaccccaactccctgagcttttcagtggcggtaatgtgaagggggctttgtttctgcattagccttgctgagtgagattaaaattcccaggcaggctttcctatccacattgaccaacactgcctttgtttttcacatttgtttcagtgacagcctgtttgattagggaactggccaatctgcttttctccctcctgacaggtgaattgggcccactcctttttgggttttcaaataaaatgtccagaccttttaggtttgtcagtaggcccaagcccttcagcccatttagggagtggcagcagtgagtgccaggcagcagcctgtttgcctccagagcttactagtttgccttggcccttgtttgccttggccctgtcttcctaaaatcacattagaaggaacagcgtctggcagtcttacccaatgtcttctgtctccaccttgagccactacttcaagcagtgtttctttatgcaatagaagccttatctagtgagtgcttccactccttagtctgtggatcagtggttctcaacgctggctgcacaattagtatccccagagccactttcaatacacactcatttaaaaattttacatcattttatttttggcacctaataattgcacatattttggaggtacattgtgatatttagatacagacagtgtgcgaagatcaaatcaatcttgttagcatatctgtcacctcaagcatttatcatttctttgtgttgggaacattcaaatcctctcttctagctattggaaaatatacaatacattattgttaactatagccaccctacatggctataggacattataacttattccttcgatctagctataattttgtatctgttaaccaacctccctatctccaccctccccagcctctagtaaccaccattctactttccctttctatgacattaactttgttagctcccacatataagtgagaacatgtggtagttatctttctgcacatactcattttttaaaagcactccaggcaattccaatgtgtgcaaccagggcagctctgctgtacaccttgttctagttctgccctgccactggctggggcttggggctttgaaggatttaatttcaccatattaagtatcagtttccacatttttcaaatgggatttgtaaaatttaccctctctacctttcagacaagttataaagaaaagataccaaaagataacaatgaaaagataacaaagagctttggaaagttaaaagcactacacaaatgagcacttgccttgttctctctttgacttcagtcacaattttttgtaaagggggtttaattgacatataatttacaaatgaaaagtttatccttttcaaatatacaattcagtggtttttaatatattcacagagttgttcaattagcaccacagtctaattttagaacactttcatcaccccgaaaagaaattgcataaacattagcatcatccccattccttctttccttgttctggacccaggaaaccactaatctactttctgtctgtatggatttgcctattctggacatttcatgtaaatgtaaccatataatatggcattttgtgactgacttctttcactcagcagaatgttttcagggttcatccatgttgttgcatgtatcagtacttcattcctttttacggctgaataatattcctttgtattatatatcacattttgtttagccatttgtcggttagtgtacatttgggttggttctaccttttggctattgttaatatgctgctatgaacatttgtataaagctatctgtttgtctgctttggagtatgtacctagaagtagaattgctgggtcaaatgataactcagtgtttaaactttagagtaactgccagactattttccaaagtggctataccattttatatgtccaccagcaatgtatgagcattccaagttctcaacatcctcactaccacttgttattgtgtcttttttattatagccattctagagggtgtgatgtcgtagaggttgagtatccgttatccaaaatgcttagaactcgaagtgtttcagattttggaatgctgcactttgtacttaccagttgagcatccctagtctgaaaatctgaagtgcttgaatgagcattcttttgagcatctctttaatactcaaatttgacccagccatcccgttactgggtatatacccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaatcatcattctcagtaaactatcgcaagaacaaaaaaccaaacaccgcatattctcactcataggtgggaattgaacaatgagaacacatggacacaggaaggggaacatcacactctggggactgttgtggggttgggggaggggggagggatagctttaggagatatacctaatgctaaatgacgagttaatgggtgcagcacaccagcatggcacatgtatacatatgtaacctgcacattgtgcacatgtaccctaaaacttaaagtataataataataaaataaaataaaataaaaaaataaaatatctgataaaaaaagtttcatattcaggaacatttcagatttcggatttttgaatgctatttctctgataactaatgatgttgaacactttttcatgtacttactagctatttgtatgtctttttggagaaatatcttttcagatcctttcccaaattttaattgggttgttttcattgttcagttataattgttctttctggatattaaacccttatctgatatataatttgaagcattttctcccattctgtgggttgtcattgcatttgcttgattgtatcctttgaggcacaaaatattttaattttgataaagtctaatttctctatttttgatttggctgcttgtgcttttggtatcacatctaagaaactgttgtctagtccaagatcatgaagatatatgactgttttcttctaagagtttcatagtgttggctcttacatttaggtctatgatccattttgagttaatctttatgtgtagtgtgaggaaggggtccaaattcatttttttcatgtggatatccagttgtcccagcaccatttgttgaaaagactcttctatccatccccattgaaatatcttggtatcctttctaaaaatcaatgaaaaataaatgtgaaggtttatttttagaccctcagttctatctcatttctctatatgtctatccatatgccagcaccacactgtcttgattgctgtagctttgtagaaagctttgaaactgagtgtgcattgtaacaagatcttctggggattagtgtgtgtgtgtgtgaatgttgaaaagggctggaaagcaaagttgaaagaaagcaaaatgagcaatatagtgttcagatgataaggcccagggggattgactagcctgaggccacatagccagtgattggcagatcttggttcagcactcaggtcttctgacttccacatcagtgctctttccacctcccctgttgcataagtactgaatgagatgcctttggttaatggacactctgagcaagagacttcagggttatttaagcaactgaactttgctcaatcgcctcatctgtacaacagaaatattacctctatcactggctgggcctggtggctcacgcctataactgcaacactttgggaggctcaggaggaaggatcacttgagccgaagtgttgagaccagcctgggcaacaaagtgagaccctgtctgtacaaaaaataaaataattagccagccatggtggcatgtgcctgtagtcccagctagtcagaaggccgatgtgggagggtcacttgagcccaggaatttgagaccagactggccaacatagtgagaccggtctctaccaaaattttttttaaaaaattagccaggcgtggcggtatgtgtctgtagtctcacctacttgggaggctgaggcaggaggatcacttgagcctaacagttcaaggttaccatgagccatgatcatgccatacactccagcgtgggtgacagagtgagaacctgtaataacaaatggaaggaaggaaggaaggaaggaaggaaggaaggaaggaaggaaggaaggaaggaaggcaggaaggcaggcaggcaggcaggcaggcaggaaggcaggaaggcaggctggctggacggaaagagggaagcagggagggagggagaaaggtacatcatagttattatgaggattcaatgaaataatcctttgttgggtgccaactggcaagatgaattcagttttccattgcataaaaagaatcggggggtaggcagagctcctcctgaggcccatctcttacctcaacaggtggcctgccaacctccccttaggtcccacacgcctaggaccttgagtggagtgaactgagactttagggcaaactgagggtttctttagaaagtccaaggaaagagtgatcacttctgggtcccggtactgcatgggtgccagttgaggaagctttggtggtaggatccggccagaggagctaacgcaggaaaggagtttggggtggaaaaacttcgtaagctaggaggtcctatgatgtagtggataagaacaggagtgtatgtatataattttatattgtagaaaattgaaagcatacacaaaagtagaaaaaatgttccctaatgcatctgtcacccagtttcaatgattgtcaccacatagcccatctttttctttttaacaatacacctcactccaccacaaatccattccacccccaacacaaacacctatccctggattatttggaagaaaatctcatgtaattttaactgtaagtatttcattatgcatgtctgaaatgtaaggacacagtaaaaaataaacattacaataccattatcatacctataataactagcaataattccttaaaatcatcaaagatacctagtcagcagagcccaggcttttaatctagccaaatcactgttccagtcttccttctacagcatcaatagcctgtctcagagcctgttttacattgtaaaatgaggacggtcataacaattcctgaatctttaataaggtaatgcatgtaaagtgcttaccacaatgcctgatacaaagtagtaaatgctcaataaaggttagctaagattatttattaataataataggaaatatttgagttgctattaaggtgcttttgagaatggctttgacttagaatcaagaggcagatttggagcccagcgaaatgattgttgcggggaggaataacgacaaaaacaaaacaaaaaaactttcaaagtggctgaaaagagagcaccggtatgaactgggaagtggagctgcagatgatggcgtcctggtaattttcctccactgtatgtagttttttccccctgcagttcccctggaggagagaggagaactggctcgggtgggggttgcaaatactagaaagtattctgggcaagaaggggcactgcaatcaaagggctgggggcccccagagtcctggctcaggagatgaagtctcaggttccctgggctcatgggcctaaagccccaccttgtggggaatggtctgagtgactctgtttctgtgcacggagtttggaggcatgaggcaggctcactacatcgtgttagaaacattcccattgttcaggaatggtcttgctctctgctgccagttccaggcatcagctgaaagctttttaataaaaatggaactcaaaggagacgtgataaggtacctgattttaacctgaagtgagagaacaccagatgtttcattctgtctgagggtttgagaggcaaagcaattagcagctgctactgatttagcaacagacacctgctaaatgaaaatctgtaaaaccggccaggcttggcagcagaagcgcatacactgcttctcaggcatttctgggaattgtaaattatgttggctcaaatggcagggcggggggcttccagtgaagctgaacatgctcatctagaccaggagtgtgtttttctaagatggcaataacttagaaatggctatttggttggtggatggagaggacgagatgagaacgaatcttccagaagctgcctggttcgtctctgctgctggcccagctcacaggtgccctctgggagtcatcctatagctgccctctggggacagatagggctgacagaaggacgagggaatcctgccacccctctcctcctgatccagagcacatctctccctgccaccaaaggcagtaagtctcaaagcaggaggaacacccacctctggactcacagcatctcctgctctgggacagttacagactgttggctttagcagtgatttggagagtttgtgcttgctttggctgggaaagagacttatccatagcctactgcctttcaggattcttttctaaggggatatcaatgcctgctctccacgtctattttctcgaggcccacagtggagcacaaacaatggaaacataggaatccatgcagagggctttagcgatctcctgggacactgcttctgtcctgtcttttagcccttatagtttatagtttagattttacatgtgtttcctatcttttcaaccttttctaataagaattccttacatgtggatgggacttggcaaccagcaaatctcaccttagtgtagttgttgaggatgggttcagggattttctagaaaataaatctattttctaggtttatttcctggctgggccactcctgtgtgtgtgtgtgtgtgtgtgtgtgtgtgtgtgtgtgtgtgtgtgtgtgtgtggtgttggtgggaagaacataaggttcttcatggagtgggtgttcaatatatgactgattgaagagaaggtcaatttgtaggtcaactaggtggtgctgaaagaattgagcaactcccatttgtgccttatgccacatgcactgtacataactgtgtcttggtctccaaactaggccagaggtcaactgtaacttgggccaaaggtgccttctgtttccagttttgagcaagggaatggcagctctccatatggagcagggaccagggggtgctgttggcagatgcatggtgagagctgtcctgaggaagtaccatccagagtctcgtcctagcaaggtgttttagtgtggttaaagggtcactcctggccgggtgtggtggctcatgcctgtaatcccagcactttgagaggctgaggcgggcagatcacctgaggttggcagttcgagaccagcctgaccaacatggagaaaccccgtctgtactaaaaatacaaaaattagccgagtatggtggctcatgcctgtaatcccagctactcgggaggctgaggcaggagaatctcttgaacctgggaggcggaggttgtggtgagccaagatcgcaccattgcactccagcctgggcaacaagagcaaaactccgtctcaaacaaaacaaaacaaaacaaaacaaaacaaccacaactcaactcctgcttccaaagatggaagtgagagaagattctttttcctttaactgagtgggcccttagttgagatatacagacatgttttaatttcactaactcggccccacagtgtaggagggggaaaggaacagcaagtagtccaggtagaggaagagctagggtccccacactctagccagaattgggggagctccaccttctctgatcaggggagagacaggattcccatcacctccttccaataactaaaataaccacagcacaaatatgtgtcctgtatcagcaagctgccattgaaagagggccatggaccctgcgtatgatagagcatgctaggtgcactcatggtccttataaaagcagccaggtatgcatgggctgggccctgcatgcacaagttacccattggtccactaaacgtatgttcctaaaacccattatggtcttaagaattcagactggcatggatgcaaaaattcagataacccctaagtaataaaagtacttatttttctttagaacctaagacctataagtctcaactaatttgaagaatactctggtgaccaaagggagaatgcctcttcaaaagattgcttttatttggaggttgcaggccttgcatagggtcgttcccccagcccccggggactctgttaatgaaggggtttgggtagggcttgagcctctgctccttcaacatttcagcatacacacaaaagagcctacttctcagcacagatgtgactactatgtgtccacttggatgtcacatttcagggaaggttcattcataatacaggtaaaatgttactatattttatcctctgttgttgctttgaaaagtcagtggtcagcctttttactcctttgaaagtaatcttttcaggtcacttttgaggtttttttgtttctttttgtttggtgttctgcaattttgctatatgtttcagtattgatttgttctttcttattctgtttgggagcctttgggcttctggtgtgtgggtatatatcattcatcaggtttcagaacattctcagctgttataacttcaaactctgcctctgttccattctattcttctgggaccacattttagagatatgttagtccatcttactgtgtcttcttatctcttaatctttctttgatattttctaatttgtcttactgtattgcactttggctaatttcttcagctgtatattccagtttattatttatctctttagttagttctatccattgagtttttatttcagttattatatttttaatttttttcaaacatacaaaacagtctgtaggtaataattttattatctgcagtctttaaatttctgttttcaggattcctggcttgtttccttgtgtatttaagttttctttattttaaatattattatttttgttgctttactgtaagttgcttattttccttgggattttatttatgggtagtttttgactcctggtttcctgtagaaaggatctgtcttcattcttgctaggcacctgagagctgccagtctggaatcatgctaaatgaattctgacctcaggttttttgattacccaagtagtatacattcacttttcaaatacacatgatggctggcttgccgttccaagtttttattggagataacctagttcctttccctgctactccaactcagtgtaaagattgagagtagattttccttatcgtcctagggggcaggagtaatttgtatttctagtacacgtttacactgaagtgtagctttttggggtcccagctttatgagagttatctcctatcagactctttttgggatatcttgacctttgtcccccatcccttatgccctgtgaagctatgagaaatcaaagctcaagttcagctggcttagcaaatctactttgggtgaaaattggatgccgtatcccacttatgtctctgggttcccactttcactttttttctggctagaaaattccttgtgtatttgacagttcatagattgaaaaataaaacaattttaaaaatattttatccaggacttttggatgttttcagtggtagatttgtttaagaactagctttttatatgctcagaaatgaacatctggatcttgttttccaacacttttatggctgtgtccttactttcaggagcaaccaggaggacattctaattctattccttggttgtcagtgctctcctgaaatatctctaaataagttgataaatacctactgtgtgtctagtattgtgctaagttctatgaaatatcgggaagaccatgtagcttctcatgtagctaacagaacattggcagtagtggccttcagcccttggaacactgatttaaaccatattttcatttccaaacccttttaagccctagaaattagcatttagaatgatgtggttgtaagactgtaaggtacataaaggcagaggccatttgtatcttgtttataatagttggcacatagtagatgctcaataaatactgaatgaatgagtatctgggaggtcatggaggcagattccaatgctgatcagttcccatggcaatttaattagaaaattccagatccatgctcacaggtgtggaggagaaagaatagctcaatagcaggaggtcaaaccatcatgtgtttgggtcattggtatatcaagtttctaagtcaagggtccactctctaccataaagggcctcagggcacatgtaggtagtataagtcggtgattaagaacatggactctgaagtcagactgcccattttcatcctggctctgtaagttacgttgggtcagttacttaacctctttgtgtctcagttttcttaggttctacctatagagttgtaggaattagctactacatactaagtattaagacaatgcctggcagagaagtgccatgtactaacaattacttattatttctattattattatctccgttgttgttttgaacaccagtcacatcataaaaaatacattctcctgggagttatttgtcatttctatatgaaaatattctgagttttcatacttaccccttaggattttggagcctgccctactggagtatttctccaggtaggggttgaatacctctgtatctttttttttttttttagggaaatatattaaaatacaggatgctgggccccatcccagttggtccaaagaaatttctttctctgaaactctgtgatgaaaataaagattctacacattctctgtgtgttgggttagccaggaactgctgcaggtttaagtttaccatccttcagtgctgatggaaaatctgggagcaggcttggagcctgagaagaaatagagaattggagagttaaacagaagagaagagaagaaagaaagaaatagaaagaagtgaccagagtgtactcatgtcaggaggtggtcaaatcccatccatctctggtggcctccaggggatatgtgacatttgctttcccttgatttagggatttatgaacctggctccaacttaaagcagaggtcatggggattgttagggggagatgttagaagtaacaggccagggaagcctgcctcacaaatgactgccaggcccactggttgcctttaagcaatgacccccagggagtagattaaccagattcccttcttggcagatggtggggtggggggttaggctgagtgcccttgagctgttttgactggcctgaaagccaaatccagatgctttcctgcttgcctttgctctagtgctagtggagggttggcatttatatcagtcatgccatctgatgctcaggtcttttaaagacattacaatatgggtggagggtaacacagactacctgtgcggatgaagaactgggagtttagtacctttcctctcatacctactgctctacatggcctaaattttctgggtggaatctgtaacccagggtagaggaaaatgatgtgttggtcctgtcattggtggaaaggggcctcgttgatccccttgttccactacctaagcaggaatgttaggcctgggcaagtcagtctgcaggcacagtttggcctccacatacaagccaattttcttttgacttgcagctgccctggttcctcggtaggcttttgaaccatctctttgattaattagactttcctctgagttctttggagagatctgtacaaatactaactttcccttattgagtaaaaagtcaaataatgtgttcaggactggacttcgaagtcctgaaacaccatcttgtatactcaaaacatctttcttttttgtgtatgaaattcaacctttgtctcagtttgaagaagtgataaataaatttgcattttgtgaatttggagctccctgagtccattttgatggctaggtagtacctatattatggcagctaggtagcgtaagtccttccgttttcatagtagactttatttcttttccatcagggagcagcctgaagtatggaacagacaataatggttaagatgatgggttcttgagccaggttccctgggttcaaatgccggctgagccacttaataaacccaagaccataggcaaattatttcactgaaaccctatccctttttcttttaaaatggaccttggatacacataattggagtaatcatatttctaatccttgactcatttcatgctgcaccattcgtccatgtatagcctgctttaattttatttatgtgtgcatttacttttttatggataatatgacaactgtgagcccaacttaagaattagccacattgatgagaactcagtctgcctgtgtgctgctcccccaatcctgctctctacctccctctccaccctgaaggaatcgctggcctgaattttggttattattctttttctctttttgaagttttatctctctcatatgcacagagatatttatattcatattgatgtagctatggatatatagatatatacatgtagatatatcttcctaaataagatattacttggttgtttttctggccctcataaaaagggtattatgttttaggtagttttctggtacttgcttgttttactcatcattatattagtatgattcattcctgccacagagtataactgtagttacaatttcactgtggcataacatttcatgttaatataccacaatgtatttctccagtctccttgagatgggtttttggtcatttccagtattttactatcatgaaaaattcctctgttcctcagttttctcatcttcaaattggggaataaccataggagctaccacataagggtgttatgaagataaaaggagttaaagtgcttagaacaagaccttgctcatagcatattgttggtccgtgtattggtttgttagggctgctatgacaaatatcacagactgggtggcttaaaaaacagaaatttatttcctcacagttctggaggctagaattctaaactcaaggttttggcagggttggtttcttctgagggcctctcttttccactggtgagtggctatcttctcccaatgtctttgtagggttttttcctctgtgtctgtctgtgttgtaatctcttcttctttattgtttttttctttttagttggagtcttgctctgtcacccaggctggagtgtaatggcacgatcttagctcacagcaacctccacctcccaggttcaagcaattctcctgcctcagcctcccgagtagctgagattgcaggcacctgccaccacacctggctaatttttgtacttttagtagagacagggtttcaccatattggccagcctagtcttgaactcctgacctcaggtgatccacatgcctcagcctcccaaagtgctgggattacaggcatgagccaccgcgccctggactgtaatctcttcttatgaggacactggtcatattggattaggacccacccatatgacctcattttaccctaattaccttttttaaaggcactatctccaaatacattcacatactgaggtattgagggtgaggaattcaatgcatgaatttggggagagacacaattcaggccataagagtcagtaagtattcattatgaccatcattctcttcaccctcctccttatcattaaagctcaagaaaatgcagcagacttagttatgatatatcccctaggaacactattatgtgaactattattattatccttaggcagaccaaacaccagagcttccttcccggccttttcagaaatgactttggatacttggataccagcaacaagtactcaaaaatggtaaattgtggtttcttaagatgataggcagcagctccttaagtcagttagatgtgggaggaggagagtgaggaggtttcatttccatcttggttaaaagaaacagctaagtgagctcttgtagagtatctaatggtatacagactcgaaattgccacttggtaaagttctatgggttttcctgaaagaggcaggcagatctggtttttcaaaccaggaaatacacttgcacaagtggctgtgccaccagaacaaacagcatcttttatgggctcaaagtatttgacattagggagctggctaggggaaggcacctgatgaccacaactctgttcccctgctctctcaagggctctaagcactaaggaggaagtcaggagtagccctgatagggtttggactccaaaaggaaggaccagccagacacagtggctcacgcctgtaatcgcagcactttgggagacagaggcaggcagatcacttgaggccaggagttcgagacaagtctggccaacatggcaaaactctgtatctactaaaaatacacacacacacacaaaatagccaagcacagtggcctgtgcctgtagtcccagctactcgggaggctgaggcaggagaatctcttgaactcaggaggcagaggttgcagtaagcctagatcacaccactgcacgctagcctgaacaacagagcgagactctgtctcaaaaaaaaaaaaaaaaaaaaaaaaaaggaccagtggctgcccccccgcttaattatgcccccctgccctttccatgtcagacgatgaaaattagatggaatagcatgtgcctggcagggctgtgggcatctgtccttactggaggtgaggtgaggagtgggagtagggtctcgagggaaaaatacaatgagaacaagggatttgggggtctatggatgccccctttacacattattttcttaacaggctgtgattctccaaaggagggaattcttaaaaactagaacaaattaacactaatcatcattaataatttaatgcatcctcttggataaggattcctgtaatgtagagatgtaaagaatgtaacataaaagttcccacctcctactccccagagagaattgctgttaacagtttggtgtacttatcttttaacttttttcatcctttaaaagaatttagctacatgattaaaaatgaatacattcatttgttataaaaaatatatatatacaagtatacagagcccaaagtcaagatcttccctttcctatcccagtctctcttcctcaatcctgtttccttctccagtttggggaatagtaactgggtgctatcttagatccattttatatacacccaaaaatacatatacaaacttattccttttcttctaaaaaaaaaaaggatcatgccttatacaatatagacttgctctattttacctagaaatggttgtacctccttaacaacaacaacaaaaaaggtggagtaatacatcttccagagtgttttttgatgactgtcttactgatgatggtcatttaggttgcttttttaaattacaaattttttgtaattataaataatgctgcagtgaacatctttatgcatatatttttgtgcatgtgggcaagtattgctgttagtaccaattcctagaagtgaaattactgagtcaaactgaatgggcattttaaagttttcatagatattgacaaattgttctccagaaataatgtatcttgtttcttcttcggtgtactgtatcttggggtttcaccatattagttcatacttttatcatttaaatttagttaaatatttaaaaattcctaagtttttactatacaaattttcaaacatattgaaaagttgaaatagtagcatagtgaacaatgactgtacatcctccagctagattcaacaatatctaacatttctccatattcacttcctatctaaatttgctgaatcatttcaaagttgcagacatcttgatgcctcagtctaagtacttcagcctgcagctcctaagactaaggacattctctcgtataactacaataccttaccacaattaagaaaattatcaacatttctataataccatctaccttatttaatcagcttacatttaaatttccttgattgtcccaagaatgtcttttaaaaaaaaatcaggatccagtgaagtttcaagtattgcttttgattattccatctctttactggttttcatttttttaacctaagaacggtacccccttcttcatttatgatactgaaatttagggagttattttgtagaatgtcccacattctggatttgaatgtttccttaatgacaccttcttatttttaatggcaatgtggtattctgtaccatgaattcatcgtggtttttttaactagtcccctattgatggtcatttaggtcgtggcattccttttgtggctcctctcacaagtggtatttcgtcctaaggagtttgtggccccagtaggccacagttaaagtctgtggtcagttaatgaagataaagtgttccaaaacctaacttcgctggcaggaacattatcaagggcagttgtaaactgtgaattgcatcctttcccctctaaaggagatggattatcttttttgattccctgatttattttgagaggctgtagtctagggctgagctgagaccagggttctgtctttgtaactacctattctcacttggcacctgatcattaaccatggactcttctggtaaggccaagtcacctgaggtatggtgtgagctcccttaatttgcagtgtgcagccctccctcaagcagttattctcacttcagcctgttcttccttcctcatctcctgggatcccaaagctaatatttccatctgtgctttgggtcctattccctcccacctgcttccagtcctctcgctgtctagtgcctcctgccccttatgcttctccagcatctccctgtccactggctccttccttcagtctatacagaatctctcctgttcttaacagttatttctcaatattgataccaccctttagttatagttttcatctctctccaggcatttactcttctcaaaagattactgaggaccaggggtccaccaaatggggtgcaagagatgttccattgggtgtgtgaagaaaatgttagatttctattctaataaaatttcatccttttaaatttccatgtttgtgtgtcctgatgtacatttaggtgtgcatattttataatttacagttatacatgtatatcatttgccttactttcgattcttatcatcctctctagcccccttcagatccacacccacctacattctcaccgatttatgagcttctctcccaggcagtcacactggcatcacaaattcagcatggccccagcttcttttcttgtacctcacctcctccaatctgcaccctagactgtaggtcccaacatagggagaagccccaacatcccaccatccatctaagccatagcctgtgagtcatcttcaacttcttatcttctcttacttctgcacaataccctgtccagtcaattaattagtcctggcaattcaacttccttaccttctctcaaatctgcccatcctctcttctctcgctgtgtctgcctttgtttaggcattgctatcgccagcccctaactggtccctctgcctcaagtagcaaaccctgcacacaaccaccaaaaggagctctgcaaaactacataccatgcatgcctctcactcacttagaaaattcaaaccaaagccaatacatgatctacagggcctcccatgatcttttcctgcactgatattcttgccttatctgttagcctcctcaactagactatgaactgttgtagggcaggggtccctaccctgcaagatgtcttcattattgccacatagcaagaggcaagcacattacctgtcacctaggcgtgccttaataggtgtttttggtcaacagtatgaaagtgagaataggactgttttgggtaagaacaggagagtggagttgaccttcctttgagaaataaagaagtttccagtgagaaactctggcctatagataggccaaatgaatggactgatgtggggagctaaagttaccctggtagtcatctgataaacatactaatgtgtgacttaggactgtgggacaggcccaggtgataccatctcttcttgctaaggcagaatgatgaaatgaaaccccagcttttgacctagaaagatgtggcattaagtcttactgcctgggatggaaattctggctttcctggttactggctggattgatgttgaaaagggggatagtgattataacagccagcatttaatgagtacttactatatgccagcactgggccaaggattctacaggtattatttcaccacaactggatgaagtagatactgttattcccatttatgaataagtcaactgaggctcagcaaaattaaatgatttgcccaaagttgtatagagaataaatgatggagacagaatttcaatctcagcagcctgactccaggctggagataccgattgggagtcatcagtatacagatggtatctagagccaggaacctggataagattacctagtgagtgggagtagctatagaagaggaacatggaattggttcttggcccctgtagtatttagagatgagggacataggggaaattcagcaaaggagattgagaaggaacgccattgaggtagagaaagaacagagggtgatgtgcgagaatcccagcacagaaagtctattcaggatgagggaatgatcaactgcatcaaatactgttgatggaccaagtaagatgagacctgaaaatagaccaggactagtatttctagttgtgcaggttgttaattgcataatggagtgagtggtatctagaatctctctgacaccctggcatggggttgagccttggcagaagaaggagagcctatttcacataaagacgccatgtgggctaacttccatccttgtgttgcctactggaattagaaacatggaggtcattggtaacctcaacaaaagcaatttgagtgaaatggtaggaatgaaaatgtgattgaattggatggaagaatacttcagaggaaaggcagtgatggcgatgagtagagacatctctggaggagttttgctgtaaagtataaaggaaagcagagaaatagaggtggaagctccattactaccacaaatggaagtgaggtcaagagcttttgtttctttagatgaaaggtattttagcatgtttgttttctgatagcaatgatccagtgagaaaaacagacaattgctggtatgacattcttgagtaggtgagaaaggataggatctagtacaggagtgatggtactagccttagccagcagcacaggtgcttcctgcatagtagcagaggaaaaagcagctgtggggatgggtgcagggaggagggaggtatggaggtgggagcttatgcatgttatcttctaatggctctccatgccccctcacctcactgaaataggaaaccatttcctcagctgagagcgaggatggggaaggtctgaggaaagcaggagaagttgtgaaatagtggcctgggagagaggagagtaaatggtcttgggaatatagtgagattgtagagcagcatgaaagtctggcactaagtttgttgtcatgaatgtaaagggttaatagcatggctttatatttttctccagacatgtttgcttgcatgggtttagggatgtgaagtcagacagttggatttagccaggaatgtggtattgcaaggtaagtaggacaaaaagagagagtgtgtcaggagagttgggaatgtactgaaggaagtgatgggccttgaactcaatgctggtgagcatagaagtgaggacatgaggttggtgagggggcagtaaaaaggtggtaggatcaagactgtaggtcctggtgaagtgggaaaattgtgagagtagggatattagagggagtgaattggccagacacaaggtggtggctggatagtagggtgcatgacagaggttatggagagatcacagccattaacagtaactggtgtgaccatgtgaaaaaggtgtgaggtaaaatggagaggagaccttgaggagcatggagggcaaggcattgagaggccagggtgttgctaaatattgataccgcagagattttgacaaaggaatgttggaaaggcatcacagggaggggaaaggcaaaaccttcaaggactgaagaagggagggtatacatggagggggccgtaaatccgtaaatgactgcaacagaaaggagtagtgggtgccatagtctcaggacatgagattcaaatcagcagagtggttagcaaggaggcagagagaatggtctggaagagacagcaatttagaaacatctgtgaggcacagagaggcactcccttggcccagttgtgtaaggttatatgagaagaaaaacccccactacttgagagagctgtcaggatagcagtgtcttcagagaggaagaactaagtttttcttaaagaaaaaaggtgaagggactgctcaggtgactgatgtaaacagggaagtaggggcgtggtgggatcagtggtctccatggcagaggacagtggtgtagctgtcagggttgtagagtgggaggaaggaggttgagattctttccacgaacagagtccacgcacctactgtttcagacagtctaaactctagagccctagagaactttaccactctggtcttttgattctaaaaaggatgttgacttgtgagaaggtagttaatgacctgtgttgcttaaagcatttttattacttttgactttaaattgcattgatgcaggactttttgtctataacctcaggattcctccagctgaaaaagaaccaggctatgtatattagagtggaattccaggtatgagttctctagtgtgtagaaatgaattaaccaagtggaactctttctagggaagtatggcatttcacagatattacttgtaaaatggggaaaagagggtcaggggaggctcgctgagaaagttcccagaactcagcccagactcggtgctcagtaaagaactgtcttagctgggcatcatggtgcatgcctatagtcccagctacttgggaggttaaggcaggaggattgcttgagcccaggagctcagggctgtagcatgccatgattgtgcatgagaatagccactgtactgcagcctgggtgacataatgagaccctatttctttaaaaacaaaaacaaaaactttttcctccattattgattgccctttccccctgtccctgtgcctattgctgtttctttggatgttatttaatttctctgtgccttagtttcctgtatgtcagatgcgcatgatcatagtccctacttcataggaaagttgtaataattaaatgagataacactatgtgtattagtccgttttcatgctgctgataaagacatacacaagactgggtaacttataaagaaaaagaggtttaatggactcacagttccatgtagctggggaggcctcacaatcatggcagaaggtgaaaagcacgtcttacatggtggcaggcaagagagaatgagagccaagtgaaaggggaaaccccttataaaaccatcagatctcatgagacttattcactaccaccagaacagtatggaggaaaatgcccccatgattcagttatctcccactgggtccctcccacagcacgtgggaattatgggaggtacaattcaagataagatttgggtggggtcacagccaaaacatatcaacgtatagaaatatttaacacagtacatggtacataatataagtacttaaatatgatttgctattaaatgacaagtggtaagttcttggctcccattcaactctcttattcttgccattatgtttcttcttacttcaccccctttctcttacatcttcttccctttctctccttctttttccacacttcctccttaacctatttcctctttccctcccctggctttggttgcagtggcatatgcacctagttcagtactctttgtggccccctgaagtagagaagtcttagagtaggggtgaggcagccatcagaggaaggaaactgctggtggggacagtctcttggccattccatctgaagtctgtagtgtagccatggtggctgcagagatgcaaagggccagtgacaagaggctcaggagctgggaggcctatgttgcagggcaagtttggctactgtgtgatgtgtggctggggcaccagacagtaggcagagcatgctatgaagatgaggatcatttgaacaggaagggactgggctaaatcaccatgtggagggacgagtgaggacatgtgcatgtcctgcccctggtcctgttgctgataccactatgactactcccattcataagggtggctcctccccacggggcatctcctgtcagtcggccttctgtgggagggagcgagtgagcaaaggatagctgagtgtgctggctaagactataaattctagagccaaactgcttggatttgaatcctggctctgtcaccgaatgagaatgtatccttgagtaagttatctaacttttctgtgcctcagtgtcccatctctaaaatggatataattggaacaatacagttcttatgaggatttgtttaaattaacagtttacaaagtgattttcatagttcatggcataaaagaagtacgatgtgagtttttgttatattttaaaaattttaaaaatcatacaacaatcttagaagacttactttcattttaccgatgccaaaacggaggtggagaggttaagggccttggccaaggccacagagctaccgagcagcagagtcaaatctagaacacagctttgacatactccaaagtcctagcttgtaactgcaatgcttaactgcctccctggacattcaggtggagactttgctttctaggagagctgggaggcagggtgaggcaggtgggcaatgtgagtcaaggtgggtggtcagcagttggagtctgagaggttgggagaagtactgcttgaggacacacctgggactagtggctgcatgcccttggcccggctccttggttggggagagcagcctggcttcccaggcccatttcagggacaggtcaagtcccttaggtgcatgaaggtgctgatttcagccagagagctaagccttcttgggactttttccttccttccctattttccaggtgacctcagtgaagttaataacccttttgcacctcagtttcctcatctgtcaattgaggataatactttacctgtctgcttcctgggtattttgagacattgagtagattgtggatgtgaaatcatttgaaaagcataaagcagtacctaaatttaagatactagagtgatctcagaccacattactgtgagggtccagtgtagatctctcaggcctctccatagctaccttgtgctgataatgcccagtgtccaatttcatgaccttttccagctggggtctacagtgatacttggactcttacctccttttctcagtttttacatttcccttggtgagtgtaaagtaatagttgagcagcatgtgggtccctgggaaattattttccgtgtggatttttatttttaagagccagagccaacgtctgtgtccagcctccacagttgtcccagctcccattctgggagctctgccatcttcttggtttcagcccttggcataagacagacctgggctcctgtggctggggagcctgtaactgcctcctctcattagcagacagtcttggttatgtgcttgccctgtggggaacagggaggcagctgaccctttcccctgggtgcctttgtctgtcctggcatactttggggtgtgtgtgtgtgtgtgtgtgtgtgtgtgtacacgtgtgtgtgtatgttagagattctgtaagcccaagaggctaggcctcttgtcagctgccaaagttcttttttccccagaattgagttagccacccaactgtttccattctctgcccgctgcgaagctctacagcagggctgctgtggcaggtcaaaacatgctctgctttgagaatacagagattccattttgagagagatgggaaacaggagcgagtgagtgggtgtgttggatgtagggaaagtgaggacattctttttggtaagctgtgccaaaattggcccagaagcttggtctaaactcaaaagtagggctaatgctgggctgacacccaaatatccaatggggaaagtttattcttggatctagaccctatgagacctagcaatcatttttttttctcatctggaatatggggataattctactccatatattcttcatgtcaaatgagaaataaacttgtaaatagtctaccgtctagtctccaggagcaggaagtgacataaggttgtgattcttaaagtattttgcagaatacaaactgttactaaaaaaagaatcacttgctaaataagtttggggaacactggataaacaatggcatgttttttgtctgtaggggccactcaggtccttcatattccaataatacacatgggaaaccaccaaggggatatattatatactacatctcctaaatttttaaccaaactttcttagtggagcatttacaagtaccttctctacaaaagacatctaggaagatcctgatctagatcagaagaatattcattttgttcttttttttttcctgcaattgtaaagagaagtgaattggtgaaatgcatgggattgctgaaatatgggtcctgaacagcaggggaggtcaactttggactctgttgaaatgaatgcttcctgctctaaaacacttctctccctcctatcctcacagctcccctttgaattggagatttactacattcagcatgttatgctctacgtggtacccatctacctgctttggaaaggaggtaaggccagcaaaccacattcctatgtaacccccacacctaacctctcccttctgtttttgggagtcacagcctcttgggtgcttcccaggatcttcagctgccgcttgactgagtttcttcaacataatttatgccgggcaccaggaagtggggagatgggaatggacgaggcctgcaaggggtctggggactttttagacccacccttcactgggtgactatggtgctgctgactgtctgtcacagggcctgggctttgggttcttgatggtggcattgtgtttgcatggagccccccacactgtcaccttcttgtacttgtgccttccccctgcctcaatgtgcagtgtgggatagaaggagagagtaaagcactcggtcccctcaagaacaaaagaagatattgtaaggggcaagaagtccggggaccagggcaattatgggattgaggggagaggcaggtgaaagagtggtggtcacccatgtaaaataaaccactgaaaaccttcatttggtgaagagggagagaccaccaacctggtagaggcagcctggaaaggaagctgatctatttgtaacctctcagtgacccttagattatcccttccctctattgtgtaacagacaaaaggaaaggggtgcctatccatctaggcttgttgtgagagccactccttctcagtgttctttactttctgaaaggccctgtgactggaagtcatcctcttttagttttagccccagcctctctatctcagttgctgagacttttctgctcctacctcactccaggcagcaagggtttcatttctaccatactgaaagtggcatgaggccacatgggcccttgagctcactggaagatagtctgggagttctgctgggcactgctgcttcttggcttatgcgtggatgctctaaatcaggcattccggcagatcttaagatctggtgtgagatagccccaaggactggtcaacccaggaacatattacaggatggagtctacttatagtccagagatttgcctcctatgccttgatttctatcagttctccatacttgcctaaatattctttgagactgcttttaccctgtgcggccacttggggtctcacgatgtcccaaaacacttccttttaatttgctgtaaaagcactattttcctcacgaggctttaaggaaagtctgaagttccaatatccaggagacttgtgccatttctcaggtctgtcccctgtggcacaggaaacagcctcttaatattaagtctcagaaatacacacattctgaatagaaccaggcagataggtgttcctgggcctcagaaccctgctactcatcgttcctggcttctgaggtgtgtgatggaagtcctagccaaatctgcatggctgttatttaaacatatttgtactctaaggtcaccataaaaatctgtcaggtagctgggttagactggtctgacatggaaaataccaagtagccatctttcctccctccaaaagaataatccaggaagccacatcctcaagacttggctaactctaagataattgtatctccttagagcagatcctcccgatagcccagttccctaagtggcgaggtgagagatagtagggctgtaatgagagacagtatgctctgttattgctaataaccaatagataccctggtgcagtgagggtttagcttgcagcaccagtggagtgatctcaccaaactgactttttactccaggacctcaatgagagcatctaccaccccgcagaagttgatgggccccagtaccttctatctggccaactttgagctattttgagggctcatctcccatctccctttccagctctttactgccatctgctgttcacttggggggaattatgagcattgagagaaacatctggatttcttcacctttgatcccaagccttggacctaggccttgcagagggagaatggatctgaagcaagctgtcagaagattagttttctgtaaaccaagaaagccgagagtctggggcttctgttccctagaagtcgcttgtaattttgtagaaataaatggcttagcaatttttacccagtacaagacagctctcctataggtatctcccatgcccaggaaccctgttttcctgaaaggcaaggtcctgcttgagcatatagtgcctcttcctatggtttggggtgggtgggtaggtggcgccttgtgggaaacccactcatcccttattgttgcagaccttatgcactgtcacagtacatgggacctctctcatccacactgctcttttcttcctctggcctgtcccttcatttccctgtttcctttccttcaaacttgttgcctgtggccctctggaactctatttcttttttttctgtgttacagtatttttaaatttaatttttattagatactgacaaattatgcttttatatatgtgtagggtacaaggtgatgctacgctatatgtatacaatgcagaatgattgaatcaagctaattaacaaactatatttcttacaaaccactcccaaccccaccggcagctctgcatggggcacagagccttcctgtctcttgcctacagcttcctctaatggaggctgctctttctgccctgccccatatgctgcagagccccctctgtctcttctagagcactatctcatctgtacgttaggggaaaaaggctttctcttttactattctctctctttttttttcatcaccaccatcacttgacctcttggtcccttcccctatattcctagaagtcactggcctgtagctctcaatatttccattataatttgagccaacatcctgagagacttcttgtaaggaccacccatccaccccagcttctcaaggtttgggcttcttaattgcagtgacctcagcattcccttcttttcagccaccaggaccttgttttcccgtaaagctcctctatgtgagaacgtaactcctgttatgttctttctttgacccaaatctccactcctttcctcttcttcctattcagcttgtatctccatgacctatcattgaaactttcactagctcctgaaagtgtctcacctcccttgtcccttccaactgggatcagtgtcccatgccttttcagtgtgcccagtcttggcctactggaggagctctttcaagccattctgattagggccatgaaaatttcatgatgtctattataattgtgctctcaacaccattgctcaatttattttctgtctatggccagctcctccacacattgccctcacaagtcctgtgctaaatctttaccaccctcctcaaatttcctgtctactctgttcaaaccttctgttctctccaccctcaatagatcccccctctccccacaaatgactgagaaaattgaggttttgggatggaaatttcctcaacacttctctctacctctacaagcttctttacccacatccatccctatcttcctccttctcatcctggaagaaatggtgttcattctgttctggccaataatatccctgtgcgattagctcccacccctgctaccacctctggagcctcattctatcaattaatcacttatgtacctggatattctttttctttctttttttttctttttttagacagggtctcactgtatcacccaggctggagtacagtggtgcaatcacgactcattgcagcctcaacctcctggcttacatggtcctcccacctcagcctcctaagtagctgggactacaggcacatactaccacacccggctcattttttttttttttttttttttttgtattgtgtagagacagggttttgccatgttgctcaggctggtcttgaactcttgggctcaagtgatcttcccacttcagcctcccaaagtgttgggattacaggcatgagccactgtacctggccattagctgaattttcaaccctctcttcactgctggcttttcagccaatacagatgttcaaatctttcccattctaagaaactttctcgcaatcccatacaactctgtcttccctcttcccttcacacctaagcatcctaaaagaataatctaaacaacattttctaaaatttagttctttgggcaagacaatttttgtcttatccacgtaaccatgtgtgttattatgtatgtaatacatgtccttaaatctattgagttttttttttttaactaaaatatatacgctttcaagagaagccccataatatccatgagattgtggctttgatttactggttatctattttaacacagtttatatacaaaactattaaaaatgaaatgtttatctgtttgccacctgaaatcacctcatacatggtgcataactttgggagacactggggtctgcccttgagttttcttctcaattaccctttattcctcagaccatttactctgatatctaaccctctaccagacttttcacagaaatggtgcttctaaagatcaccagcaacgtctgtctgaccaaatctaatgaccatctctcagtctttatcctacggaatgctgttgcattggatggtattgatcactccgttttggattgctctgcttcggggcttccaaagttcctccctttcctggctttcctacctcaccaatcatgtcttctcaagtctccttcacaggttattttttctcactcctctgagatgttgagttctgttctaggctcacatctcattctaattgtctggtatggttttgcctgctttcacggtttaactactagtctgtctagttatggctgctacatcactgtctacagctcagacttacgagagtcacattcatatagtttactcaacttctctacctaaatgtctcaagcatatgtcaaacccaacctgtctgtgtcaaactcattatcttccctgtcagccctcctgctcttcttgtggttcgtgccaagtagcagcatccaatcaccccagctaaaaactgggaatcatccctgcctcctgtatgcaatgcatccgttcatctcacatatattaacatatgccttcttcctgccaggatccagactgaccactggggtgccctgataagcaaaaatcagacaccaccctgtccttcataacatttataagctagtgggggtggagtggggagatggatatgaatcaaatatcacatgaatttatagttatgactgagataagtactctgaaagaaaggaacatgctcttatgagaacttagaacaaaacaagctgactgagtttgggggtttggaggagagttccctgaggaaatgacatttaaatagaaatccaaagggtgagttggagcttattaggcaagtacaggattaggggaggtgacttcttgtagatgggcaaaatggcatgtacaacagcactgtggcaatggggagcacaaggggagtggatgacactgggcctgaggggcaggctggcgtcatatatgaaggctttgtcacccatggtcaggggtttggccttgattgccaaagctatgggaagcctgtgaaaatgtgaagaagggatataacatcagcttgcttcaccaattgattcttctctgatttaacttatttgcacattttacacattttaattcaaaaatctaaaatataaaaagccatactgtgaaaaatatatttcccgtcccttccctccatccatatagttccctgctacaactccacgagtaactactatttttggtttttgtatatcctcccagagtttgtttttttgcatatacaagtaaattttaaaaatattttcccccttcttcagacattcatcctaaaatagcaaatacacaaccatcctgttgttactgttttgcttagcaatatttcttggagagctttccatgtgagcccacaagaagctccccctttctttcttttttttttatagtggcataatattacattgtgtggatgatagaatacagtataataaaaatggcagagctttgacataagacaactatatgccagatattgtcacacacttttcccatgcattaactcatttaatcctataacaactctgttaggaaggtgttattattatctcccttttatggaagaggaaactggtactcaaatagcaagtgacagtccccggatttgaagccagtagtatggttccacggttcttgcttttaatcataacacaaagttacaacactatatcataatttatttttttcagtctgctattgatggacatttaggttgtttcaaatcttttgataatgtaaataacactgcactgaaggaactggtacctttgccattttgcgtgtgtgcaagaatatctataggatatattcccagaagtggtaatgctgaatcacagtatatgcatttgtatttttgttggatatttccaaatccatgaaagttgtaccagtttaaatgtttactagcaatgtatgagagtgtctgtttctacacaacctcaccaaattggatttttgcccatctgatgggttaaaaaaaaaaggtatatcagttcgattttaattttaatttcactttgagtgaagccaagtgtctttttacatatttaaaattggcatttggctgggcatggtggctcaagcctgtaatcccagcactttgggagaccgaggtgggtggatcacctgaggtcatgagttcgagaccagcctggccaacatggcgaaaccccctctctactaaaaatacaaaaattagccaagtgtggtggtgcgcatgcccgtattcccaggtactcgggaagctgaggcatgagaatcgcttgaacccaggaggtggaggttgcagtgagccgagattgtgccactgcactccagcctgtgcaacagagtgagactcagtctcaacaaaataaaataaaataaaattggcatttgatttcctcttccttgaactacatgctcctatcacatgctcattgttcaattgtgttggcctttttacaaaatttgaatcctaagagcttgttacatataaatattaacagtttaccctttatgatatgagctacagatattgtcctcagttgtgttttcttttgactttgctaatgttttattcttgccatgcaggattttaaaatttctttttcttcttcttttttttttcttttcttttcttttttttttttttgtctgagacgtagtctcactctgttgccaggctggagtgcagtggcgtgatctcagctcactgcagcctccgcctcccgggttcaagcgattctcctgcctcagcctcccaagtagctgggactataggcacgtgccaccacgcccggctaatttttgtatttttagtagagacggggtttcaccatgttggccaggatggtcttgatctcttgacctcgtgatctgcccacttcggcctcccaaagtgctgggattacaggcatgagtcaccctgcccagctgaatttttacctttctatgtaatttatcttttatggcatctgaatttagagtcatggttagaaagccctttactactccaaggttataaaaaatatatatcccatattttcttctggtatgtttatagttccttttattattattttttacatttaagtcttttattcacttggaatatatcctgatatacagtgcaagataaagatccaactttatttccagctggcttcccatttgtccccacactgtttattaaatagtccaacatgatccaatctgcttgtggagaagatcatattggctgctgtgtggagaaatcactgggtcctcctgctcttacctcctaaatatctctcagactcatcctctccttaccatctctaggaccagtaccttgggccaagccttgcacatctcttccctcaatgatgataattggctctgtgtgatctctctccagccagcctcctttgctccccctaagcccattcctggagctacttctatagctcaaataggatcatagctctttgtcatttggaagctttcagtggccccccatcttccccagtgcacaagaccgtatgacctgatacccaaccccttctccaacctcatgtctttacactcccttctttatactgtacactgtggtgatacccaaatccttggggttccctgagtattttatccaattttcatgcctctgtgcctttgaaaatgctgtgatttctgccaggaatgctcttctccagctgtgggcctagaaacattcatttgtcaaaactcatgtcagtagttactttctccaagaagccctctgtaactattctaccccagctcccgccagctgcctctgttcctcccatttttgtcatcctcacagtatagtctttacatgctggtctccctgaggacaggaatttttcatttcttcttggtatgtaggtgatgaatgaatgaatgaatgaccttctattcagggatgtattcctgtactgcaaattgcacataatttattatacatcttacaagctaatgtttactaggcactgggtttgttacatgtgtgatcttgatctcatttaattcccacagtgtccactagacttatgggagtacatcacgtgaggcccatgaccttgaatgagaaaaataatcacatctttatgtccattaactgcaactgaaatacagtcatctctcggtatccatggggaattggttctaggacttcccccaccacaaataccaaaatccaaggatgctcaagtccctaatgtaaatgacgtagtatttgcatctaacctacacacatcctcctgtatactttaaaggaagcttgtctaacctgtggcctaggatggatttgaatgtggcccaacacaaatttgtaaactttcttaaaacattatatttgaaaaaaattttttttcagctcatcagctatcagtagtgtattttatgcgtggcccaagacaattctccttcccatgtggcccagggaagccaaaaaattggacatccctgctttaaatcatctctagattactcataatacctaatacaatgtaaatgctatatacatagttgttatactgttttttatttgtatttttttttactattgttattttcatttttaaaaaatatttttgatctgtggttggtcaaatccacagatgcggaacttgcagatatggagggccgactttgtggtatatcctttagtaaggaatgtagataacaaaccacagttacattagcagcacttggcatgctgttgttaatgtaaattacacttattttcctcttatgttagagttgttgcagatatctcaaaaaatcattggcattcatcattacctcaaaatttaaaaacagatgtgccttttaaaagcattttgataactatagttcaacatgattattttcttttataatcctatatattctatttcgtatacttaaatactttattctgagagagagcctttacacttccccagactgcccaaggagtgcatagtaccaccaaggttaggagtccctttactagagtttattttatttttatttttttgagacagatactcactgtgtcaccctggctggagtgcagtgacctgatcttggctcactgcaacctctgcttctcgggttcaatcaattctcgcacctcagcctccagaatagctagaagtacagtcacatgctgccacgcccggctagtttttgcattttttgtagagatagggtttcaccatgttggccagggtggtctggaactcctggcctcaagtgatccgcctgcctctgcctcccaaagtgctgggattataggcatgagccactgtgcctggcctgcactagagtttaaactggtgtttgaaaccaggtgggcagagatgcctctatgctgcctgtccatggagtcgctggattcagacagactgtaggtacaaatcctagttatcccacttgctagttagttctggcatttggtcgagtaccttgacctctctgtgtctgttttctcacttgcaaaatgagggtagtaatagtacctacctcatagggtgttatgaggattcactgagctgatacatgaagagtatacagaacaatgactggcacatagtaaatactatgtattgggtttgtataattattaattacccactgttctgccttgtgttaattattcatctttcttccaactagactgccgtctctagaggtcaggattgtgccttgctgtgttctaaagccgcagaaccttgcatgaactgagagcatgcttgtcagtggatgtaacattactggtcctccctcctttgagacacttgtttctcctttgagctccagggtacctctttctcctggttctcctacttctctggttctttctccttgggctcttttgctctgcctgccccatagatcctggtgttcttcatcaatagagataacacaggcttgagaagcagtacaggtacttcaaaaataacaattagactcctcatttctgtaccccttctctcatcctgcttgtcttcctcctctgtttcctgtcttggttagtggctctactctccatccactaccaaagcaaaaaatgtaggcaacatcctagatctcttcctctgcgtcttcccatttaccaatcagttcagaagttctgacagtttaaattctcaaaattgtttgcaaatttggcccttcctcctcatcctcaccacccctgtccgactgtgggctctcagcctctgttaccaggactactttgcttcctctctcctctccctgccccctgatttcccctacctcctacccaggctatcctctatacagtctccagagtgaccattttaaggaaagaggaaatctgatctgattttgctcagctgcttaaaaatcccatccaggatgaagaccaaacttctttgcatagcattcaagaccattcacagtctgattcttgtccatctctttggcctcatttctcattgcttagactccgattctatcactttaccttctggtttttatttgttttgtttttttagagatggggtcttactatgttgtccaggctggagggcagtaatgcaatcatagctcactgcagcctggatctcctgggctcaagtgatcctcctgcctctgcttcccaagcagctgagactgcaggtacataccactgtgcccagctcattactttactttctgaataaacttatctgctgacaggtttgcccagccttccttgctttgtgtccaggctcatactatctattctacttgaaacctggcaaacttcgtgtgttcctttgcaagttagctcaagggtactacctcctctctggaggtgtctctgactttcctaggcagccaagggcatgtattccttaatgtgcctttctccttgtacttttattatactttattataatatgcagtaaccaccatttctagttgtctgtattttgccactaggtggcagtagtcacatcttttcgggagattaagataattaatattggatattgatttattttatttattaaagatgttgattaataattgttgtaattgaggtgctatgggaataaggatgcgggtaaaatccgtgaggcccctgaattttggcctgagtgactgggtgggatagagtatcattaactgagaagagggcgcagaaggaaggagcatgttttagagagtgtcttagtctttttggcctgctacaacaaaaatgctatcaactgagtagcttataaacaatataaatgtatttctcgcagttctggaggctgggaagtccagatcaaggtaccagaagattcagtgtctggtaagggcctgttcctcctagatggggtcttctcactgtgttctcacacgtggaaggggcaagcaggcttccttgggcatcttttataagggcactaatctcattcatgagggatccaccctcatgacctaatcagctcctaaaggctccaccgcttaataccatcacattgaccattaggtttcaacatgaatctgaggagaggaacataaacattcagaccatagcagcgaggaagatgattttacttgagtttgaggtgcttataggctatctaggttgagatgcccaggaagcattaggataaaatattctggagctgttcaggggaatctggactagacactgactttagtatcagtggttatagaactagtagatgaaaacattggaatgaatgagctggtccagggtaactatgtaggtagggataaaataggacttagagaaagccttggggaacatcaacttgcaaacagtagacagaagaagaagagtgtaaggagattgcaggaaagatcagtgatagaaggagaggctggttgtcctgaaaactaaggcagtagaaatttttcccaaagtggtattagccaagccatgttggatctaagaggtacagtaaaatcaggtcctcagagaagtgggaattacagggaagaagttaagggcattaaggaaggaggggttaagggtgttacagagccaagggagggtgtttctcctcctcctttctccccctccctttctctccttttcacctccttttccctttctctctgccccagggctgagcatgttcaaatgctaaactgaagcccagtagagccagggaacattgaaggtaccagagagaaaggggagtggatgaattacaagttgatgacaactgctgagaatgacaggggtttggtggtggattgagaagggtaatgacaagagaaataagtgctgtgggaaatggaagaaggagataagcctagactctctcaacactgtccaatagaattctctgtgatgatgaatatatcctatatctgttctattccacatggtagccactagctacatttggcttttgaacagttgaaatgtgcctggggggactgaagagttggatttctcattcgattttaaggttaattaatttgaattgaaattgattggttggttgattgattgattgattgattgatgagatggagtctcatcctgccgtccaggctggagtgcaatggcgagatcttggctcactgcaacctcgacctcccgggtttaagcgattctcctgccttagcctcctgagtagctggatctacaggcacatgccaccatgcttggctaatttttatatttttagtagagatggggtttcaccatgttggccaggctggtctcaaactcctgacctcaaatgatccacccacttcagcctcccaaagtgctgggattacaggtgagagcaactttgcctgacctgaattgaaatttaaatggccatatgtggttagtggctattggacaacatagctctagaaggttggtgactggcactgtggggccctcctgaaagaagaatccgtggatttttctggcactggtttgtacggttaccccatttggggttcagcagcctaagtggaggtgcaggacatctggctggagggatccgtccaatgttgaggctttgtaagtagggtcagtattgttgaaaatctagaaagtgagggatgtttgaggggttctggagagttttggtaatcctgcaacgcactgtattgctttcaggtttctgaccaaggacaggtcacccaaggagcaatagcagaatgggagacagagcagcactttattattagctgagcaggcatccagtatctttagtgctgggcgagagcttgcagctttgttctcaacatctaggtgagcttcccactctgtacctagagaatataatgtggctagatgtgtagcacaggcccccccatactttccaccctatcaaaggcattgagaagctagagaggaaagtgaagaggcctggctatgcagagagacaggttctgctgagatgtgcacgacgaaatacacatgctgcccattacaaagctagactacctggtttcaaatactggttctcctccttactagctgtgtgactttggccaagttcccttaccttctccaagcttcagttttctcatctgtaaaataaaaataataacagtacttcctcatgtggttgtaattagcattaaatgacttaatgtattaatatataaagtgcttataacagtccctgtcatgtaatggtggtatataagttgtttgctattattagtatggtttcagcttgccaatatactgtggccctgcctactaatctaataaaatgtggtttgagcagttttttaggttctcacctttagtaagccaccctttggggatgatctagtgaggggatagatagaagtgtggggagagggggatgaagagttctgcttcccaccagggagttgagagtgctggtgtcagagttcgaggccatggggtccaagctggtgtggaagaaaggctagaagagagctggggaacaaggaggaattctatggagggaggtaaggagcatcaagggatcacaggtcacgaggaggtctaggggcatgcgcatagtaggaataaggatatgaaagctgaactgtcgggaggttgtggtcagatgatcccagcagaggcggggcagttcaaagtgatgacagaaggcaggttgtggttagtgcggtggagtagacctgtagagttgaggaggttcaggaggccacgaggttagggtattggaagaggtgcctgcatggatgttaaaatcacccagaatgccatcaggaaaaggtataaaagaaggtggtaagctaagtgacactgatctgaggtgaattcaatgacctggaggccaacaacaggtgacagtgacaaagaggaggaactgaatcttgaaagagaacgagggaagagtaaacgtctagaagcaataatggagggctagaggaatcttcaacttcccttcccccacaaaaaattgctgcaggaatagaaggattaaaaaagaacagccttctcagagctgttagtggaagaaatcacaccctcagtggacagccagggttccttagggtgaggaggtgaaagggacattctggggaaaggtggcaggtatagacagattggttgatcataaacaccccaggccagtggtggtggtgggcttccagaggttctagtgggatgggttgggaggaagtcagccacaaggtggttggaggaaagtgcccacacagctttaggcccacagcttggtcctgcctacagctggtgacacaactcaggagttcccctctcttcatccttgtgatgtgtttcgattggttggttgtgtttgttttcatttcggcagcagttcttaacctggggttcacaaataggatcttaaggggttcattcacttgaatggggggaagtcacatctttattttcactgacctctagcagaaatgtagcacatgaacgcagacaacaagcaccagtggtattagccctacctgtgtctttgttgtcagtagcaatcacagatggcttcctatcacatttcagtagtagcggccatctcaggatagtgtttatgctcatctgctttgaaagtgatggtagttattaggcctgctgctagatcttgtgattaaatgtatttataaagaaacataattagtatattacaaaattttaaaaatattttggtaactgtgttttaatataattgaattcctttggcttttattttatgcatttcaaacactgttctgagaaggagtcctttggtctccccaggctgctggggtgcagggggtggggtggagggcctgcttcaagtctgctgggaaatccctttctatttcactagagggagctcttgtttcagaattgctgagcagtgaccctcaggcttgacacccagtaataaggttgtttttttgttttgttttgtttttttgttttgagacagagtcttgctccgtcacccaggctggaatgtagtggtgtgatcttggctcactgcaacctccacctcctgggttcaagggattctcatgcctcagcctcctgaatagctaggattacaggcatgcgtcaccatgcccagctaattgttgtaattttaggagaggtggggtttcactgtgttgccaaggctggccttgaatcccgaagtgctgggattacaggcgtgagccaccgtgcctgcctgagaaggctgttttgaaatacaggcaattcagatgtttttggaggacatttcaagaaactggggttaagaacctcagtgttgtttgttctaggcaggccacctctctcttgagtgggctttcagctcatcttctggaggatgaggattggacctcctgtgctagttactttctgggaccagttaaagcggaagtactttggccaatggcagctcaaaaactggccccaaggtcatgctgacatcagtatccaggctgagtttcctgtttctcctccataccattgagcccattgcccctcccatctagctagtgttaggatgttagagaagttcccctcttccatgaggcttccctgctccactatactggtcaggtaagggcaggtgaaagtataggaactctggtaaatcctgaggctcctaaagggttagtggatgaggggggacctgagggatttgactgattggcgaagggctgagccttgtgcaacaggtgggtaggtgagtttctgaagaccactggattgtccctgctgaggaagaagtgattggtgctcaggagtcctttgtgggagcaaatggttaagtcaagtgttttctgccttaattttctcaccttccaggagacactgctcctcacacctggccagactctgtccccttcactggcagcttttcccaggtctcttggttcatcttccagctccaggattccctctaagtcagtgtttctcctatatggttggaggacccaagcatcaggatcatcctgaagcgcttgttactacagtggagattccagggcccactcagacttcctggattcaactctatggggcagggcccaggaagctgcattttccacaacttccctaggacagttgttttcaaagtgtggtccctggaatagtagtatctgcctaaccagggaacctgttattaataaaaattctcagattccagattccaggcctcaccctagatctactagaaactctaatcagaaactctgaagtagggcccagcaagctggattttaagaagccctcctagagattctgattttgacccacactcaagtttgaaagccactgctgtagcggattctgatacagaacgagttgaaaccttgttgcctcagatgatccaagagttggctcccccttgcgtaaagctcagcagagacacagctaaggtcacacagcagcttggtaagagtaggtaagagtagaagctgggacctgggtccttggacttcagtgcatattctgctaggtcaggtccacctgttggattctttgccaattcagggccctcatcctgtgtactactgtcagggggctgcctctctgatcctcatggatgaaggtgggtctttaaattgccttagccacaggctgggtggccagtcagccccaactaggctcttccagggtgaagcatggcctgggtagactctccagcctcttaggatgggaggttgacaagatggaccttccctgtgaacacttaacccaggacatcctccacttccaagtacagtaaacagaatagaggataggtttttttggtcaaatgcctggatgaggggaaacctgacttgagcctacactcagtggctaagaatggggaatcaaatattcacgatcatcttggggttgtgccatgctgagatatcttttaggcagccacagcttacaaaggctaaaaatggaggtatctcatttaaagagtaccaaagatgggaatacattgttgtcaggaaccaaacttgtcattctcttccctatccccaaacctgtaccttctctgatgttccccatccttttcagtgataccatcacctatttgttatccaggccaaaaatctaaagccaatcattggtctatattcctatccctgcccccatccaatcagtgaccacatcctattaatttgaccttctgatcatttctcaaatttatttccactactccaactttagttcaggtcagatcatccctgacttcgtttattgcaacagccacctaactggtttcccagcctctagcctcaccctgttttgtcctcagggcacataggatgaggcctgagaattggccattggatttagcaatgaaaaagtcatttgtgaccttaatgggagctgttttgatggagggagggaagcctgataagagtgagtttaagagagaacagtaagagagaggaattctaggtagggagtataccagtgctgtccaataaaaacatgtgaggcacatatgtaatttcaaatgttccagtagtcgcattaaaagcaggtaagagaaacaggtgacattaattttaataatagatcttacttaacccagtatatccagtattttatcattccaatataatcaatataaaaattattaccaggatattttcctggatttcctttgaaatccagtgcacattttataataacagcacatctcaagttcaaactaaccacatttcaagtgcccaccagctgcatgtgactagtaactaccacattggacagcactggcatagacaattatttcaaggaatttagctataaaggggagcagaggagtgaggtagtggccagatggggaagtgaggtcaagtgttgacttgttggttttagaacgggagctattaaagtactttccgtttatacactaatggacttaatccagtagagaggaagaaattgttgacataagatgacgaaacagtgactggagtgatgctgttgagtaggggagaggggatggaatctggatgcaagtggaaatgctggccttggctaggacacagggcagttcatctgtggtgacagggagcaggggagtgaaggaagaccatactgggcactgatgcagatagatgggtaaatgtgattgtggaagcttatggaagtttttgtctgattctttttttcctctgtgaagtgggaagcaaggttaatatctgagagtgaaaatgggatagaagtattaaagattcgagaagagagaaaatattaatttgtggcctaggagcgtgacagagtgaatggactggggaaatacagtatgattgcctggcaacatgaaagatgcacttgaggtttgtgatcacgaatttgaagtgagaacagtcagcgctgttgtttttctctagtacattcagctgtgagggacaagcaaggcagaggaggagctttggattcaaccagggctgggttttttttccagctgagtatcattccataatgagaagaacaatggagtcaaaggcgtatgcaagggataattagaatcatgggccatggaatttaaggacagaaaagggagccatgagggacagtaaaaagatggtaggaccaatggatcacagattccagtggggtcaaagaagtattggggtcatggttatcgggagtgagctggaaaggtagaagtggtggttgaagtgggaatgcttgacttggagattagggaggggctacagatatacataattataaggtctcaggcacgaccatgataatgagtggctgagatgtggtagagagcagggtcattgagaacaagaggccgaggaactgacagaccaggatgctggaaggttcatctagatgcatgttgaaattaacaagaaatctgatgagtggtagtgagccaggtactaaaggaatgagggccatgacccatatgtctgtagatgactgtgaaagggaaggatagcgggtggtacagtatggtagtggtaggattttagtgagaagggagggccactcgtctaggactacaatgaaaagaaagaagttattcactctacctacatgggccaaaggagaaaaatcagtcactactttagagggccacagatgaagcaggcaaggagaggtaggttgggtaacaacaaaagggtgaagggaacattcagagaagagattgagaacataggaattgagctaatgatttatctgtgattgttgcctatcctgttcccttttcctggaatttccttccttaccttgtacacatagagaactcttcatctttcctcatccagctcttgcattgctactttcctgaaacggctattgcaaagattactaactagtgatcggcatgttgccaaacccagtggaagtgcttgcctttactgtacccctatagagaagtgtgttcccagtggaattttctgtggtgatgggaatactctatctctgcactgtccaatatggtggccaccaggcacatgtgactgctgagtatatgaaatgtggctgatgtgactgaggaaccaaagttttaattctgcttaattttaattcatttaaatgtaattagccacatgtggcaagtggctaccttatttattggttggtgcaagtaatagagcacttaacattattgatcctttccttcttgaaacttgatgttcttttgacttccagcacacctctctcctagctttacgattgcctctttaattttgtcttcattcttgacttctcatggatctttctccttctgctagccacttaactgttgctattttccaggcttcctccttcagccttttatcacattttgtggactctttctcattgatcttatccataccccaagtcctgtttccaggccatctccctctcctgagcactagacctggacataacagcctattggagacatctgctggtgtagtggataggcattcagtgctggcatgctccaacctgagctcatctcttctctaaattacctcctctcagttactgaagccatagacctggaagttagtctagatgtctccttcctgtctgacaaattgccaagtcctctatgccactgcagtaccatttgaacttgtcatcagtcttgtccctctccagtccattgtccacattgctgctagagcagtctaggtagctgaaacataaatttgacctttttattctccttgttaaaaccttttagtggcttctcattgtatataagataaaggccaagttcccagcatggcaaacaaggctcttcatgacccagcctcacctgcatgtttttccagcttcatctcctgacatgtgtcccttctcacaaagttctctcctttccagtaacgcagaactccttctaattgcacacaaacagcatgctgtttcatgtctccacagcttttctcaggctataacctctccttccttcaaggccctaccctaaccccttctggttctgcaaagctcacctcaactgtcatcttctccagctacttttcctcagtgtccctgttacttaatgcacttacctaactacaccattgcattattcacttgtaaacgcaggtagttcccaagagtggggaccaccatctttgcctccttctttccactgtctggcatggagtcttactcccaatgtggactctgtagatgttgagtgaatgggtaccatgaataagtgagtgagttgaaggaagcaggaagaagattagagagtgggatgtcacactgcccagtctcatctccttagtataagtccttcatgggtgggattataggatgagaaaaggggcccctgggaggcctgtggggatcagtcttggctgctgctggtgcaactgacttctttcccaggactcataaaacttgcttctggcagaaattgattttagaaaaagctattatctaggttttcccctacctttacagctgacatgcttctctcttcctgggatataagatgctagcaaaaaatgtcacattttttcttaaaggagaaaaaggttttgtatgtttaattttttgaaagtgcttaagtttctgttttcttttagaagaaaactggtttttcactgggattttcccaagggccacatgcaggtatacagaaaagagaatgatatgtgtttgcatacaatttgcatatatctgtgtagactggatcatctattctcagagtactttctttttttattttttcaaaaaaattgaatacttgatcaacttttcaatgaaaagaatcagtaacagtgaaaggcaatggaagccatagtggaagtcctccttcatagagaagatcacctctttagaagatgccccatcatcttctagtcttttataagattttggatggttgtggtcgccatgataaaaaatagcagcagccatctgcatgccaggatagctgtcgtatatacttttatctctctttttccactcaccagcccttagaggtagatgttaccctcagcccaccagcaggaaaacaggcttagaggggcagcacaatttgcccaaggtcactcctatgggtagtggcagagccatgattcaaacccaaggctacatggccccaaggcctttgtttttaaactactaagctgtattttctgccatttgtgtactgcctggtgttttgtcttttgtccttgccattaccagccatagacagatacatagtttggctgtcatttgaatggtagtggactctgttgcacaatgttgaggtaccatagtttatgtaactatctccccacttggtttgtttccagtttctcagtattatagatagtgcaggtgtaaatatctttgcgcaaattagggtggtttgttggagtttttaggtatttgatggtggtccgcaaagtagtatttttgaggcaaagagttataattttatgattctccagaaagtctataccattcattcacccaagcagtgattacttttggagtgcccactgtgtaccaggtgctggacgtgaagaggtaattcagaaacagcccctctctcagagaactaacagtctggtatgggatggatgatgcagcacagaatgaatgctactaaagtcggggtttgggcaaggggcagtgagagcactgagaaacagtgtcccctggtagtatctctgagtgttcctttccctctgcagcatggggcaagacgggaggagcatgataacagggctggctgcagagctgcctcctggctgaggacaccccccaccaacacccacgggctttcctgccaccgcctgttggctcagtcactgctgcccatctgccactagggggcgccgagcagagaggatggagggagggggcacccgggacaacaggactgggggctccagcagtgggaggagtggcagcctaagcccttgtctgtcctccaggcctcctcttcccctgtatgcccaccgcagccagggtgacaacacggtgcccagtccacactcattcagcagacaggaatgtgtgcatgccttaagggcatagctctgtgcattttcacgcaccaagcactgtgctagatgctaggaatgcagaagtggcctgacatggtccttgaccctgagatgcacttggtctagagggttggacagacaagggaagagacaatccaacttgtgtgctggaggccttcacaagtggcaacaggagcgttgagctccctagtgagtcccctggcagtgcgtgagagttcatttctccagtgctccgctcttatgactttggctgtgacattgcccatcttctagcctggaatttctccatctataaaatggagggaatgatatctatgtctgcaagggccttctgactcagatgtgccatgagcctaaagcaagcctgagcttcttccacagaagagcccccagccctggtccccactttagtcactgaagaaagtctcctttctcttctcgcccacatgctctccttacatggttttccttggcattctgcctctggccttttccttctctctttctacgtatgttcccatgacttcagttaccactgtgtgctgatgacacctacatctccatgctcgcccccatcctctccactgagtttgtgactcatataacaatgaaaataatcagcatttgctaaatcccagatacaatactgtaattacggtatattatctcatctcatctctccaacaacattgtgaattaggcagtgccaccccattttataggtgagtagaaccgagttcaagagatgctgagactttcccaaggccccaaagttgataagtgatggggccaggatttgcaaacctctacctgttgagctccactgcccatgctcttatccatcacactatatgtcctagagtacaggcagccgccaaagacccatttccacttggatattccacatacacctcaatttcatgtctaaacttggcctcatcatttcccttctgtcccaatctgccttttcctctcttctccatggcaataaatggcaccatcaacccagtgataccccagccagaacactgggagttttccaagatccttcctctcccttaccaacccccatctccccaacaatcttctccaatcttcttccacatcatggtgattttccccccactctcctccagcctcactgctgttgccttccaaggccattcatcctgttctctttttgggctcctgtagcaatcttcttaccagcctccctgcctcgactctgtctgcttgagtccatcccctgcacaccagccagggtgatcctttgcagacacacgtgatcacctcaccttactgcttcaaaacttctgctttctgtgactctacagcagagctcaaagctggccacccatgggctgaaatccattcagaagacatgttttgcttggtccaaaatgttcttaaaacattttgaattagtcgccaacattggaaaatcaggaaatttcacataaaagttcatatatattggcttctcttgcaaaagtgaaaagaactggtaactctgggtgcacatcccttcagggcaatgattggatggagctgagtggtggttgccctctttagaaggggtgtgggcttttcagtttgacagtctccagcatcccctagtgtctcttaggccctggtcgcacccctgcttccaattatctgcctgagagttggggcatttgagttcatgaccctggtgcatgggatgaagcccaaagccctcagcatggcttctagtgtcctatgtgtcgcagcctggagcagaccagccctgcgaacctctgaggctagtacctgctaactgccccgttacactctcccctgtggccccatggaacccttatccatagttctctgaattgccccactcttgtctgtctccatgcaagcttgtgctttggaattcctaggcccctccttaagtcctatttgtccttctgggctttgcaccagtacttgctgtaccaagaagcattccttgtgcccctggctgagttttgttttcccataacaggtggcgcagacctcagtcatcccaccagctaccctgtgttgtagttgttgactgtgagtctgcagttgcagggaacctgccttctttatcttcctgtcctcaaagctttgcacaggacttggaatacacaaggtgcctcataactgttgaatgaatggatgaatcagtgaaagactgatttgggaaaataatagtctaggatatgatgtcaaccctaattgcttggggtgggggttccaggtccctttcattcttcagcattccccactctgagttcccactcagagtgatacccacaacatcctataaaccatgcccccattctccaagatgtggaatatatccaggcctactgggatgatactttttagcaatgatagagggaaaatatatcatttttggtatccctgggggagagttggcacattcttcagttatttgaataataattaagataatgccagcatttaacactcactgagcacttacattgtaccagaccctgaactaagagctctcagtatattgtttcatttattccttcaacactaagaagtaggtagtactattgtccccattttacaggcaagtaaactgagatacaaggattttaaacaacttttcacatggcccgtaagcggtagagtcaagatttgaactcaaatctaacttcatagttaacattctcaaccactacaccatacttcctcaatgacatttctctttagaaacacgaggaaataaatgtgggaatgaagggtatacaattatgtgtacagtaagattgcaaatactaatttagaaaagaaagaaaagaaaatcctgaggcagagaaaatgaccaaagagacaaactcatgtgaaaattttctttaatgaatacataccacttttatgattaaaaaaagagtcctctctttgtagtgaccctagaaataagtggcaggacagagggcaggaaggggctgggttgagtacccagctaatcagtggggctgtctcttgagtagttgccagtgatcagtaaaaggaacagtcatcaggcagcagctgtgacctcagtacctgcaccctcatggtacaaaggtgaagtgggtcactattcctgccatctcaccatctcccctcttcctccaggtgcttacactccagagcccctcagcagtttccggtgggctcttctctcaactggcctcatgttcttttatcacttcagcgtcttgcagatcctcggcctggtaagtttggttatatccccttctatcccctctgtttgcagttctccataaatcttggtaatcctggttggtgctgacgtatcactttgttttgaaaatgcaagatgctaaaggccaggatgtcagattgttgtgtctggattgctgatttatgatctacagccttggcctctccaaagagttttctgagtctttcagtaatgactgtttctttcatccctggggaggcaaggatgcctttcactcatggccacttgggtcggaaacaatgagctgcaactggaaagtggtttgttgtggaccccatggggaggcaggaccctaaccctgccccttggcctgggggagtcttctgaccttgggtccatcctgggcccattcataggccctgaaggctgcactcttccctgagcttcatggccagtgaagtgtggtgttggggaaatcctgtggcattctggggtgtttagaacttcctggagtcatgaagaatggttggatggttggactcagtagctgagttatccagagcccaaaattgctgagtgtaagagtgtatatcagtggcaaaatgagtaggaagagctcaggactggggctgggggtcaggagacccaagttcaagtcctggctctgccactgctctgaatgagtcacctcacccttgagggcagagagttctccacctctctttgacatggtataaaagccccaacttccctgagaggtggtgaggacttgtctttaatgtgaacaggcttgaagggctttggaaggcaggtgccgcgaccgtccccggggcaggtgtcgcatgtctggttttgtgtgcaagtggcagtaatgtagcattagccatgtggagcctcgcgtgacctagcatgactagggcgtgtaactgatgtccccaacacctttgtagaagcagtcactttctcttcctcattctggtgtatggctctgctctggtttgctgggggcttagtctgagctccttgccaacagtgtgaatgcttcctgcgctctcaggaggaagccgtacaaagttcacacccttaccacttgctgctctccactgggacccagattccagaggcatcagtgtgctcatgtcaccctacataccatgctcaggcaacgcctcctacaaggagggcaaccctcaccccattcctcaccataaacccccatccatctttcatgagtccattcaggtaccacttctgtcatgaaatcttctctgaggactcagcccccatattgtatgctcctcagacctcctcatagtgtataaagctgggtgagccctgtctggtttggggtcagatgtagtaaacctttgaccacccccacttgattgattgcagttacgtggaggcagggcccacgctgtgggctgtacttttagcctgtaacacctctccggggtctaggcacatagtagatgctcaggaatggcaacaagttctgggcccaaacagaaggcaagaccgtgagcaaaactgaatagcttttccactagacggccctccgccatcacctccagaggcctctagcttgactcactcagaaaaccgaggggagagaagaaatccctttataaacaggtggggattggtcaatccctccttgtctagtcccccattaggtagagatggctgaactggcagaagccagagaaagcctaaggatggtgaacgctcactctacctcccttgtccctgcaggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatg

SEQ ID NO: 4917 - DNA, 92065 bp, human; identical to SEQ ID NO: 3618

SEQ ID NO: 4918 - DNA, 37277 bp, human; identical to SEQ ID NO: 3619

SEQ ID NO: 4919 - DNA, 121984 bp, human; identical to SEQ ID NO: 3630

SEQ ID NO: 4920 - DNA, 120520 bp, human; identical to SEQ ID NO: 3631

SEQ ID NO: 4921 - DNA, 122194 bp, human; identical to SEQ ID NO: 3632

SEQ ID NO: 4922 - DNA, 121909 bp, human; identical to SEQ ID NO: 3633

SEQ ID NO: 4923 - DNA, 119878 bp, human; identical to SEQ ID NO: 3634

SEQ ID NO: 4924 - DNA, 120035 bp, human; identical to SEQ ID NO: 3635

SEQ ID NO: 4925 - DNA, 119762 bp, human; identical to SEQ ID NO: 3636

SEQ ID NO: 4926 - DNA, 308461 bp, human
accccacatcacaaccacgacgggttgtccgcagctcgcagccaccccaaagggaggaataaagaacaggagcagagggaagccgggcgcagaaagaagggaaaaggaagagctcagggttggacatttttggagacaggggtggggaggataaagggagcgtgcctccttgattttcccctccccacccctctttgcttttctctccccttctctgtatagcatattccagaaacggcagcagaaggggacagaaacctctagtgtagaaaagggttttggaggggtagccagcgctcccgccagccgctacctaacagctggagcttgagtgtgcgtgtaagagtgtgaatgcggctctctctctttttttctctctctctcccctctctctccatcccttccttcctccctccttctccctctccttcacactacagtgtcagctacccctgtcagtttccccgtgtcagtttcttccctagctcttattgtgtgtgactggctgcgtgaagggagtgggtgcgcttgaaggggctcaggttgggttagagagctgggagaacagggtagggacattggtagagcaaagagtttcagggcactggcgaaggtgaaaggtgaggagggccgatctgttacaggcaagtttggcaataactgagcatccaaaggggaagccaaggtaggagccagtacttgcgctcgtctttacaccccgcccctttccctgtgctcatccgcccacccacccatcagcctagaggccccgggctgtcccagtcggctgctgtttcgcgccgcaaaagaggagtccggcaaggcgccgcaccacgcatcctggccggtggacatccagacgacacagattttatccgaaaaaaccacttggctcagggtaagtctacaggcggccggtgcggtccatttcactgcctgagtgctgctgaggggcaaggggcagcgaagtgcgggttgaatgaagatgctgggctgctgtaggcggagaagcattgactggctggctgtgggctcagggtggtagggagcagagggaggccagcaacagattgttttggaagaggaaatgcaatggggagaagctccagggttgataggacaaggtgctgcctgcgatgaccaaaaacatcctttcactgggaatattttcctgaaccacagctttgtcctatccctggacaatgatttgctccattcttgggtagattttaagatccgtggggaacctgctcccaggcctccttaaaatcgattagtgtggccctcggaccaaggatacctgcccttcgtcaaaagccaccttcagaaatagagagccaggagccggatcatgaaggttcaggaaccagggtccccatttaccttctttgtcttgtatccttcaaacttaagaaatggccagatttgtttgcctgtcttccttaaaggaaccaagaaatgcaaatggaggggcatcagtcagatctctgcttcaaagtggacacctccctccctccctagacacacatcgactcggacaaatggtcatgatcatgtcccacatatgcaggtactgagctgaattcacagatgctgatctttctccatggtctcttagaatgagactagaagggctttttccctattacaacctgggctctttggatcgcagtcatgtacctggtgatggttaagtgtttagcaaggttattactccctcaggaaaagcctgaagcggggaaaccagcctgaaagatagaacctctgaactttacccgagtttattataagagtaggagagacatagactaattgataatgctctttttagagattgtgcatgttaacccttggcttcaaatgtgaaatgattacaacattgacatggcacacccagacccacttttctattgccatatatttatcttcatggcatttaacaagaatgacagatttatatatcagcattcataattgtctattgttggtgtcataggttttttgatgttttattgatgatttatattatgtctcctttcccataaactctttaaaaactgagatataaatgatgtcacatggtacctttcatcatgtctttaaaatctgcttattctaaatcaaaaggcatgttaatatatttacatagtacgaagttcgtttcaaagcaaatatatagtctgggataaaagaaacccacagggtcaaggagtctctgaagctctctctgtgaggtcgaaggaagaattgaatgtcacctaaaatccacattttggtccctggaagatgctgttttcataaactttcacaatatacatagggagagagagaaaatctgtgtgtgtgtgtgtgtgtgtgtgtgtgtgtgtgtgtgtgtgtgtatgtagtttttcaaggacctcaatcaaccccatacaatcttggctctgcttttgtaacagaggggagcaggaggtgaatttgtgcttccaaagcacccaggttcgtctgttaaactttctatttattactatgttaccaaaatgcaatgaattgcctctttccaactcagcaaataagagaaacggattctgcattaagtgaaactgtttatgttgcatcaggcaattctttctaatgttcactgctgagagagagcagaatgaggattactcaagtaggatctgaaaaggtgcccattctgttactttttaaagcaaccatagtaagtattttcttaggttaaaattacactttcaaatagatatactaaagaccgggttgcagacaggtaggaaagaactggcagcatcataattggggaaaaactcaaaatatcagcacgaatgaagcctacagtgtaggttttgctctgttcttggtgatgtgagtatctggctgttgaggtaagtcctgatggttacccaggggataagcatgtgagcaggttcagggattcagaaccaatgtagcccccggcttcactgatactaattcacctggcttcagtgtacatctcaacatggagacctgaaccagatatctgccatccttcccagccacaagagctataatcctaagattctgttctttctatagctaacaactaaaaccggaatggcacgcagaaccacagtacttagagaagactaggccaggaaattagagatgcagaagggaggaagatgagaggaatatgagagaaccgaagatgttttgaaacaaacagaaagaaaactatccaggtgtttgctttgactgggaatggaattaatccagaaatcaactcatatgtgaagcatcttaaaattgcctgtatttgacttgcaaacactgtgtaaacaatgatagaattccatagtaccagggaattgggaaccttggagtacattctcagtgttgctgtctcatttctctccttacaatattaaattccaatctgcaagccattcaggtgcttagttattgaatggatatttcaaatgtgtcatgatgctttcctgtagcctgttttcgaatattctaatttattttttgccatggctccatcactgaaggtggtagattgaagcatttctgcctgctttacttctgccaaaggttcctgttttcaccttagtatactaagctgttcagatgcctcctgctaactgatgaagaatataaggcgcagaatctctctccccaaagtactctgtgccacaaggtgccactggcctaatctggcccagtcatttgccaggtttgcagggaaaggtatgacaaagtttgcagcctatagacagaaataaagcctcattctaggcagaagttattcctcatcccacagatgagggataagctaaggccagccatcatgtccagagcctagtagctgacatatccacagtgtcatcctttctaaaactcacgaagcttttcttctgttgatgggcccctcaaactttgtccagtgagaccagcagagccatactgccagcaaggaatgattcctgaatgactcaactgtggtcttataaacaaacatgtacatcatgctcaactgagtgagcacagatgatttaaagaaattataaaagctgataggggctaagaaaaattgcaatttgctgggtgaagggaactttgcaagtttcttaggtttggttttctgtcaccaattctggagttggcccttggatggtggtggccaatgcaattgccccaggtttttgccttagcaaaaggaaagaaaaaataacgataagaaacaagcggggatcttggaggggtcaatcctctcatttcacctatagagaaattgaagtctagagagtagaaatgacctgcctaaaacagactactagctaacaacagtggcaaaaccacaacccagtactgtttgctgatacgaaatacattttctgaagttctgtggagatcttcccaagaaatcgagaggtaactaaagtcaagtttaccaagatcacagccctctacttccattccatatgtatgtatacgtgtttatattatatgctgctgtcatatctttgtgacttaccttcttgaccaccacctccccctaacacacacacactcacacacacaatcctatcttgctagctaagaaaacattatatgtgtctatagctagcgtattcagatggaaggcagaattaaacatgacaaaaatttagctgctcacatttatgtgtctgatctggctcacaccaccaacagcaaggcatctagaaatcccagtctgttctgcaccatagtagttttggggaatggaagctagcagaatccagtgactatggctctggtttagtatactcagtctcagaatcagccccccaaatgcatgtgcaaatacacacacatgcacacacacacaaacatgcacatacagtcacactctttccgaaaaattaaaacaaagaaaatagaaaagataaggcaggtggtttttagagcagagtacaagaagaaggaaaggtttgcagacggatattcttaccttcccccattctttagccttattgcctaattttcattaatcccaccctaatttattttaggatctgagaaaatagagcaatgcaaacatgtttactacagcccagaaggatgatctgaaaaacctccacatttgagtgagaatatcacaaggatagggaaaaggctaggatgtagtgagctagagccttgctactccaagtgtagtccccacaccaggattgccaccatcccctgggagctatctataaatgtagaatctcaaatccttccccagaccgactgaataagaatctgcattttatgaagatccccagtgattcatttttatactaaaatttgagaagcaccgggctagagcttatccaaaaagcatctgaaagatatttgaaaataaacaattacctactgagcatgtagggacaattcatgtggcttatcaattaaaaaataaaatataaactttttccaggtccacttatcttattattcactgtaaaacccttcagtgtgggcaagagagttcatgtaaagggagtgagatcataggatttgtttatttaccaggacgacttgggtgtgggaactcacacagacctgagttcaaatcctggccctgctcacgaattactagctgtgtaaacatgcactttgcctctaagcctcacagtccccatctataaaatgggattaataatagtaccaactggcactgggctgtcatgaaaaattaaataagaccgtataatgcactgggatatggtgaacaatcaataaatagaagatataattcatacgatttggctaataattttagtttggtagaaaaccaaccactagatgtgatatattggggcacctagcattatttctaattgacgtgaatcttactgggttttctacagatagaatgctaagatatacaacagtaaaatatatttaaatatgatggaggccactagaaacaaatattttttcagaaggaattacaggtgtccctagtgaaatcactccatggaagaagactgaagtcagaagtggccctgttctatgaagcatatctcaaaatattaccaagttagaaagtcaaaagtgaggcattttctgcatgtttgcatatatatgcagcatgaaaacacacacatacatacacacacacggacgcatcatttgatggacaaattataaaataattcaaggccaaaatgacattctaggagcagaactaggtttctgcctgataaaatctttaaaatgcacaaataataacctctacttcgtaacttgctcatgttgcacagtttaatggcttaggtatatactatagctattactattttgtaggtgaaaaaaaaagagcaactcctacctcttcccagcccatggtgctacctacctgctcaattttctcaccagtaaaatatgatacacgtagtactcataaagtccaagaaatcaccaggcacttgattctataaagacttattgactggcatgtgcaatctgggcaacctgattgtaaagacacagagacagacactaccacctctggatcccagtcctttggtatgttccagacctccagcttcccctgattttcaatagtatcagattagtaaggtatcaataatcttataatagacaatatttatatctaattgctaagatttctgtgatcaccctaaataaacaatagcacgtgttatcaattattgactatctttatattagttttctattgctgccataacaaattctcacaaccttatcaatttaaaacaacacaaatttattatcgttatagttctgtagttctgaagtctgacacagggatcactgtgctaaaatcaaggtttcagcaggactgccttcccttctggaggctctagcagagaatctacttcctcacttactcagattgttggcctaattcacttccttgatgttacaaaactgaagtcctaatttctttggtggctatcattcctaacttctagagacaacccacattccttagtgcatggccccattcctctgacttcaaagccagcaagggcctgtttgatgagggggaactcagctggccaactcctgtctcttctccctttgcatctctctctggttgactgttctgccttcctcttctgctttgttttgtgcttacattgggcccactgacataatccaggattatctcctattttaaggtctgctaattagcaacttcaattatatctgaaaaatctttttcaccatgtaacatatcatattcacaggttctggggataagggtgttgacatatttacaggttggccatatcttgtctaccataatcttctgtgtgttgagtgctacaaatatggggttttaaatgacattcactacagtttctatatgataggtattattattattcccatttaacaggtgaggaaacaggatcagacaagttaactggtatgtttaacattgcgcagcttgtgagtggtggaggcagggttggaacacaggtcactcttcctccaaatcttgaattttccctgttggcctacattatgctgaacgtggcctgaaagtttgtaactcacataaaatatttaacctcaagaacgaacagaaaacgttatccttttgattgttgtcatctttacatagtggtcatcaccagaaatttttttagtagcttttagtctaatgataaagaccaaacaatgaagaaagattgacaggaatataaaatgtatatttgtttatacatctaggaaaaggctgatgaagtagtgatgggtaggtaaagaagattgtcgcaggatgtttgatgttgcaaaagagaggattttcacatttgttacggggcagttatgccaagaaagaggaaaatgagagggctagttggaaggatagaaacaagagagtgttaaggagtaattaaacagctcaatcctcaaagtggtaattgagcccctaatatcaatcacttggcgaatattcgctcagtgtgcaccaggtggaaggcactgttgggaatgcaaacaggcatgcccttccttttccctctaggaactttcgacatggtcagaagtgagtgggatgatgggagcaaacatgaagtgaaatcctggtgtggccaagtagggcatcatgctttaagccattcatggaaacaggcaggtacttccaggagatagagtggggaagttcagtctgtagaggcctttagatgttcaggctgtgctggatttaatttagtggatgaaaggaagatacgaaaggatttggagattttaaaaaaagaaataatgataacccatttgggaatgattattctggaaatggtgtgtaggaattccggattggtggaggagcaagcaatggcaggcataccagttaggaagcaattatagaaatttaggctttttgtccttgcgatagtttgctgagaatgatggtttccagcttcatccatgtcccaataaaaaatatatatatatatataataaaataaaaataaagatgataaacagaactttgctactcaaataaaaataactgatatggccttcaaaaaaaacaaaaggaaatttaggcatgaagagtagcactgtggttaggtacagaatctaggtccaaattcgtctacgtgtgattttaactgtgccactctgagccttagttttctcttctatgaaaagaaaaaactaaaagtacctgccttaaaagaatactgtgaagttgaaatgagttacatgtacaaagcacttagcccagtacctggccagagtaaacatgtgcacgttaactgttatactgttgttattgctgttgttactgtagtggtgcacttggaaaggatggggtataaaatacactgtaaagaaacaataatgttgaatggctgtgtgatgtgtgatgaaggtagtcagagatgactgcaagttttacctccttgctaggtaacagagaagtggtgccataagaaaatgtgaaggcgaggtgagataataaggcgaggaagataataagttggtaataagctttgatataagattaagcgcggagtcagtgtgagacattctagtgaaaatgaagcttggagtcagtgtgaggcttggagtcatttgaaaatgactaccagaaaattttagatgtgacactggagctcaagagaaagtttagggatgaaatgaaaatttagaaagtcacagatataacaatttttatctctgggctgggcatggtggctcacatctgtaatcccaccactttgggaggccaaggcagatggatcgcctgaggtcaggagttcgagaccagcctgaccaacatggtgaaaccccgtctctactaaaattacaaaaattagccgggcatggtggcacgtgcctgtagtctcagctactcaggaggctgaggcaggagaattgcttgaactcaggaggtggaggttacagtgagctgagatcatgccactgtactccagcctgggcaacagagtgagactccgtctctaaaaaacaaacaaacaaacaaacaaaaatttatctctaagaaatacatgtaaaatctccaagaaagaaagaagagagacaaaagcagatagttaaggtttaatctgtggcccatgattagtgggggcagaagagccacaggaagaatgattgaaggcaaaaagagacctgtgcaaggcactacagggaattcacaagaagaacacgccctgctcagtacaacttatagactcaggacagaaagcattataaagtatgaaatatataataatgacattcaattttaaaatataaattatcagtttcaaatataccttattttgttgactagaaaagacaggaagtcttcataagtattttagcccttgaatgatgagtgacatttggaaaaataacaaggagcacatttcagatgagaagaattatatgatcaaaggtgaagagttagaaatgggcacaccaagtttaagagagagagagagatcgatctgacaagagtgaaggaagataaggaaaggtaagagaggaaaaatgttcaaatcacccacatagctaaactcaagtcccaactcagtctcatcttagctttaaagttggaagtttcatgtcatttttttctgacataaaactcaactcccagctttctcagttaagtgattgagtggacagtgatgcttttaacaagaataaagtgatagaagaaaaatagcaggttagggtgaggtgataggagggtagaaaagggatgatgagttatgtttgggacatgttgaagtaaaggtgccagtgtgacatccaagcacagatgttaaacaagcagttagttaaatgggtttagaactcaaaatagaagtctgagctgtagatatagattagggagtcattatcccataataacaggacaataatagcagtgatgatgacaaatacttatgaagcatatactctatcaaaggcatggttctaagagttttccaaatagtaaatcatttaaccttcacaacaaccttatgaaggaaatgctgtttttatcctcatctaacaaaaggactaaaaccaaggctcagagaggtctcatgcccaaggtcacacaagtggtatctattggagacaagatccaaacccaggcaagtacagatccaaagttcgtgctcctcgttaccatactaagagtgagtgttagtagtcttagaagtagagtcacttactctagcagagcagagtaaaataggtcagctactgatccttgaaaataccaatatttcagaggtaagtcggagaaaagaatctttcagaagagaataacagcaatcatagagatagaaggaaaactaggagtgagtgatggccttaaagtcactgaggagagaatgcccaaaaaggggaatggatattagcagcattaagagctgcagccattggatttgacaattcaaggggctttgaacaatgcagtagttaggacaggggacagaaaaccacaagccatgggcaaaattgggcctaccatctgttttggtgtggcctcaagctaaaagtggtcttcacatttttaatgcctggaaaaaatcaaaagaaaatacatttcatgatgtaaaagttatatgaaactcaaatttcagtgtctatagatattattggaacactgtcattctgatacatttatgtattgtctatgacagctttcctactacaatggcagagcctggcaacagagagcatatggcacaaaaaccctaaaatcttctctatttagccctttacagaataagttagccagcccttaggttaaaggattagctgaaagtcaaactatctcagttcaaatcccaactctaccactgactacacaatgtgaccttgaaaaagtcaccaaatgctctaatgaccattgtcagtaaaatggagattaaaatggtatttatctcataggattctttttatttatttatttatttatttatttatttatttatttttgagacagggtctcaatctgccacccaggctggagtgcagtggtgtgatcatggctcacagcggccttgaccaccgcaggttcaggtgatcctcccacttccccgagtagctggaggtacaggtatgcgacaccatgcccggctaatattgtgggttttttgtttcgtttgtttgtttgtttttgttttattgtagagaggggggttacaccatgttgtccagactggtcttgaactcctgggctcaagtgatccacccaccctggcctcccaaagagtggagattacaggaatgagtcacttatcaagcccaacttcacaggatttttttgagaatcaaataagacaatttgtgtaaaggacctaacacagtgcctggtgcatagttagaacttaataaatgtcagctgctgttgacttttgatatggtagaaatgaagccaaatttcaataggtggcaaaaggaattggagatgatgtctatacaaatagaaactatacttttgaaaattttcacagtggatttgaggatggaggaggaagtaactttgggggggggcagttttcagttttagtggagagacttgaactcagggaaagggagaagtgaatgaagattgagaatctaggaggaaagaaaatgaaacaacaacctgatgaggtaggaagatcaagagtagagatcagagattaaccttagaaaggagcaggaataattcttcctcaagaaataaaatcgagttggatgcaaatataagattttacgtggggtgggggagattcatatctcaaagactctttcctctataaggttggagacaagcttttctgttatggggcatggataggggaacttgatggaacactggctatggaactttcagaaagaaattggcccaggagattccaaaggggaatatgtatgaaatggccctgtgggcttgatggagcttggaaaatcgaacttggcggcgtcaatctgcacaaccatgtgaattactctagaagtgctgaaaaacctgaaagaagaaatccagaaactagaggggtgagttaagtcatgacttttagttgtgttgaaatacttggaaaagttaatgccaccattggcaaacatttgaatcccataccagcctgtcattggaaccactgcctctgggaccctggtcttgtcaaaaggctctgcagcttgctcatctttatcctgcctggtgtcgtattatgtttgcacaatggcacagcctccccagacatttctggatttctttccctgaaatctcattgcaacgtaacagagacagacggtacattggaaagctctgaggaggaacataaactgtgacttttgtggagagagaatgatactgctgaaggatgggggctagtgctacagagtctgagtacctttcaggactccctgagcctagccataaaatccctattaatttgagagatgcaggacacaagctttatggtgtccaggataaatccaaataaaatgctacaatggctggtgtgctgggtttggctcccttgagactccaggggtaaagttacagggctaacaggccaactcctgtctgggcaaactaaaggcagagcagaagtcagggaaggagacgttgtctgaggaggctacagattcagagaacaaatgctttagctagaagttgagatggcaaggaagaaatggaacaagttttcctaaaaaggtgcccactgggccccctggaggcttgcagctcagctagaacttagccagggcagctctgaagattccattcagacttcctctagagagcatgcaccttctgctggggaaaacaggcctcccgtaggcatttccccatcttaccctgaccttttgtcctgggactcagacaagtatgcattccccttagaggcttccaggctcatctggaggtctgctaaaaggatatggagtgccagtttacattcagatagcacacacatgcccaaagcactttcccatccagcattttaagcagactagtatggtgtcaaaagcactatactgggagtcaagagtcctagccctgctacttactaggagtgtgaccttaagcaaaacactaagccactctgaacctcaacttttagcattcataaactaaggataatagtagtgttgtcctaatagagttgttgggaggattaaataatagtgcttagcatagagtctggctcataataagctctcattagctgccatcctcatcctcatcatcctcatttaacatataaagaacttgaagcatgtattaggcttgaagcctggctctgacacttatgagtcataagaccttgggcaagtcacatcacctctctgagcccatttctttcttctcagtttaaggtagacttggctgatcctacaagatactgtgtgtaaaaagtatacaatacttttcgaatactatagtattcatttcccttttcagagagcatcatctctttttaaagacagggaaaagtacctgagaggtaaaggcatttacccagtgaagcaacagaaaacctggaatgagaacccaaggccctctacttgcaacccagggctcttcctaattatattctctgaaagcagtttggtctggtactcagaatagagtgttccacatggtcccagcaatgcaggctgtgctgatgatgtgtgtgtttccctgatgctcaccagccagaaggcagcagtgctgactgggcccctcgcaggcagatgtcagaagccagaacctcaagctctttgtttgcccctgtagcaagtgactagcattcaaaaatagagagttctggccatcttcatacccaaaatactttcttctccccacaatcacccaaccttggtgtatgaatccctatcattcaagctttgtccttttaagcttcagcccttgttcaaaaggtgaactccctatgacatgcatacaatgcctgctaccaagaataagcaatcagagcaacagtatgaattaaattattcagtgctttttctctctggaagcaggaaagagggagatttcaagtgcaggacactgttcagtcttcctggatagctagaacaaactacagacagcaggaaagatattataaatggagagaggggcacataaagagtaggttgcaaaagcagcccatctctacccattttgaaagtgcaggagcaggacagacagaagagacattcctggaatggtgaaaagagcatccatttagaatgacaaggtcagacttccaatattatggcaaatttcctaacctgtctatgcctcagtttcttcacctgtaaaatggagtgatcatatcatctaccttaccagatagttctaagtgtaagaagaaagaaatgtgtgtgaacatgcttataaatcaatgcccagatctaagtgatcatcaaggattcggttaacttctcagaggaggctcgaggatgcagtgaccttgacagctaaatggccaggagagatgcacctggcgttcctcccatccccttcactgttaagtggagcatttaatgcacctgccatgcttcctctctgagtctgcctctcttctcatctctggcaaagtggaagcatttagtagctctccctggggccagcagtaggtttcaagggctctgatctgagagcagtggaggtgggcagttggcagagggcaaggctcttctgagactgaatgccttccctctggccagctgtagcctccagacagatacggaagtcctgccaccaacctagggtagcagagacaattaggatgacctctcagtgacaagactctggagtcattaaagcagtgacataattggcctgacaaagctgagacggcagacacacagtccagcaatatggcaaaatagttgtctcgaggaataaataaagcaatctataaataattactgaggctattagctatattttatcttctcccctatcctgcttcctgacactactggattcagaggccccacaggggtggcagtcagagtaagagaggtgacaagggaaggaatggctggggccaaggactccagctggctagaggctattggggaccctgcaaaatatctacctacaagttccagggaccccccaaagtcttctgtgatgaaagcaggcaggaatgggtgaagagtcacctctagtgaggaatggaagagagaaaggactgctaataggacagaaatacctaaggcccacttatcaggtcatgacttagccctagccactacagaggtgactgaccctgggcaaagctgaagctccggatatgtgtgggaagttagttgagagggtggtaagatgccgggctgtataattaccctgaaaggccattctcacgatttccttctctttgcttttattaaataaaccctgaactgaaagtgacagaaaggggaagatcatgtatgaacaagtaaaatcagaactggtaaggagaaaacaaggccagccacattatccctcaaactgagaaatttaagtttctttgtactctgccctaaattttatttaattcattttattaaacacttggcatattccagacactaagtgctttacaaatattgactctcataaccctcatcacagccctctgagataaagactataataattcccattttacagatgaggaaaacaagagacagggacattaggtaaattgcctgaaatagcataactaataaatggtgaaaccaggattcaaacacaggctagcccaattctggagaagagaccatgcttttcacctctatgatatgcttcctgacaacttacattcaaactctacacctaccatgttctgttgatatttgatatttattggtgggtatcccctaccagtctaagcattgatggtaggcaccatgaaggccagggccagacctttctggttcaccaccgtacaccgtattcccagggcctaacacaggggctgaatgattaaatgaattcattaatgaaatatagatttcatgagtattcaatgaaaacaaccaaatgccaaataaaataattgcaatagtttgagacaggagctattttcaatgtatgtgcagaactgtagatgattctgtgctataggaacacagaagcagaagggtttggttctgcctgaagaagtcagggaacgctgtacagaagggatgtaacataagagctgggacttgaaggagaagtaggtattcacaagcagagaacggccatcaggtggaggtattctaggccaagagaaaggcatgaggaaagtcagagctgtctggggacaggtagttggtgtggttggagtctaggatatgcacatggtagccagaggtacctttggagagctaggcaggaacctactggtcaattcaaacttgatcctacagccagagcagaaccatcagccaactttttttttttttctttttggaaatagagtcttgctctgtcatccaggctggaattcagtggtgccatctcagctcactgaaagctctgcctcccaggctgaagcaattcttgtgcctcagccttagcacaccaccactcccagctaattttttatattttttgtagagatgagttttcgccatgttggcctagctgctcttgaattcctgacctcaaacaatccacccgcctctgtctcccaaagtgctaggattacaggcgtgagccactgggcctggccccatcagcaaacttttaagtaggacaaagttatgacaatcaaatttgtgttatggaaatgtcataatactcaagggaaagatggaagagaccatgaagccaaggagaccagaaaacggaggtttgaaggcaatatcctaaatcgaggatagagattgttagaggctgtattgatagctcttggtgataggatgtggaagaataagggaaaaggaggattcaagaatgactcccagttttctggcctgggaaactggatagatggtgttgccaaaaatgaatacgaaatatgtgaggtaggttaagataagcgtgatgataaatttggtattgagtatgttgagtttaaggtatgtgtggagggattatataccagtggtgatgctcagtaggcagtttgacacatagatgttaaactcaggagagagatataagaaatcagatttgattcattgctgtgcaagatcagtcattgaaaccaagtgtgtgaatgtgtgaatgaaaataacctttttgttttttttttttttttgagacgtagtctcgctggtctcccaggctggagtacactgcagtggtgcgatcatggctcactgtaagctctgcctcccgggttcacgccattctcctgcctcagccccctgagtagctgggactacaggtgcccaccaccatgcctggctaattttttgtatttttagtagagacagggtttcaccgtgttagccaggatggtctcgatctcctgacctcgtgatccgcccgcctcagcctcccaaagtgctgggattacaggcgtgagccactgcacccggcctaatcttttcttttaaactcacacagatcatgatttgatccatcctatgatgaaaggaaactctgtaggtcttaggataaaagagagatgccttccctttcaaatactcattcctaaacttttcagtagagagattattcctgatacatttctagatgcttagggaaagtcagtcaatgattatggacaagccagaggcttggctcccattctgagaagttgagccaaagactccaggtacttacttcctttgcattttggaagccagctgtcagaggtgtatgaagctggcacaattggtagcagctctatggtctccacattgcaggagggaatatatctttcttccagttgccccctacacttgtcgactgactggctattgtggcccaaagcaaaggttggcaaataggctttccttttcagagaaaaagaaagaagaattttaaaaaagggcatttttgctaaaatgctcagtgaacttgggtgagtaatttatcctctccatggcttgagatataatgctatctacctgacagcaagaaagttgtgaggatcaaattaatcacggagtattaaaatgctttttaaaatacactacaagcaagatatattataatttcaagcaccaagatctctgggctctagtttccaatacttcattgttccaattaaaaatggtattttacttggccttcgtttactttcctatatatgacagaagtgaccatagacctttcatattttggattgtgcacatgtttggggggcaggatgtgtgctggcttgtagacaaatgcaatgatcataaatggctttagaataagtaagcacttggccggacgtggtggtgggcgcctgtagtcccaactgctcgggaggccaaggcaggaaaatggcgtgaacccgggaggcggaggttgcagtgagccgagatcgcgccactgcactccagcctgggcggcagagcgagactctgtctcaaaaaaaaccaaaaacaaacaaacaaacaaaagaataagtaagcacttaaaaatgctaagtaggtttttatatactacctgacattattcttttaatctttcacatctcttcctctgatatctctttttcttcaaagaattcatgcaagcatacactactgaacccagtcccctgtgaggaaaggggggaaaaatgtcttcctgtgccctgatctagaggcagaaagtgctcctttatttaaattaacaaaacaaaactaacatttttattagttgtctatggttgtataaaaaagcagcaaatcacagtccctgaaatgtctgcagttctcaaaagccaaaacaagcatgaagacatgagctaatatcaggcagacaggctatgccacacagaaaagtaaggaagaaaacatgccaatggataaaagttatttagcccctgaatggattgcctagaaaggtaatttggggcaggatccacggacttgaaatctgaatgaaatagcaagagagatgaatcaggaaacaatggaattgatctgtcatagtttgggttgacccctacaggccagagttcaaacaaaccagtctagaatctctaggtcccttcaaacctcagagtctcaggttataattatatgaaatgcactgagactaatatttttgcaaaccagcctaagacatcattaaacaacttctaagcagaaataaaagacatctgtggtaatgccaccactattcctcagtctcatgggctagaagttgaagtcatcctaccttccaccgctcctttgccccatatatataattaagtcactaagcactcttcttttgaattctgcattttgttattgcctatcttactgcattttccactgctattaccctacttactgcccttatccgcaagctaagcctccgagctggtccaactgcctactgtctctccctgtcaatccattctgcacatagtcactagattcatcctcccttgacattacccttctaccttcagtagttcccccactacctataggataaagttcaaacccttttcccatggaccttaggccttccattatctggcaccaacaacgttttgagtatgatctttctctataaatcctctgctctagaaaaactatttgcagtgtctcccaacacaacctctgcttcctctgcatttacctataccagtattgtagcaagaatatagctcccattctaaactgcctctcaaaatattatctatcctttgagatccagctcaaattctaccttacccaataaatatatgttgcatgtctagtatgcaccaggcattttaaagccttgctagctttcccagtcttttattgctccctcctctgagtctattgagcagtgtctaagtatcacaattggcccttcgtagtgattctcttatataattattagccatttttttgtcttaatgttttttgtacccaagtacactgtaagcttcttgagagcaggatcttggttctgtatttctttcttccctcaccccttactctacaccctgaaagtaacatattgctttgcattttgtaggaaggaaatgtattttaattatttttataacagcatatttccagtcagaaatcctgttgacctgagagagttactacatcagcatcaaaacagcctaaatgaagcagagtaaaagtaaaaccagttggctctcttggagccaatacaattaaattctaagtctagaaggaaaacacatctgttctagtaaaatggaatagcctggagatataaagaatccctataacatataggaggaagaaaaagatgactatagctcataaaagaaaatcaaaccattatatcattgaaataaactgctcctggttttagacaggagaactaattcaaaactttcaatgacttccagttataagttcactttacggttccttgcagattgaaaattagtgtaaagaaggagcaaagaggtagccagcaccagaagaacctgcttctggactttttcttttattccctttccctccttctcccactattttctccctgctacatctccaactaccactagaccccctacacacacacatacagacgtttttaatagtcatgtgtgtgtgtaaacaagtgtattagctgcctttgtaaagactgctcttctctgtctccttggaggattccagttaaggagggaccacagccctaaccccaaatcaaatgccagagactctcagagtcttcctgacctgctctgccttcacagctcctcctcttcttttgcttcaactctgtttcaggccccaccctcatctcagatctgaagactaatatggtcctcagttttccccctcagtattcctcctcagacatggcttttcattctcccttagtttcaactcacgcttggcctcccaatgaaacaagcctgtttttatatccaaggaccatctccaaggatacccccaggacttgtacaccacagggaatctgacagggctgaatgctgatgttcagtaggagatgaagataccctctctcaactcttgtctcttttgccaccctttctgtagccttcaacacagatttgatcaaaatggatcttggccatacagtaaacagagcttgatacagtccaagaaactctgtgtatgtttaattaataaacagttgttgaacagcttcaatagcctataagctgaatcagagataaatcaggacacagtcaacccaggaagtgttatccccaacattggaaagaagtttctaaggaggaaacagaaaattaaggtccaggaaatggccagttgttggagggtccagacgaaagccaaggctgagccaggaggcattttcatctaagagtccacaaaattagaaaaccaagaaagagaggttttattttccccatttcacagaggaactgtagaggcgtgagttcaaagagaaagcatattgcagctaacaaagcaacccttttgggggaagcctttccaactaggttctgttgatggttttcagtcatatattattttggtggggggaggatattcatgcaaacaacaaactgcagttagcaacatatcatattgcacaaagtgatttacaataagaacttcgcttgggaagtgatgataggttcatgtgcacccccagtggagaaacactgagttaaatcagagggatcaatccaaccaaacacaggaaccaggaaaccccaatgtttttgacaaagaacctcagataacctcagaaaagattctttatttcaaatctggtcatatttaagtaatttattatgctaaatatattacatgaataggagcagcctcatgttcattaatattggaaaacattacatcttagatccttcaaaagaatattactattactcacaacctcactttattttgtgagggaaatatcttttatttactcttgttttaagttctgaatagatgcaggttgccctgggtggtcacctctccctgaattggtatataattttgtcattctcaggtagtttggcaggagttgcaaatgtaaatatcctcaggtgtcaggcagtaacataaaactgtgaaactatggggtaggagataactgggagtagtaaaaactgtggtgatcagcagagggcatgcccaaccaagaatttaaattcaaaactttttaaggccacatgctggtcaaacatatgtttctaagttttggactcaacctctggcacctagttttctatctctggttaaaactcaaaggaaagagggatgggcttgataagtcctcagtgtctttcagctggaatatttgtttattttgcattaaatgttgcaaatcaatcagaaacccctttactggacagattctaagtggaattcagtacaaatccattttctcataccttaatatcacttcccttattctattcttcagaataaaaaaaattgcatggttttcctttgactgaaacatcttcataaaatttcctttatttaccatcaacattggtccctaactgctctctgtgagagctactctggcattttggagactatagagctgatgccctaacttggtcctattctgagaaacacataggtgaaaatttggaaacaaacactttagcctgagtttatgatggtagggatagatgtggagatttggggttatcagaaaacccccgacttggtgttggcctctcctttctacaccttcctaaccttccatcccttaaactccagggtgatataactcagaagctccagaaaacaaccttgtccactgagtgcatacccttaaccaggctctttgaatgggttttacgtcaagaatctgaacagttctagaaatggaactgcgtcatgtggcagagactgtagcaaccaaaataacagtaggcaaggagaagctctgctgcccatgcagctgcagagatgcttcagatgtacagtttcttgtagagcagagattattccatgtgttgtgcatagaatagcaccaaacacatttcattaatgctgaataaccacccagagaggcagaatgggcttcattagatggtaaaatccaggagtggcaatgcaagatgtgggtggtgaattggggttctcatttcaccatatttggggctcctcagaaactagtgaagctagttaagatttaacattgttaaatcagaattcaatgtcactttttgagaatggaattaacatgatggagagagtttgataaagagtatcttggtaatcctacctgttgtgtttgagagacaggaagcctagtggttaaacccagaggctctcgagccagtctgtctgggttcttctaattccaactctaaggtcatctgtgaggccttgggcaatttgcttaacttttctgtacttagttccttcatctgtaagatgaagatcataagatccaccctatagtattgttgtggggcttaaatatgaagcacatagaacagtgcctattatgtaatgagtactcaaaaagattattaaaatgctttcctcttaaaagcttttaagaataagaataaagttgatgctcactgtttaaagatttgaagaaatcttaagcaagtcacatcgcttttctgagtcttagtatcctctgtaaaatgggatgatgagagtatatggcaagatgtttcaagcatttttttggtagtacaaccttttattcaagattaattgatgcttctttttatttaaatcttggtataagggaataatatcctacatatgccttagatacttttagtccacaagactgagagtgacgctttcctctgctatttcttggtttcttaaccctatgacaccagaggcatggaatgcccccagcttatctgctcacaccagctgttaggggacagtagagattttcctttagagtgaaagctgcaacaagcatctgagaataatttgttatttatcaagtgtttccttttgttcaccatcaaacctgacactggtcattggaatcacacaaaccagctggtgagtaaaaacactgagtttagttttggcttgcttctcatcctggcctgttatactgaatgtcagggtaagtctgctctgaagcctaggtgacgagctccaagttaggagagaaaactctaatattattctttcttcactgggtaggggctctggagaaatcactttacctttgtaagtctgaagaaaacagagtttgcaatcactgtccctccttctctcacaaagacactacacagagagcagaaacaagaatagacccagggctagagaaagggcaagcaagaacaggcataggtggtggtctctctccattaccatcttttgaataaaatgtttctccaacagtggaccactagccccctgaaatgaagccatcttgggtgcttgctaaaatattagattcctaggcctcacccaaacccactggatctgaatctgtggtagtggggaccagaaatttgaattttaataagctcctttaaggattcatttatccactaagaaacttgcttaagaaccactggtctagtcaatcaccagctctttgaatccatctggaaacgatgatcatctatttgagatctcagttatggacaagttagttatgcacagaaaataagtgttaattgtagctggagatgattgaatggggtaaaagggaagattttctggcagtgtgattagacacataggaacgtggaatcaataaaagctgtagaaactcagcacacatttctgttttgaaaataagatgactaagtttggtaattcagggaaaagcttgcactatatgaagcttgaactacctgaagggaggttcatatttctgtctccaggaataataataaaaaaagtgtaagcaaaaacatccctttaattgtgctgtatacatttcttgagtcccttgaagccaaacaaacttattttaccactaaggaaactgaggtttaaagagaaagtcatttttcccgggtcacatagctagttgattggttacaaatctttattaaatcagtcattgatgggaagacaaaacttacttgatttgcctatctgcccacatttcccttccctcccccaattttgagaagaaaacactgtttctcccactatatttttgccttgcaattaggctttaatgcttgtcagctgaagcagaaactcttctgagcatttaggcagagcgtctaaaggagatctaatgaccctcgtgactgaaagtgaaaagattcaaaaaccagtgtttacagatcttcagctgctctgatcaagccttaaaattgctgaagccagacctttggttgcacagctatctacaggagcagccaaggaagaaaatgttttctgaataatttacaagatatatgagtaaatgtgatattcaattaagcatgtagtcataggaaggaaaatcaaacaattgaaattgccactcaatggttggctgtaaatgctgcctatgccgctaccccactttagagatgcctgctagacactggcaagaagaagacagtgcagttaatggtaaaaatggcccctctctaaaaacagagttagagtgaacatatgccttcaaccctcttaggaaaatgagccaaaaccagccagtaaaatgtagctgcacaggctgcctggcagagaattttcatacattgctaagcagcaaaatgcatagaacatacggtgctatggctggaaaggaccttccagatcatctaattcaactcctttcattttataactgaagaaactgaggcttcagagagggaaagtgattatctcagtatcacacagctggataattggttctaaatattccctaaatcgaactccttggtgtggaagcatgtttgatttagtgagatgtcagaattacagaccactttttaaaatgcatttcttttaagaattctacgaagtttatagagtaaataagtaaacatgtatcccagtaattcacaaccttggcttgttatcagaatcacacggggagacttttaaggtagctctattaagcattctcatgcagggccactgtatacaattgtgcaggccacgcactgcatgagagtgtccactgatggaggtgaatgggggcccaacttgagccactgcacagacttaccaagctatgcaccctgatttagggctgcacctgctcaaaggaagatgtgcctttctctactttgtgaaaagggtcaatatggattagtagcagcactatattcttggctccccacctcacaggtatcactgcaacttcctacttcaccctatcttgatgctccaatatactttgaatcctctcccactcctgaaataggctcaattggtggttgcctcttgtgtatctctggacagaaaaagccctttcaatgtgtggtacaatttctccctcccccttactacaactgtgcagttgtttaatgcaatgactttcaagttttcttgatttctaactcaattactaaaaaaaccctcccaatatatgtacaaatatatatatataaattatataaatgtaataatgtatatcatgtataaacatatatttataactaaacatatgctactgtactagaaacacacaaaattcctttaacacaggcaaaaaggaaaatttaaagtatgtaataaggatgaaattaaccatatttaaaaataatatataataaatatattatagtctgaaaatctttttggctttcactaaaaaattaacattaaactaatgtctttagagagagaaatgttctttaataagcttcatttgttataaaaaacttcaatctttcataatgcagtaatctgaagtcctgattctaaattcagcaatttcaattcttggaattaatggctgtcagccaccccccaccgccaaaaaaaaagatacctcacaaagacttgcagcaaatctgtttcgcctacttcttatcagtttattaattggaattgtgctgttttgacttggtaatgtggctaacaaagagctcatcctatgagtagaaccttctagaagcagaatggcattagctctgccatttccttattattttcttgtgcttacactaagtttctcctcaatccctgatttacttgcatgaaaaattgcaaactacttgctcatttgtgaggattaggttaattaaaactagacagtataatatgtaatttcacataagcaggcacacacaaactgcaatatattttaatatgaggagagtaaatgaaggcatgaggataatttcatcaacccctccttattctggaatttccatgcttcccttaggatccttcccatattgttcatgacatgtgactggcttagttcctccaattcccctctgaactcgagtcctcaagtttcctcatatcctgtcctatggtaactacaggagacattacagcagttaggaggaaaacatgaaccagggaggacttctcagtggaggctatatctaagctgaacgctgaataatggggaggattttcaaggagatggagagagagggcttctcaagaggaggtgacagtatgagaaatgtcataaatagcagagtggttatgttctataggctttaaagacaggtagacttttgggttcagatctctagttctggctgtggtcttcacctctctcacatgtcactattcaatctctatacccacctctctcacgcccaccccatgaatcagaattttggaacatggcaccagagtatctgtattttttagggcagttttgagaactgccatgtataccatgttcataactatagttatgtagtatgtttacccacatcttgaccctctctcttgcagtattgtagagtggctccctattacctattgagttacatcctctgtccagcctccagcaccctaactgcaaccacctcatcttggtgtgctaccatgtttccttgggcccttcaaccacaacacattccctccttttagtattctttaacatatgataatcccctactttgacaattcatccccttccactaccaatccacatcactcccttcaaggctctgctcagaacacattgccccaaagaggtactctccatattcctctgctccaccttgcctactttctaatcccacatcacctcaaagtgttataacatctttgtaccacaatcaagcctcacctattttagatgaattgagcattccaatggatgaagaaaaagatcacatttgaagaatatggaatgtatcttttaaatacatatatccacccataccactgactcataaagtattaccaaatagtagcctagtcatgtctgctttattcagatttggtaaagctataatttgtacaactttagatacatgtaaatcaggtacatgtgagctaattcaatatatgtgacctaataggttacttaaaaactgttttatgatgttaagcacactcctatatgggaaggctggaacctggttccatgtctatctccctgctgtctcctttcttcaacctcagggaaagcatgcacttgcagtgctcatcatttttttccacttagttaataacaccaagaaattattttatacacacacacaaacacacatgctttcttcctcccccttcctatatctccattcaagccatcccttacaccaccaggccatctattacaccaccagcaaaatctcttcaccactcacctgtacagccccaactagtcattcctcttagctctcaataatggggtaaaaaatgtgcttttgagacactaatattagtactggtgccattaacctattaagccctttcaatgtaagggaacagcatttattaacactaactacagaccaagttctgtgatagatgctaagcatacagaacttcagttagtcctcactacaacaccgaaacataggcaccactgtcaccattttataaatgaaactgaaactcaaaatatcgaagtcacatagctagacagtagcaaactcttcatttctacaagaaaatgcatgccaggttccccaaaccaatttaaatatcacattctggaatttgaaccatttaaggatttgtatacccacgagtaaactcctttgaaaaatgtgtccatttaatacttccagttagactgctttctccttgagtacactaatgttgtcattaaccaacaggttttcttcataatgtcaaatatttccatctgatttatcccctgactcattgctaccccacccctcagcttcatacttcagtgggtgaggggagtcacttctataccacaaaaattatttagaacttttcataaaagttttcctggcacacaaaggcagacatatatgccaatggaatagaatagagtacccagaatcacttatatggccaaatgatttttgacaagagtgccaagaccattcaatggggaaataacagtcttttcaacaaatagagttgagaaaagtggatatcaatatgcaaaagaatgaagttggacccttaccttacaccaagtacaaaaattaactctaaataaatcaaagacctaaatataagagttaaaagcacagacctccggggggaagcttcatgatattgatttgaaaatggtttcttggatatgacaccaaaagcacaggcaatcaaaagtaaaaacagagaaattatactacatcaaaatttaaaacatctgtgcatcaaaggactcaacagagtgaaaaggcaacctatagaatgagtgaaaaatatttgtaaatatcatatctgataagatgttaatatccaaaatatataaagaactcctacaactcaacaacaaaatattccccaaaaaaatcaattttaaaaaatggacaaaggactcaaatatatatttctctaaagatatacaaatggccagtaagcacatgaaaagatgaacaacatccctaatcattaggaaaatacaaataaaacccataatgagataccacatcatactcattaagaaggctaatttaaaaaaaaacagtaaataaagagtattggtgggaattggaaatattggatcccttatgtgctgttgatgggaacgtaaagtggtgcagccactatggaaaacagtatggtggttcctcaaaagattaaaaatagaattaccagagaatccagcagttttgcttctgagtatgcacccaaaataattcaaagcagggtctcaaagagatatttgttcatccatgtttatagcagcattattcacaatagccaaaaggtagaagcagctcaagcacttgttgacggatgtgtggaaaacaaaatgtgacatatacatacaatggagtattattcagcctaaaaaaaggaaggaaattctgacacacactgcaatgaggatgaaccttgatgacacattctaagtgaaataagccgctcggaaaaagccaacttctgtgtgaatcaatttataaaaagtacccagtgttgccaaattcatagagacagaaagtagagtggtggttgtcaaaaactaggggtggggaaatgggaggttgtttaatgggtgtagtttcagttttgcaagatgaaaatagttctagagactgattgcacaaccatgtgaaatgtacttaacactactggactgtgtacttaaaactggttaagatggtaaattttatgtgatgtgtactttatcacaatttaaaaaatagttttctggcaaagctggcttcaagatcagttggagcaatgcagaagacattttttttttctcatgagcattaggcttttgtgttcactttcatcaacttttgaacagatgaacattgccctggaaaacacctctaatttctgctctcacttattgaggcagacagtggatggggaaagcagtggatcttgagaagatacaccgttattaggcagggtttcagcagaaaacagaattcaccccagacagtcaaataaattgtaataaagggaatggaccaagggctgtggtaatgcctctgtggtgaggcacccacatactagcagcagtaggtatccactgtcagccccagaggtggaggaacaagagaaggaaatagtaggaaatgaaacctcgaaggagttacctggcagaagcagaagtcctggcaccaaggaaacagcatcaatgcagacaagaaatatcctgacctctatctcttcccacccttcagtcttctggagaaaactcccattggctgaaccagccagcaaagaacccaggttatacattctgctgcagttagtttctcaaagcacagagcagggcagagaaggacaaagagtagatatcgggtatacacgttgggggtgacaaacagaataagtggcacacttggattatagtcttaggcctgttgctaaccatgggaacttagagaagtcagttaacgtattttgatttttggcccacttagaaatttgctcatagtaacccttgtcttgcccagctgatgggctctgtgagtctcaaataaaataatggatgacagactcctttctacccaacaaagtgctattaaacatagaaaaataatgttttttccactctttcctcggtccttctctcctctacctgagaaggtcaggaaacaacatagcagagtaggaaaaactaaactggcaggtgggagacctgtgatgtcaagcaagtaagtgacttttgcactctgagcctcagttttcacatctataaatatctgaactacatgttaatattaatgccctttctgactccaatgattttcttactgaagagtaggttagcaagatgtgcacaagaccatgcacatgtgcgcacacacagtcctttttcttctgcctcaagtcacacacacatttacacaaacctatatgtttggctttcatcaaaccaatactgctataaatgagagcaggaaccagggcattaattactactttgtctttcatgtcataccatgtgagagccctttcctgggataatcgcctaaggcagtgttgcccaacatgggttccttcagtatgttaacaagtgttacaagaggaaaaagtcaattcagtatcgaaaatgctgggataacaaagcagcacttctcacagcctttgtttgtttgtttgtttgtttgtttttgttgttgtttttgagatggagttttgctctggtcaccaaggcaatggtacaatctcggctcactgaaacctccgcctaccgggttcaagcaattcttctgcctcagcctcctgagtagctgggattacaggcacgcaccaccacgcccagctaatttttgtatttttagtagagatggggtttccccatgttggccaggctggtctcaaactcctgacctcaggtgatccgcctgcctcagcctcccaaagtgctggcattacaggcgtgagccaccacgcccagcctagcctttaatattctaatgtacattgtgcatctctgagagggtagtaaagtaaatggtgggattttttatttgccaaacttatttgactgtagaatcctcccaccaccctacccacagcacctcaaattctttggaatgatatgaattgttggaccaaatcctatgttcagacagcctttctgtacattcatgcttaggcccaaaatacattttgttctatttatacattaagaatatatttttattttaagtctcagctactcagaaggctgaggtgggaggatcacttgagcccaggagtttgagcccagcctgggcaacatagcgagatcctgtctcttcaaaatatatatatatattaaatatataaatatatatttatgtattatctattaattactatataattaattacatattttgtatagtatatatatgtgtgtgtgtgtgtgtgtgtgtatatatatgcgtgtgtgtatatagtagcctgtaatacatgctttgtctctcagttcctgccttggtgccccatgcagttggtggtgcttccagatgaatatggagggcagggcagcataagaaggcatcattccttacccaaatcaggaataggcattccagaatgtctttaagataaggcagtctcttggtatttggcattgtttaggcaagatgaaaagttgctgtcataataacaattcacaaaggaagagcagtttacagttgcagagagctttcacataaaccatctcatttctaaaaactgaggtcagtaggatcatcttcattttacatatgaaaaacagcaagattatttatctcttgcaaggttactcagcagagccaggactcaatagcaggtctagaacttctgtttccagtgcttcttttaatgaaccaagatggaaggcagaaaggctcccttagctttctaatgacccaaactcattggccacacagtgctgagcattctgctgttggagaggcgggatgaggttgccctcttgcttccagggagggagggacaaagagtatttttttaaagctttccttttattgtttgtttttctaatctcatgagttaaccatgctcattacagaaaggtcagaaactacaaataagcaaacaggagaaaaaattaaaataccaataaacacctaccaattcagacacaactactgttgacaccttggtgttccagacacttttctatgcatgttagagtctatgatacgttttctttcatattctagtgtttctggaattgggctgtatcttctaattgatgttcatagctgatgtggtaatccttccctccctcacaaatatggttagggttatcatactgatgatgtgtcttaaaactgtggcatctcagggtccatgagggatcttatatttttcccccaaattatgtcagattgctgttttgaaacatgcttttatcactcatcactctcccctcctttttttttttttttttttttttttgatacggagtcttgctctgtcgccaggctgaagtgcactggcgcgatcgcggctcactgcaacctctgcctcccaggttcaagcgattctcctgcctcagcctcccaagtagctagaactacaggcacacgccacgacgcccagctaatttttgtattcccctcccttttatttcttggcatgatgccatgtcagtagatatttttctaccaaaagtatatttagtgaatgcaaaaccactccactgattggttgcactgtattttttttaaccaaacacctattgctgagcatttaaatcatttacaacttttcccaactacaaacagcattggcgacagatattcactgaagaattgaggttatactaggtgccagacataatactgggtgctagagatagagaaatgaacaaaatagatgtggactcaaccctccagaagttgatagtctagtagaaacagcgggcattaaacaagtgaacactttcatgtatatttgtagagatttattaaatatcaaacactgtgaaagataagaacagtctttctttagattagacaatcaggaaagggctctctaaggaaggagtaattaagctgagatctgaaggatgagaaagaaatagccagtgaagggaaggctgcaccaaactagactcccacaagtacagcaggaaatgcccactctcttgctgatatggaataaatagtctcctttttctttaccattctgctggaggatgaaaggattctcattattttttaattagcattttacaaattatttctaaggttgaacatgtgttcttacttcatgtcgttttgtctccctagaagagcttatcaataacactgtattcactgctgtgacgaggtcatatctactatacaccacagcataaagctagggcaatggctgttgaagtgtgctccctctggaacctccagagtatatcagcatcacttgggaacttgttagaaatgcatattctcagggcctacctcagaccaactgaatcagaaattctgggggtgaggcctaacaatctgtcctaacaaatcctccacatgattctgatatattataaagcctgaaaaccactttcaagaaaatattcaatggatatttgtggatggatgcagttccaacatcctaggatcctaggatgctcctccaaatacataaatcagagaatatagacctcaattgaagcacaaaacagagttttgtgctgaaaagtttgtgctgagagttcattcatttatccagcaaatatttttgagcatctactatgcttaagaactttgctacatactgaagatttaataaggaaataagacaagagtccctgccctcacaaagctaatcgtctagtggagcgattccttctcaaagtgggatggacggccaaggaaagttctagcatgcactgtttttgaactcttgaaaagcaaggaaaatggaacaatggtaatataaacacattgtggtcaggataagtgagacaaaagtgaaaagagagaagcggacagagatggtctgtccatcttggtcctgctgagtctcctctacaaactgctccagaacagaggtagattccagatgggagaaatgccaaggtcctacacagttattattattcacatatttctctaaattgtatgcatcatttcccttttctaggcagcatagtctcagcttccttagattcctgaagtgtgccccaaggatttgtagctctatgttaatgtgatacataaaatagagtcaccttgacttcacatttatctggcttatgtaagctctaaccttttactgcagtgcaacagaaatgccagacccattttgtataggcacataaacaaatactctgattctaaataatatattggggaccctggtgactatgagagcatgacagcctacagggagttaggaattaagctactgatccaagctctggtgtggagggaggcaccaggctctggctccacttcttttcccaagaaaactgctcattgcagtaaagtctttggaaagagcttcagaatttttccttccactggctataaatcaaggaagctatctagagaaggggtctgatgagatcactcacccaccaagtccaatagccttgaacaagctctttataatcctttcttctaatctaaaagaaataaagcaaaaaaaaaaaaaaaaaaggtgggggtggcggtagacggggctagttatgaagttatgatgcatctagttttctttcccccctagagcagggtttctcaatctctgcactcttgacattctaggcaacataattatttgttatagggctgtgcattgtaataggtttggcagcacccctggcatccactgactaggtgccagtaactcctcctcaagttgtgacaaccaaaaatgtatccagacatcaccaatgtcccctggagtgtggggagggaatctcctcaagttgagaaccacagcactagaaattaaagcagttagaaatcccagatattaacccctggaaagccacgtggactttattttcccagtttgataaatcgaatcagtttaaatacagaagacaccactcaacggttcacaaaaataatttggatagttatctctctcccacttataataaacccttaactgcctccattgactttaaataactcaacattatcagagcaatgaggtgaattactgagggccaacaattgagggactcaaaatcaagttataatgattactccttgcaaatgtataataattcatgttttacacatctgtcaatttgaattcattttaactttcattggttatttctgtgtgccaggggcctttaattttcataccacctatattagttttctgtgactgctgtaacgaattctgcttaaaacaacataaatttattgtctcacagttctgaaggctagaagttcaaagtcagtaccactgggccaaaatcactgtcagcaaggccacactacctccagaggctctaggggaaaatcattttcttgccttttccagcttctggtggctgtcagcattcctttgacttgtgaccacattactcccatttctgtctccaaagcaaccttacctattcctcttctacaggtcatcaaatctccctctgtccccctgttataaggtacatgtgattgcatctatggcacatcagataatccaggataatctccctgtttttaaattcattatttgattacacctgtaaagaccttcccccacaccccatctctttgccatgtgaggtaatatttacaggctccagggatatggatatgggggaacggaaggactatctattatcagccaattataccacccttgtgacgcaggcaaagattaatatttatagatgagaaaatagtggcacaaacaagttaaatggtttataagaagttacatgctgtgagagattggcacagatgggacaagaatccagggcttctgactcctcttttgaattacccatggcccagaagaatagaaacctattctccccttcctccagcaaacagttaaaaggcactgtgaagttagtataatcatgaaggattagaggatggagtttacaggctagcgaggattctggaaagcctcatatcattctgaggggcttaggggtgagaaatcacacagaattttccaagatattagaatagcacaaggaaaatgaaaggagatgatatggtatgagaagaaagcaaactgtagccttttaatattcattgagtccatgacagcataatgtttcacctgctatttagcatttcacattggcaacactgagtagggcatatgctgtgtataattttatgaagctctttaacaaaatagtctatggttgaattttcacaatatctctgtatggaagggcagtcattatcatcattccatttcataggtgaggaaactgaggtttggggagttaagagattttcccaagctagaataaaatccaagcctttttccttttatgataattgtcttttctaattattgtccctcatgtaagaatgatatatacaggtgtctcataaagttataacccatagctactgagttatcagtatagatgacaaatgttactttatattcaaccttcaggagacccagtacccttcaggcacttttcatgtaattcagatacacaaacaacaggtggcagtaagtgccttaggtaagtgatttgaatgaacaaatttaaacttaaatatacttattttaaactatgacaaaaatggtagattttcaggatttccgttttattgtttacagttgctagtctatcttattctatgcaatatgttcagatgtgtttaaaggtcaaatgtataaaataacttcaagaaaataaaaatctgttatttgctgtctttcaaaataattcctgctaactgcaattaaactaaagttttgtcttatcctgagactaaaattagaatattcatttccactttactctaaatatttttaaaatctaacttcctcctgattttaaaattagattttaaaatctaatttcttcaagatttctatttaacttactgacaaaagagccatgggatcttttactcaagtggaaaaagcttttatcatttcccattttctctctaagttttcagggaaaggacttaaagaatgaggaaatagtaggcaaggacatttctcctcttgagttccctatctctagcttttttttttttttttttacctcttctcaacagagaaactatcaaacagcagtgtgttaccactgaaagtacagagtcttttaacttttttttctatcagaatgaagtaagttttcacgctaggtcttaaaatgatagcaactagcagcattccccttcctgtttatcacatgtaaatttcaagttacactaagccagtagctacttttggaaatacgtgttaggaaggggaatgctgctagtttaactacctgtaacatccacacagtggcttctgccacagataggctccttttttcaaggctaagagatacaaacatacagctcacaccaacacagcaaatcaaagaacccgcacatttaagtactttttatacgaaaatgttcatttgttacattaaagatacactggcatttgtagtaaacaatatccacattgtcagtcaactttaaaagtaacactaatctagggttggctctgcactagggactttgagaactcaggagaaatgtaaaccacagttcctacctcaaaagatttacagcctaattgaggaggtggcatttctaaatgatgcatttgtattatatatcagtataacatgtacataagttcatattcaaaagaatggttacagataccatgaagtacagtggatcatggtagaaaggaaggtttcatggagaagaacttaaagggtgaatatattttgcataagcatataaaagaggcaagaatagttcaggaatagaataagtctcacgaaggcagggggttgagaatgaacctggtaggattgaaggtcagatggcacttgcctggaaggaggggaaatttggtaaaaaaaaaaaatatagctaagatatattacagtcttaaaggtagagagtttgaaaaatatgatcagtttataatacttttcatctgcccctatatagaggctggatctaatagttaaaaatgaaagtttaagccagagtagtagttaggagtactggacagaagaaaagccaggtgttgggaaccgaagagggctaatccatgagatgagaagaaaagacaggggccatgaccttgaggaggtaagctacaaaggatcagaaagccattagcatgaatagaagcctaacaaaaatttaaaaagggtgatgagttctatttggcatggtgagtctttaagagtgatagtacctttacaaaagaaaccacagaagatgggatcccacatagaagaagacagttaaaggaaaaagcatccttgcctcttggagcaactaaacacaacccatcattaacatcagagtccccaggtccaatgtggcaccctttatttttcctccaaatgttcagcatcgtttatcttcctttctcgcggatcctgcatttaacggctgtcacattgcttgggaaacttgattgcaacacggtcatttcatgggcaccagtcagaaggcttataccaaagtccttgcaaaagacaattttcatataagatatgtacttgtcatatctgcggtgagcatctgtcagtctcgtcataggctgcacatagagaattagtttataatccttaacactccagcttcccatgctgctcctcctgagtggattgagacatgcaaattaagcttgttttatttgatttgcatttgagtaattgcctactgtccataaagtaatgataaaacaaaaaccttttccaaattgaccagcttacctaaaaccattgagaataagagagagtcgagctataaaatgcctttcagaaataagaggagccacgttcataaaacacattgatttctttcctactacagagctataagcaatattacctgtggaaaaaaaatagatcagagatttctgtcattttcaaggcactggtccggaaatcggcaaacaaaacttcagcaagatctcctaaatcctctttaccagctgaagcagttggttgcattgcaaatgaaaaattaaaaagataggatcttcaaggtcaccagggagactatgtcgaccccttacccccagagttgtcagtagagtatagcagttttaaggatgtggactggagaatttgactgctggtgttcaaattcaggtctgctcaccattaactgtgtgagcttgggcaagttatttcacctctctgagcctcagtgctctcctctgtaaaatggagataacaatatttcattcacaaagaggattaaatgagtcaatgtatttaaaacacataacatggtgtctggcacacggtaagtattcaatggatgttatgattataatttcaatttctttccagccatatggccctttgtcatcagtttcataggtcttagcgggtaactataattctaatgcttataattattaacttttctttatacaaaagacatcacttatgctcttgtgccaaatgtagcagatgctgtcataccaatacttttttacccttaccacttcagtgcctgccacccccaaattcctactgccagcacctgcatttctttccctggggactttttctggattccaaacttgttttgccaacttgtatagtaggttggaaatgctgagaaattaatggccccaaccaaagactgataggagtcagcgtactctcacctctcaggtggggtaactctgaaggagatgtcttacactgcctccaagactttcccctgaagacttaagccccagacactctgtctgtggcagcaaatgtgataatgttgtctttaacacgtgcttacttgtttcactgctccattcttctatcactatttccttcaactctgaaacaaactacttatacttgaatccctgtctcagagtatattcttgtgggagcccaaactaagatcttctcacaaacctgtgagataattaagggtagacatcataattttgcagtttcagtaagaaaaccgagttgcagttcatgtgggtagttggtagaagagattggcctagaacccatgtctcttgataaactgtgttctttttctgttaccaagtatatatcacagctttttccagctgcatgcagactaataatgtcagtaattccctattatcttcctcctcattgtatatcagttggcctctgaaaagtctgtctggaccaagcaggaaatggtcatattccagctgactcttatcactgaacttccctatgtgtgacatgcgtatttatcagtttatactttaagtgtatgatcttaacaagccctctacctaatgaacactacattatctgccagagtctggaaatggattgttctagatcatcaagagtctagctaataaggaagttctgaattagctggaactgatttgtttttaacgtagcacttagcatagcggttgcactaaaaacacattaaggtccctttgatgatttggtctcaaggtcatgtacgaacacatcaattcttattagattgaaagacctacaaaaggttgttttatctttttaagactttcccccacaacccaaaaggaaggtacccaataaccctgggtaccataactgaaaggctacttaaatagagcatctgttagatgtaagagtacaagaagattctgcccattgagggctcttatttggagagcctccttaattaatggccatctggtcccccatgaaggactataattaagaaagcaatgtaggagcagatacatcagttaaaaactcgcctgtgcttgcctttcctccaagatattcagtagtcaggtaaatgccaaggtcacattgagctatttgtctttttcataaaaaaatggtttgggtgcagaggttgggataaaataaatcactgattgaattaagtggcagacacaggacttgctaacatctgaatgcccctcactgactctgattcagcagagatctgctgttttcgttgtccctgtttttttccagttgattttaggctctgtatgacggtaatagaggcaccctggatagatgaaagaactgaccatccttgatccttagctttgtcaaaaggatctgcacatgtccatttttactgcaaacatgagggaaaattcctgttgtggttattccttaagataataaagatatgttcttcacccaagctcccagagagcatctgctgagttagaaatcatctctattgcaatgttcaaacctagggatatgaccaaaccatacgcttctctaagtatttgcaaaacaacaaaaaacaaaaggagtggcaacctaccccttgctgtctaatgtcctccatctgcaagacctccgggtgaaagccttaagagccccaggcattaggtacagagtgttcctattatcagaaaatggggttgcagcaaatggctacaagccactagtatgcttaaattatagccctccctcagctatgccttttatatatttctctgaaaaaggtgaaataataaaagtatcattttagaacagtggagagcaacatgaaacacattgtcaactacctcctggctttacagtaactttaatgttactgtacaacgtgacccttcacctttctgaaccttaccttacaacaatagcaacattacatacctgtaacataactaagaaccaggaggtaagcaaagagggcatctgagcaccaagtctgtgcactttaactcatgtgcttccttaaaagtgaggccccataggctgggcgcggtggctcacacctgtaatcccagcactttgggaagccaaagtgggcagatcacgaggtcaggagaccaagaccatcctggctaacacggtgaaactccatctctactaaaaatacaaaaaaaaaaaaaaaatagccgggcatggtggtgggcgcctgtagtcccagctactcgggaggctgaggcaggagaatggtatgaacccaggaggcggagcttgcagtgagccgagatcgcgccattgcactccagcctgggcgacagagcgagactctgtctcaaaaaaaaataaaaataaaaaaaaagtgaggccctataggacttgattcagaatctatatacatttgcattgtatgcataattttaaccaagtttgaatgttttatttccagtctcaccaaagattagagacatcctgttaaaagctagtcagtggatgttaaaacaaagataacagaacacctacagcacagggagagaaaaactacggaaaagctggcaaaataactctgcagtcagagaacattcagtgtttgtgcaaacgttcattcttacagcctgtaataggttctgagggcattgctggatacagcacactgaaaagctgaaaatcatagtgtggaccttgagtcatcaagaaaagatgagactgtattccatacagtctgcctaaggaggcaacgaagtgtacaatacatgttagaaaacgttctaacaaaagcagttaaattaaaacttgttgaaatgtaacgacgtaaatttctacaccagaaaactctactatccagaaagattcctttttcaaaagctccatctcttgctgaaatttcaattgttctgacttcatcatttacagccttggtcatctcttggtggaagactatgattttgcatctcatactcccttttgcagtggaaaaatacatgtgcatggttttgccaagtttttaaactcttggaagaagggggaatctttatttttaattgcatattttgtatgcttctgggggtcacaaactgtccccattcttatattatcagtgaatttccaataaaaaactagtgcaaatttagacacctcccaaaatgaaggaaaattacccacaatgcatctttgcagtagaaggttggcccagttagattatgcagcaatttgtgtgatttctcatctggacactcagcacttagttcccatttcacctctaccaactgaagctttgacaatttgtctgacaagtccataacctaacttttttttaaaaaaatgcaaaagaaacagaagctacctatgtttgtaaggtacagttcagagattgtagaaaagggtaagagtaatagacccagagcagagggaaacagaattaagacaagaaattgtataacttagttctaaaagctactgtgagggctaaaaagggacctataggggatggcaatgctggaagaaagatttagggggaaaaagataaggtcaagagggcaaaagaaaattggtatgaatgtcccaataaataaaatagtcagattctagaggaagtagccagtacaagccggatagagcaaatatgattaactatttttgccaatctttggtgacagtggtgcataggggcattagagaagcagcaggtataatctttgaatggatctgggcctttagtgttaaggagtccagactagaaaagctaggtgaactgtgaaaaaaggataagtagggtctaagagaagatccaccaggtaaacctagaataccagaggaattacctaggatgataggaatgtaacatttcagagctgtgcttaggaaagaagtatatttttcactgaacaagcaatgtttacaattgatagagaaagaaggaagaaagaagaaaaaatgacccaaggagataataaatgcatcattgaaagcaattttgaggggacacattttgaaagaagactgcaatttagtcaccagactttgcttgaagccttgctcaatttcctttcccattgccttgatcattagtagagtctttctcactactcagcaacagtcaaatacccatgagtatcctctaactctaagcaagggtttctgtgtagggaagacatatggagaccagcgttgcttataagggtctctgtggagagaagggtctgtagttggcagaagtgatagtcttctcaagccaagccttacaaaacaagccctggattcagtggcccagataactgtttgttggtaagagtgacatcagcaaaatagcagaataggcagctccaaactcccattgctccacagaaacattgaaaagcaagcagaaactgtcacaaccttgtcaaaactctggaaaatagtcaaagatgtacagaaaccaggtatatgctgaatcaagaaaaaggcaacttcctacacattaggaaacttttgtggcatttattccagctcttgtcccacctcctccctagtttggcggtggtcttgaaggtggcaaatcacatttcttgtgtgggaccctggtccctgattccagagggagtggaacagaccttatcaaaggattattgtgtttgtctgttctaatctatgtatgggctccccaaagggctgatgcaaggcactcatcttcatttcacctaactcagaagtcactcagtgtgaaagtggtggacatttctcaaaggtgttgtaaggcaaatgaaaatcctgtacccaactggggtgaaagattatggttgaggcaaatagtagaccacctaaagcctagaagaaaaatctgggcataaattttctttgggaaattaggagattcaaaatcacccatgtatactggggaattaaaaagttatgcatatccccagagtaggacacatgttcagaaaagacttaagaagactctaagctttcacatctggctgctttctgggctcagtataagcaggaagtgaaggctaaggcagtttcagacagctggctaagtgttgaaggaatgccccaacacagagctaatcttatatatatacatatatatatatgtgtgtgtgtataacatataacataatataggccgggcgcgatagctcacgcctgtagtccgagcactttgggaggccgaggtgggtggatcacgagaccgagatcgagaccatcctgactaatacggtgaaaccccgtctctcctaaacatacaaaaaattagccaggcatggtggcaggcagctgtagtcccagctactcgggaggctggggcaggagaatggcgtgaacctgggaggcggagcttgcagtgagccaagatcacaccactgcactccagcctgggtgacagagcgagactccatctcaaaaaataaataaataaaataaaataaataacatatacacataagataataatcaaagatatattcttcacccaagctcccaaagagcatctgctgagttagaaatcatctctgttgcaatgttcaaacatagggatatgaccaaaccatatgcttctctaagtatgtgcaaaacatatatatatatatatatgagttcaaggacatctctgtcaaagcagtagctaaacacaagataaagaaacagaagacttaactgaccacacgtgacagataatacagtctttacaaaaatagtttggaaaagtaattaaacaaatggatgactctagctttccacaatcaaaaatagcaaaccctagagaaaggggagaacctgatatccagagtagccaccttataatattcaaatatccagttttcaacaaaaattcatgaagcatacagagaaacaggtaagtatgacccattcatgggattgtggggaatagaaactgtccctgaggaagtccattgttagggagatttatagctctaagctcttacatttttttttttttaaaaaaaaaaaaggaaaacttcaaatcaacagcgtcactttacatcttaaggaaatagaaaaagaagaataaagcaaacccaaagctagcagaaggaaggaaattaataatgattaatcagaagtaaaattaaggacataaaaataataaagagaaacaatgaaaccagaagttagttgtttgataagatcaacaatattgacaaatctttagttagactgaaaaaaaaaacgagaagagatattaatgaaaaaatcagaagtgaaagcaacttcattactaccaactttacagaaaataacaaggattataagaaactactatgaataattatgtcacaacaaattagatgacctagataaaatggaaaaattactggaaacacacaaattaccaaaaagatcatattaaatatcatatattaaaacattatacactatgactaaatgagatttatcccaggaatgaaagtgtggttcaacataaaaaaaaaaatccatcaatgtaaaacattacattaagagagggacagagaaaaaccacatcttcatctcaaatgatgcagaaaaagctaacaaacaaatgcatcaaagtttcagaacaaaaatcaacatacaaaatcagttgtgtttctgtacattggcaatgaagtatccaaaaagaaaatataaaaataatttaattcaccatagtatgcaaaaaaatcaaatgtctaggaagaaatttaacaaaagaggtgcaagtgttataccaaaaactaaaaaaaaaaaaaacaaaaaatgataaaagaaattaaagaaaatctcaataaatgaaaagacattctgcatcatggattgcaaaacttaatattgttaggatttcaatactgcttaaaaggatctacagattcagtgcaatttatatcaaaatcaatggcattttttggcagaaatggaaaaccttatcctcaaattcatatcaaattgcaagggtccccaaaaatgtcaaaacaatcttaaaaaataagaataagtttcgtgtgctcacattttctgtttttaaaaacttactacaaagcatagtcctaaaaactaatgtggtactggcataaggagagacatacacatcaatggaatagaattgagagtccagaaataaactcatagatcaatggcctattgctttttaacaagggggaaacaatagccttctcttttttattgagatgggggtcttgctcaaacttgcttgtgggctcaagcaattttcctgcctcagcctccttattagttggaatcacaggcacatgccattgtgcctggcaagaatagtcttttcaacaaatggtgctgagataactaaatatccacatgcaaaaagacgaaattgcacatacttcacaccatatacaaaatggggcagcaacctaaatataagagctaaaactataaaactcttacaagaaaacataagggtaaaatcttcatgaagttgaatttcacaaaggattcttagatatgaatacctaaagcataagcaacaaaagaaaaacataaataatttggacttcatcaaaattaaaaccttctgtgcatcaaaggatattatcaagagagtaaaaagacaacctatagaatgagagaaaatattttcaaatcatatctctaataaggatctggtatgcagaataaagaactcctgctactcaataacaaaaagataaaacctctatttttttaattatactttaagttctagggtacatgtgcacaacatgcaggtttgttacatatctacacatgtgccatgttggtgtgctgcacccgttaactcgtcatttacattaggtatatctcctaatgctatccctcccccctccccccaccccactacagtccctggtgtgtgatgttccccaccctgtgtccaagtgttctcattgttcaattcccacctatgagtgagaacatgcggtgtttggttttctgtccttgcaatagtttgctgagaatgatggtttccagcttcatccatgtccctacaaaggacatgaactcatcctttttatggctgcatagtattccatggtgtatatgtgccacattttcttaatccagtctatcattgatggacatttgaaaacctctattttaaattgggcaaaaaacttgactatgcatttctccaaagaagatatatgtatggccaaaaagcatatgagaagatgtttatcatcattagtcattagagaaatgaaaatcaaaaccacagtgagagagctcacacctatcaggatgtttcataattttaaaaaagacaaaaacaagcattgatgaagatgtacaaaaattggaactcttgcaccttgctggtgggaatgtaaaatggttcagccactatgaaaagcaatttggtagttcttcaggaagttaaacatagaaatgccatatgaatccatatttctactcctaggcatatacgctatgtaactgaaaacaggtactcaagcaagcatatgtacatacattcctagcagccctatttataatagccaagagatggaaacaacccaaatgcccatcaatggatttatgtatggataaacaaagtctggttgattccatatgttgtctattgtgaacagttcttcaataaacataggaatgcaggtatctctttgacatactgatttcccttcttttggatacatatccaatagtggaattactggatcatatgagagttctatttttttttttttgaggaaccttcatactgttgtccataatggttgtactaattcaccttctcaccagcagtgtgtaacagttcccttttctccacacccttgccaacatttgttgtcttttgatttttttgatagtagccattctgactggagtgaggtaatatctcattgtagtttttatttgcatttccctgatgattagtgatgctgggcattttttcatatgcctattggccacctgtatgtctttattggagaaatctctattcagctcttttgcctatttttaaatcaggttattggtttatttgttggtgagttgcttgagttccttacctattttggatattaacctttcatcagatgtatagtttgcaaatgcattctcttattctgcaggttgtctctttgctctgtttattgttttttgagattatatatatatatatgtaatatcaaagtctatatgaaatatatatatatacaatggaatattacctagatttaaaatgaaatgaattactgatacatgctacaacatggatgaacattgaaaacattatgctaagtaaaagaagtcagatacaaaaggtcacatattgtatgatttcattcatgtgaaatatccataataggtgataatattatctatatctatagatatatatacatctatgtatatagatatatatctatttatctatgtctatatctatgataatattatctatatccataataggtgaatttcacctcaataaattatttttttaaactttgctggtgctcaatatgtattttaaatgtttattttttagttaactcctattaacataattaagaatacacagcttcagcaaactgaaaacaaaattagccaataaacaggtgcagaaattggaaacagtaagattggagggaatgctcacagttaaaatgacaataaaagcactgtctgagtttcatagccaagaagcaattcccagatgcctgtccttggtttgagtagagcagggaagctattactcagacctttcattcaaggcagggactggagggagcaggaaataatcctttaattccatgtctcaaggagctgggggttttgtccccttttcttttctgcagaagatagttcattgtgttcatctgccctaggggaacctccggagagttggagccaggatttagaaaaaactaagaaagatcgagatttccctgcttatcagaactcttatggaaagcaataactgtgcttttaatgaaggctgagtagtatagtggaatagacattaggttgtagagccaaaaagacctgatttcaaatcccagctctgccccttaatagccatgtgatgtcaagctatttacttagctgactcaaacttcagtttccccttctgttacatgtagatgtataaccctgcaggatccttgtaaggattaagtgagatagatataaaatacctagcacaaagctgggcacacagtgggtactcaacactagttatttttcttcagtcaaataacagatgtcctctccatcccactccacctctcttgcaaaaatagtaattagaattgattgatgatgaagtatagtaggccaaaatttcaattagaaaggatacttaaacaattatataggtgatggatgcaatgctttttcacatagtaaaacattctgtgtgaaaggatagaagcagattcctccaggagagatcagcaaaatgagagaaagacaaggctgatggacaaatccatcccagaattcctgtttttttctattgtccccacaagaaacaaaagctatccacatcccataagcaatgggaagctcaacaaacagattcatcacaatcatttgagcaagaagagtaatggttttcttatcctccttatgaggctccaggattcggaatgctatagcgattaacaagaatgtgtgtgtgggttgagaaagatgttggttcaaattccagatctctcacttactagctatggacttcgggcaagtcacatatcttcgaggcttagagttctcatttataaataataatacttagcttgtagggttattgtatgtattacacaagatgatacatgtaaagtgcttagcacaatgcctagtacttagtcaatgaccaaaaaatattcatttctgctctctttttaatcacataaaattctactctgttttacagaaaggagctctttttaaagatgaggctatcagctgggtgcggtggctcacgcctgtaatcccagcactttgggaggccgaggtgggtggatcacctgaggttgggagtgccaggccagcctgaccaacatggagaaacccaatctctactaaaaatacaaatagccaggcgtggttgcacaagcctgtgatcccagctacttgggaggctgaggcaggagactcgcttgaacccgggaggcagaggttgcggtgagtcgagatcgcgccattgcactccagtctgggtaacaagagcgaaactctgtctcaaaaaaaaaaaaaaaggatgaggctttcatgaaaacgactcattattctacctttcttctaattttgagtatcatttaagggtcctctactttgggttatatagctacctattattctgtctcaatttgaaagttgagagacagttcactccagttaaaatggcttacaccaaaaagacagtcaataacaaatgatggtgaggatgtggagaaaagggaaccctcttgcactgctggtggaaatgtaaattagtacaaccactacggagatcagcttggagattcctcaaaaaactaaaataaaggtgctgtacaacccagccatcccactgctgggtatagaccccaaagaaaagaaatcagtacatcaaacagatgcctgcactcccatgattgttgcagcactattagcgatagccaagatttggaagcaacctaagtgtccatcagcagatgaatggacaaagaaaatgtggtacatatacacaataaagtactactcagccagaaaaaaagaatgagatcctgccatttgcaacaacatggatagaattagagatcattatgttaattgaaataatccaggcacagaagacattatattacatattctctcttatttgtgggatctaaaaatcaaaacaattgaactcacagacatagagagtagaaggatgattaccagaggctgggaagggtaacggggggttggagggagggtggggatggttaattggcacaaaaagaaaacagaaaaaataagtaagacctactatgtgatagcacaacagggtgacaagagtcaataatacattgcgtattttaaaataactaaaagttgaaaggcaagaagcttttgtcagcagaaaattcaacaaattaaaagttaaaagcaacagataaacaacagatgctggagaggatgtggagaaataggaacacttttacactgctggtgggagtgtaaattagttcaaccattgtggaagacagtgtggcgattcctcaaggatctagaactagaaatacaatttgacccagcgatcccattactgggtatatacccaaaggattataaatcatggtactataaagacacatgcacatgtatgtttattgtggcactattcacaatagcaaagacttggaaccagcccaaatgtccatcaatgttagactggattaagaaaatgtggcacatatacaccatggagtactatgcagccataaaaaatgatgagttcatgtcctttgtacggacatggatgaagctggaaaccatcattctaagcaaactatcacaaggacagaaaacaaaacactgcatgttctcactcacaggtgggagttgaacaatgagaacacatggacacagggcagggaacatcacacaccagggcctgtcatggggtgggggcctgggggagcgattgcattaggagaaatacctaatgtaaatgatgagttgatgcgtgcagcaaaccaacatggcacatgtatacctatgtaacaaacctgcacgttatgcacatgcaccctagaacttaaagcataatttagaaaaaaagaaaaaaaaaagttaaaagcactaagtttcatcccagcttttctaataactagcacagcatctttctgggcctgtgtttgtatatagtgaataaggatctttgaacttgagtattccttccagttttaaacttgcatgaaactaattattcaggccaacaataaaagacaagtcaccactttgctagcaagaagaaaagaaatatgtacatggggatatttgagggaccttgagaagtcaaccagtttgcttaatgctaggatgatttaagtctgacacctgggatagagatcccatacattctttgttgatgttctctaaggtttttctccctgaaagtaagcctctgtgatttatatgtacggaataagtaaagtatgcaaatatcataagtatataatagtcactgcactgatgcagtgaatcaacctatattctgagacatgatgggctctgcagtatgaaataactttgaggtactcggccaggcgcggtggctcacgcctgtaatctcagcactttgggaggccaaggtgggtggatcatgaggtcaggagatcgagaccatcatggctaacacggtgaaaccccgtctctactaaaaatacaaaaaattagccaggcgtggtggcgggcgcctgtagtcccagctactcaggaggctgaggcaggagaatggcgtgaacccgggaggcggagcttgcagtgagccaagatcgcgccactgtactccagcctgggcgacagagcgagactccatgtcaaaaaaaaagaaaagaaaagaaataactttgatgtactcataaaagaggatccagaaagataatttgttatttggtctgaaacttaaacataatctgctctcagggctgagggtgttttctcctattatcaagcctatgtagttaaactttggcccatgtattttgaaagatgaagcataactaaacttacagaacttcccaatcatgcacacacatgcgcatacacacacaacatacacacacacattttcctttcctcctaaaggagacaggatctatttttcaaattatatcagtaagatttgattcaaagaacacatgaattatcttcaccctataggtggagcaatttaccaatactaccaagaatagagcttctagaaggccaaaacttagagaaggtcactaaagggcaagttcagagtctcaggatcaagggcagaaatgtggtaactgttgcttctgtctccctagtccaggaaaaaggcaagaaatttcttcagatgaacagaaaactaaatgcctccatggaagcttgtcctccttgacccaaatttctttctttctttctttctttctttctttttcttcttcttttttttttttcatggtctcactgtcacccaggctggagtgcagtgccaaatatcttaatgtagcaatttctctccacaaggcaatatataatctagaaattcaatgtcatacacaatcaccgccattaagaagctttcaatccagccaggactctacacatacaaatagaagcattgactatagggttccatgatggtcaggaatgagaaaatcaaaattaaaaaacaacaagcatagactataagaactgaaagaggttaagataatctagtccagtggttttcgtactttttggtagaattttttagggttccatagaagggcctcaaactattgaaaaagagtctagggcatttctttgcacctaggaggctctagcttcatgaccttcttttatttaactttatttattgttttatttaacttttactttatcttatttagttctacttatattgttagcagaaagggttccatgaccaaaacaaaatgcttgaaaaccatagctcttattcaaattcttcaattaaaatataaagaaatgaaggccctgaaagggtccagcaatctgtccaaagtttttctgtaactagccaagccatgaagtgttgaagaaaagatacattaccttgtgacatctctgcttctttcaagtgccaaataagtgctggagacaaatcatgtaggtggatacaatcacagggggacttcagtggacagagagtgcttcataagggagattgggcttgaactgggctatgacctgtgaggagagtttcaagagttggaaggagggtatcatggcagaagtacagtctaaatgaaggtgcaggggcactgatgcatccaggagtgctcttataactgtttcttgtggaaacggtatgattatgaaagctgttaaataatattgagaataacactattgtgtgtttgtgtcaggtgagacacaatgaggaagtaaaaccaaaatgcttgaaatgaaagaagtttattactcacaggttcaagaggttgagggtgccaacaggaggctaataggaagcctggggatagcagagtgctcaaccagtggatggggagtgagaaagggggtatatctgtgggactatggctttattaaggtccatgggcattatctcttaggttttcctgtgagaattgtggattggctagtttaaagaaaacacacatgaagagggatcttattcacatgactctggtgttcattaggttttatcatgattaccagctgtggagtgtgctgggtttggggttaatgagatgcggaatttgtgaactatattacaaacaaacacatggagagtggaagttttaactaggtcaaaggtgatgggggcatgactaggttaccaataacttatgtcaggccaaaaaaaatgaatgccaaggcagtgattatattaaacaaatttacgacatggtgttagtgacctatggttcctgctcaccaaacattttgattctcattctgacaaaatctgttgctactgatcttttcagaatggtgtctgtactggaggattctgtcaaatcagctttggtatgaaccttaataagctataatttctataattggcataactggctaatttttcttttcatatccatcagcaagcttagagataaaataccaaattttatcccatatactgaaataccattatttacagtgcgttttgattatctgcagctagacttttttcataatatctgggtacccacttccaacacataattctgtttaattgtcatgaccacaaagaccattcttcctgaaaggcattgtatccccatttctatttaaaagacaccaaagaaagcaaggggtttgtgttgtatttggtatgaatagtttcagggatgattaacaaatgattcttggctaaaagaaagaaatgttgggagttgatattattgcatactagtgatgatttagttgctttacttttttagctttactatggcataggcatagagtgagagagttcattagaataatttctctctttattaaatggaagtaatcccagggaggtgacttacccaaagtcatgtcacacataaattgagtcaggattacaggtctcttaatcattcacaaaacttcctttctctaaaatcaccctaatttgaaatattttctgaagtctagtaagactgcttgagactttctttcatcttttcttgtgctgttcatggagcagcacaacttgactgtggaagggtaggtgtattagtcaggggcctctgcaggcacttattaaaaaattgacttgcatgattatgggggctgagagtcccaagacctgcaagctggagacctaggaaagctgatggtatagttctagtctaagtctgaagtcctgaaaaccaagagagctgattgtacaagttctggcccaaaagccacaggcttgagatccaagaagagctgatatttcagttcaagtctgcaggtaggaaaagactgatgtcctagttcaagtagtcaggcaggaagggtcccctcttactctcagaagggtcagccttttgttctattcaggccttcaattcattgcatgagggccatcctcattaggtagggcaatctgcttcactcagtctaccaattcaaatgttaatctcactccaaaacaccctcacagacacacccagaataatgtttgaccaaatatctggacactctatggcccagtcaagttgacagataaaattaaccatcacagtcaagatgagggaaactcttctttttgtaaagggagatagaacttgggaaatcattagtcttctgtccttccactcatagaatgaccagcatctccaagcaggcaggttcatttttaagatgatttaaaggtggatgaagcttccaagaccagagttcctataaaagagatttctagagattgaaggcaccatttccctaactctataaatgagggaggggtgtaatattgctagttggaactgctctcacccccttttcaatttttatgtatttgggctgatctcaccatgcatttttccctctgctggggtttgggcagagtttggagtagcaaatatatgaggatattcagcaagggaaccataagccatggaaaaacatggaaatatagctgtaaatggaggcagattatagatgcagaatataggaacatgtcaggaaaatagtccagatataggaagttcatggcaattgcagataataatgagataataggtcagagcctgacaagtaatcaatagcagactctagaagctaaatggcaagccaagtccaaggaaagagtcagaatagtataaattgacacaaggctccaaagacaagaagatttataaaccagacaacttctgtctctgacaggaagcctcttatactttttttatagtagtctggggcctgcttgccaggatctagccagttcaggaccaacattgctgcaagtcacagaatcacgatctttgtcagaagtacctgccaaggactgtgagaaacccacaagaggctggaggttggaaacagatttcagtagaaggaggtaaatttgtaaaaagaaggccaaaaagaaaggagacagaaaagaattttaaagtaactaagtcctgtttgtaaaaaaaaaaaaaaaaaaaaaaaaaaaaacaaaaaaaaaaactgctgggcgcagtggctcacgcctgtaatcccagcactttgggaggctgacgcttgcagatcacaaggtcaggagatcgagtccatcctggctaacacggtgaaaccccgtctgtactaaaaatacaaaaaattagccgggcatggtggtgggtgcctgtagtcccagctactcgggaggctgaggcaggagaatggcgtgaacccgggaagtagagcttgcagtgagccgagatcgcgccactgcactccagcttgggtgacagggcgagactccgtctcaaaaataaaaaataaaaaaaaaaatcttcctcaatccccacagacaagtttaacagagggcttcacattgttgtaatcagactacataaatgctaaacaataaaagatagaaaatgttagtattgttgtcagtaaaattcatagcagttaatcttgtcccagtaaaatgttacttatggtatatcccctggccattaacatgtttttatttcttttcttgagcttaagcaaaagtgaagggcattaccagtcgaattttctttttgtggttgtaattttgaaactactgtaaacttttcttcctctcataaccatgccttttctagagtccatagtcccactccatgacaattacactacaaagcaatgtacaggttttagttatgatgttctgtctggaacggtgaatgtgaacactcactcatccatgcaacacaggtattgagcttctactatgtgtcaggcattgttctatgctctggagatacagcagtggaaaaatgcacacaaaactctcctctctcataaagctcatgttctggtgaactttctaacatgctgtttagaggacctgataactaggacttctggcctatcatggtacacacatgaaaaatcagcttttcgtttcaaccaaaagctctttcctctctgcctgtactttaatggtttagtggaatatctcagttttagaaaagcattcctattctccatcaaaaatgatataagattgggaaaaacagaaatctgaatgtgacttagatcatacttcttattgcataaatacagtatatcctacctccatagatttcttgtactcttatatactccagaatgtatacctgggcttgacttcaagctcctgggcctgctgaaaccagaccctttaggggccatcattcagaatctacagatatttactgaacacccattaagtgctggtcacatggctagacacaatcaaatcatcatcccgtttattcctcacaacaattctgtaaaaggtaaagaacaggtattcttaatcttcacagactttcggtttctcagcaagatgtgcaatgacttacccaagatctataaaccagtaagcattccattggaatatgaaaatcattctttgactctatgatcttgcctcccagtgttcttatgggggactctttttccctattgatcaccttcattgaaaacatgcatgccgacataacacacacagtagccttggtctttatttagaacaggtatattcaattatcctgactgttcaatgtctattatttcctttagattccacatttgcatgggaacatcaagtggggacagcaaggtattggtgataatgaaaagaccattcactagtatatgactgagagtttgaacatctttccctattccatttggtattggtaaatctgaggcctgagcagtttctcagtagagattcatgcaaaatcagaggaaaagccccagacatctgtatgagtagcaaaatttatgaatattctattgtaccactggttagtagggaaaagccttcagttatgactcaacctcagaagttaattagatggaagcacctatactaatcttccgcaggcctccctgtgttctgtttttgtttcgtttattctacttgcctactatacttactgtatgggttgacatagtggacatcatttgatattgtgaatccagagggttttgtggaccacgaagtctgttctcaattatatgtaaggatggggaagacagaaaaaaaagagaaaaagctataggtgataaataattcttcatggctcagtggaatcaactgtttgtttctaccccagctcccacaggacctttccacaaagcttctaacaaccagaaagcaaactgattttctgccagtttcttccattctcctgtggccctgtgatggaggtggtaacgaggaagataaagaccctaaagtccagtagcaaatggaagttatcaagtggcctgaagcatcaggcaactagataaatatccccagaagagttgaaaattgactgctgtcatgagtgggaaaagtcagctgcagtcagattattgattattttgtagtagaaaaattatccccagtgtctgaatccttggaaaaatgaacaatgaaaagaaaagattttcaataaataacctaagctgatttgacagggatctgaatcaggcccctgcaaaggtaagaaatataggaggcagccatacctttaaattcagtctttgacagagtcagatatgatcattgacggtcacaccccagagatttcattatttttagatttcattattttttctgcctctgcaaaaataatacttgctcatctcatcacattgataatgtactgtcaacactggagaaacaaactgtgtgtgttttttacattcaggcctaagaatgtcactcaggtaaggttccttcaagaccctaggatattacatttccttctgtgttcctcatcagatcctttttaatggtctaatcagagaactttgaagctcaaaggtaatttccatcctaagctgttatgattactcgccttcaaagacccagaacctctgagtccctgtccttaaaagactgttctcaaataattccatcactacttggtcctgaaagagaaatagagctgtgtctttgcccaagttactcacctcttaaacaattggtttaaataaaaatatacatctgaaaaatggaagattcagcacaattcatgatttaacaactagcattgctgggcatggtggctcacacttgtaatcccagcagtttaggaggccaaggcaggaggattgcttgagcccaggagttcaagaccagcttgggcaacatagtgagaccctgtctcaaaagagaaaaacctagtatattcaatgttagatacgaatgcgaggatgaatccaatgttatatacaaagtagttttctttttctaaaacttgaagaataaaagtgtttttaggctttaagttatttcagaatgcaggtagtcatggagaagatgagaaagttagtttgatgagagattttaagctcatcagatctcaaatgctccattttccagcccttccaacagtcaatagattctagaaagaaaaaaaaataacatgagatggctgccaatgatcactaccagaaggcttccacttgctaggcctccatttcctcatctgaaaaatggcggagttattggccaggcacggtggctcacgcctgtaatcccagcactttgggaggccaaggtgggcggatcacggggtcaggagatggagaccgtcctggctaacacggtgaaatcccatctctactaaatatacaaaaaattagccgggtgtggtggtgggcgcctgtagtcctggctagtcgggaggctgaggcaggagaatggcgtgaacccgcgaggcggagcttgcagtgagccgagatcgcgccactgcactccagcctgggcgacagagcgagattccatcccaaaaaaaaaaaaaggaaaaccgggggagttattttatattatatttaacatgccatgcattccagtgctggcattgccttaattcaaatgccccttcacagttcctgtggctacttcctcaataggctttctctagcttcgaaagaattgcctccttctgtagactcaaagtttcttctcataatttatttctcactgaaatgatggaggcccttgtcagaatttctgtgataggtggaattctaagatggcctgccaatattctcagtcgctggtgtatatacaccttctcccagttattcaatccaacaccaatctagatactgctatgaaggtatttgcagatgtaattaaggtcccaaatcaggaccttaagatggtatgattatctagatgggactaaacagttgcataagcgctttaaaagcagagttttatctggctggtgagagaggaagtcagagagacaggatccagctgacttggaagaaagcaaacatttatcttgtgaactgcctttgggagccacatggcaagatactgtgggaagcttctaggagctgagaggtcgccagccaacagctagaagaaaaccaaattctgccaacaaatcgaatgaaatgagaagaggccttgaacccagatgagaaattcagcccctgccagacaccttgatttcagttcagtgagactatgagcagaaaatcaaagcatgctgtacccagacttctcacgcacagaaactgtgaattaatacgtttatgctattttaaacctttaagttttactaatttttatgccgcaataaaaaactaatataggtccttttaaccatcaaggcctggcttctcttggcttccccacttttcttgctttaaatttcccttagcttgggaattatttattcttcttcacatctcttctctgaaaagacatgagaaagatttacagataatatatttgtaaatggaacaacattacatgacgtagccacagccacaacttcctgtcattagtgaaactaaagacatgaaatatagtaatatgagttaaatactcagtcacccagaggaatggaaaaataaatccaaaatgattccatgaaccttttagccaaagtttcagcgttcaatacaaacctagatataatatcaattcctttattcaattatttagaaatatttagctagcactatgtcagatagcagggacaccatgatgggcaagacagaaaaggtttctgccctcatggagctgacagtctagtgcagtgtggtccagtagaaatataatacaagccacatttgtattaggttggtgcaaaagtaattgtggttttgccatttgcatttattaccttcaaagatgtcaataaaaaccaagtgaaattatttcaatgtaatttatttaacccactgtatccaaaatatcattcaacatgtaatcagtatacaaaattatcaatgagatattaggcattcttttttattgtactaagtcttcaaaatctggtctgtattttatacttactatgtatctcacttcatactagccacactttaagtgctcaatagccacatgtggctcatagctactgtactagtttaataagtgttaaccagatgaatggcaggtaaaacggtgttctagaagaaggaaatagcataagcaaaggaccagcagtgcaagaagatgaatgtgcccaaaggctagaggaaagaaagcagaacatttgcagaaaaacacaagtatttcagacgctgctggtgtgtggatggggaaggaagaagaaaggcccagcgccccaaggtccaaggcccaacacctcacttcctgctgagatactctgtcagctctgcttctttctacattaggtccctcataagtatattcctttctctgcttggaaattttattctctaaacctctcctcccaagaatatctaacctctcatatcccgtaaaatagtaggcttaattctgccacattattagtggcaatcacccaaggaaaaggctatcactggggccgaaaatagttttgcagtgcctcagacatttagtttgtattgccaccactctgggcttctctacctgccccagaagtttctctcttcctctgtaaaagtagtaataatcgtggctgggcgcggtggctcacacctgtaatcccagcactttggaaggccaaggcgggcggatcacgaggtcaagagatcaagaccatcctggccaacatggtgaaatcccgtctctactaaaaatacaaaaaattatctgggtgtggtggcacacgcctgtagtcccagctactcgggaggctgaggcaggagaattgcttgaacccgggaggcagaggttgcagtgagccgagattgcaccactgcactgcagcctggagacagggcaagactctgtctcaaaaaaacaaataaataaaattttttaaaaaggagtaataatgataaacaacaactgccacgtattaagtacttaaaatgtgccaagctaagtgctttacacggattacctcttttaaccctcacaagagccctctatatcaggctgcttcattatcttttgtttacaggcaaaaactgaggcttagagtagtgaagtgatttcatcaaagtaatgcagcaaataggaggtacagttgggattcaaacccaaggagtctaaatttggatagtttacattaagttattgtgcttcacctccctctacacacacatgcacacatgggtgcatgcacaagtacacacagagcaaaagctaaggctctgggaaatacatggtcaagttcgaccgagccctcaggagggtgagctggtggtcattctgaggaaagagagatgagaagatggtcttaaagtactaggatgtgggaccaggaagagaaagggtatcaggactgacctgccaactatgctttctgagcacccctgtctgggccaggatttatgccagctcatccttaccttggactatataagagaaacacaggtaagaaagactgaattgctattaaagttgatattgttgggccagtctctccttgagatacacacacacacacacacacacacacactccaaccttccagaggtgcttctctgtacattgtaatgtaattggtgtctcagggctactgggcccatttattgcctctgttcttgcctttgatcctctagagaagaggtgatggatggcaaatgcaggagccgccttgccggtcattctaagcaaacagaatcactaaccaatttcctcccaacctcatcatctctgtctagttgttccccacccccatctttgtagagaataattaaacttgcaagcactgggcattgttacttaaagctaactgcaatattcaaaaacaaccccaaagattttttttcctggtctgctgccctggattaagggtggctttgttttgttctgatttcttgctgcctgtgatatctaatttgccattgtgctttaacaacaactctctttaaatactagaagacagttctaaccatggcagggggagatggaggcaaagacgcccaagctctacagacactgaatcaggataaacatcctaattatttaactctttcttcagctactggcctcctcctattacccaggagaacatttgcttagttcctctaatgcacaccatttgtatttcatctgtcttcgcaaatggatacttggtaactttgatacagctctacccaacacagctgtgtgggtgtgcaaacccttatagtgcttgaaaattgtcatggagattgaggtctaaaaaaatcagccatctaaattgtcttttaaggggcaccggatgacgcgaattgtgccccttccaacagtggtttacaaagtgtaatccctgaaccagcaacattcacaccacctggaaacctagaactctaaattctggccaaacatggtggcccacacctgtaatcccaacgttttgagaggccaaggtgggaagataacttgaggccaggagtttgaaaccagcctaggtaagaaagcaaggcctcatctctaccaaagaaaaaaaaaaatccagattctttggccccacaccagccctactgaatcagaaactctgagagggggaaaatctgcatgattcaggtggctctgaagcacgctaaaatttcaggaccaccgaatctagagttagagaacctgtgtttaaaaggcaagaagacccctgtctctcctaaaaatacaaaaaattagccaggtgtggtggcaggcacctgtaatcccagctattcaggaggctgaggcaggagaatcagttgaacctgggaaggggaggctgcagttagccaagatcatgccattgcattcctgcctgggcaacagagccagactctgagactatgtcaaaaaaaaaaaaaaaaatggcaagaaggcagagtagagggaaaagcggctttatttttaacagtggttttcaacattggatgcatactagaatcatctggagagctctaaaaatactgatgcccaggtcttactcctagaaactctgactttgttggtctggtatggggcctaggcattagtattttttcaaagctacccaggtaattctaatgtgcaaccaggactgagagccactatttttagaaatataggggaggatgtcatctggagatcttttaccttttcagttataacctggtccatgccctgttttggatcaggggagtgctaggatggctcatgagaaatcaggaggtattaccagtttgagaaggggaaggaaaggcagctaacatgcactgaatgtctgctatgcaccaagcactatgctaggcactatatccacacatccttgaacagatagatttgctggcagcaatcgctgttgagcatccaagggaaggaattagaataaggagatgattagttcacaggagcacatgcagagaagcttctcattataaccactcaaggaataaacgaacaaaaaactgtaaagagccaagcatatatttgggatgagttaggtagatcccagtttagatgcagaaggctggactaaatgacctaatattttttcaaaatttattctagaatactatgaaaaggcataatgtcagatacaatctggaagctatttctgcacattcaaaatgatggagaaaactgaggtactatctcccaaaccattctcactgaaaactttgagctggctcaggcaaccttaaagaggaacgaggttaagtattacacccattttatagactaaaacagtggttctcaatgtatggtccctggaccagcagcaccagcagcacctgggaacttgttagaaatgcaaattccccatccccatcccacttctactgaatgagatgctccaagcttggggccttgcaatctgtgttttaacattctctcaggcaaccctgatgcatgcttgagaaccggttttagaaccacagtttactgagtttgttcaactgatcctcaagggaggagtcatttttaaaatttttttcacatcagcaagtattcactgaggatcctgcctatctataccccaacgatgcccttctctgaattgtactggaaaactaagagatgcaaggctgcagggaggactggcaatgtggctggcaggaaatactagagactgaggctccaaatcatataatgtgcttgtagtgtgaccctacaaagattacctaacaactctgagtcaaaatctagcacatggcaggtgttcagtaaagatttggtagctaaatacctgtaaggatgatagtgctgaaggagacaggatacaatgaaggaagcaggagtcagacatatctcagtttgggccctgcctctgcctttgaactagctctctgatcttgagcaaggcacttcccattttagcctcagttttctcagctataagatgagggagggagattctgattacatgatctctataggctctgctgacatctaaactgttctgtttcaaaatgagccaggcacggtggctcaggcctgtaatcctagccactatgagaggccgaggcaggcagatcacctgaggtcaggagttcaagaccagcctggccaacacggtgaaaccccgtctctactaaaaatacaaaaattagctgggcatggtggcgcacgcctatagtcccagctacttgggaggctgaggcaggagaattgcttgaacctgggaagcggaggttgcagtgagctgagagagcaccactgcactccagcctgtgtgatagagtgagactctgtctccaaagtaaataaataaataaataacaacaacaacaacaacaaaatctacactatgatcttgagacagtttagtgatccaatttctataaagatagggctatataaatacaaaatgtactgaagcctcaagatacattttatatacaggatcaatttccagcacccggcaaaatactgctatttaacaccaaaggaagtggcttaataactagagctttcaattgtctgagtagtacacaggagtatttcctcatggtaggaagttgtttggagtagctgggaaacattatgcacaaataactggggcaagctgcttgtgttcattaggatcgtagaactggaggaacccctcaataacctttaaacttttgaaggtgaaaagtattagcaaagggtcaagaaaaaccctacatacagattaacaggaagaaatgcaaatagtgaaaagagctagggcgatggaaagaggccagacccagattcaaatccctgctccacagtaactgtgtgaactcagacatgccatttagcatctctaagccacagactcatctgtgaagaggagataataacacctgcctcataaggctgttctgagcattaagtagaacaatggactacataagagcccagtaaagacacacccccatcccaccaagctgaaatgctccatcaattagagatgatgttattattctgaattgcctttgcatgtgaaagcaaagagaattgtgagatcctggctgcctgcaacttcatcaaaaaaaagaaaaagaaaaagaaaagaaaagaaaaaaaaagagacttgacaagaacctgctgcctactctgtacaggatattgtgaggcatagccaagaaatggtaggtggaatcacaccgaactgcagtatttgaccattttaccgacaaacccaccaatgttatgtggttcaacctaagataggaggctgtcccttattttatataaagtctgatcctgtcaggaaatgattgatgcccaggaaaacaatatcaatccccaaatgtctacccaagtcctaagttgaatatacagtagaccccgttatccatggtttctctttctgtggttacagttagctgtagttaatggaagtctgaaaatacgtgagtacagtaagatattttgagagaacatttacataactttcatgacagtatgtgtaataattgttccattttatttttgattactgttgttaacctcttactgtccctaatttataagctttgtcatacgtatatatgtataggaaaaaacataatgctgtatacatgaagtttgatactatctgcagtttcaggcatccactggggtcttggaacatatccctccagggtactgtaaagcaaaatgtgcagtgcagggaggcagctggtgaccctagaggtagcaaatgctctattttggcttagtgaatgaacggactcaccactattttgatatcaaaatagccaccttttagccacccacctgaccccactcttttctttctcagtcatggatatgagggcagtggaacactgagcccctgctgcagaagccctagcatgccaaagccccccactggggagcctcccagttccaggcaaaggaattcagcacagccaaagcaaggttgagatgaataactggatttactccttgagatcccgggagcctccaacgggaacaggctgtttcatagggccagtctcagctgataagaggcagcaaatgactctttccaagtcacagtcattatgatgcctgtaacctttttattataaaaatatatgcatatcccgcagaaccctacttacttgcgctttcttggatggctgctaggtttcacacacgccagattagatacattctgacttgttcaggcactgtcagtttaggtcctttcctcctggaagcaacaaaaccaggcaaagagattaataaggtccactacatataaggagaaattggggggcactttcttagccagaggttgctcaaagacagccccatcccagttgatgaaccagtctaccatgtacatggtgtctagctgatccttttttccccctacacagcctgctcagacatagcctgtattttacccttgtcaaatgggggagggtagcatgtcccttctgcagaggattaaaaccacacagtttccagcctggacactgctcatgctctcccctgagggaagtgggtagttttctggctggccctctcacaggcaggaagtttggctgccatacatcctcggtttcacatttacttaacaaacaattatgtaacagtttccatgtgccaggcactagtctagccactacacacatatcaactcatttattatcctcataagaaccctgagaagtacagtcacatgctgcataatgaaatttcagtcaaggatagaccacatatatggcgttggtcacataagactataatggagctgccttatacagacataccattttttatcatttatatcatttatcatttttattatatataaattatattgtgtataaatgatattgtgtgttagatacacaaatacttcccattgtgttacaatcgcctacaatattcagtacagtaacatactgtacaggtttgtagcctaggagcaatagaccataacacatagcctaggttcctagtaggctataccctctaggtttctatgagtacacactatgatgttcacacaatgaaaaaatttcttaaggagacatttctcagaacatatccctgtcattaagaaatgcatggctgtacgtacagttattaagcccattttacagatgagaagtctgaggcagagaaagatgaagtaacttgcccaaggtcacagagctgctaagtgggagagctaggatttgaccaggctacgatttgagctggtaagtgggaaagctgtaattatctccccttcacagatgaatctgtggcttagagatgctaaatggcatgtctaagttcacacagctactgtggagcagggatttaaatctgggtctttcctctttccgttgccctagctcttttcactattgcatttcttcctgataatctgtatgtagggtttttcttgaccctagctccagagtttgttctctaaactactagagtatcctacctcttgaagtacgattttttttattatactttaagttctagggtacatgtgcacaacgtgcaggtttgttacatatgtatacatgtgccatgttggtgtgctgcacccattaactcgtcgtttacattaggtatatctcctaatgctatccctccctgctccacccaccccacaacaggccccggtgtgtgatgctccccttcctgtgtccaagtgttctcattgttcgattcccacctatgagtgagaacatgcagtgtttttaagggataggtagaggcagagggaagggcagaggctctacccacagatgcagccactttcaccaggtcttgaattgagaggcactaaagacttctgctctaaaatggttttcccttgcctttatgcgtcagagttcatgctgtgctccctcttctgaggcatccaaggtcctcacttaattatgaataaaacttggcaggaacagtacagttatcattggtcattaacacccagacccaaagcatgttatcacattcaaagtcaggcagacttctgagaatctgggtccctgaagaggcaagttgtgaagatgaggaagagagtttaagaaaggtctatggctgtcaaagctgcctaggagagaaaggcctgaggatgatcatgatgaagatacccgaagcagcctaagggattttatgaaaatattgggtgcctcagcagcaagaccctacaggaggaaataagactacactgaaaacagactttactccttcccggtttggcccccgcaatctcgattcataaactacacccaactcaaacgtgacacatggcagctaggttctcttctgcagtggcagaggatcccaggttaataaagaaggcccgtggttaggcaagtgtccaaactcacacttgtcctcttcttggctgtgtcaaagatacagtcctcagtgaagcctgtccctagctcccccacgctagggcagcatttgagaaaacaaagcaacattaaagcatccaggtcagaaggcacaagaaaaccctcacatggtctggataagccagggttattgactgtggcagtgacaggcagatcctctcagacggttacaacccagattcccagctggttgtggttgcacagcccacacactctaacgactcagcttctctcaatatgattaagattatgattaatctttcatttatcaaacatttgatatgtgccaggcactgttattagtgttttacatgtatgaactcatttactcttcacaattatgttattacgtagttattattatgcctagaaaaactgatgctctgaaaaatagcaggccagaggtcacacagctacaaagtggaaaattggggtctttctctcctctgtctcaaaagtcaccttctctctatattttttttttttttttgagacagagtcttgctttgtcacccaggctggagtgcagtggcgtaatcttggctcactgcaagctccacctcccgggttcacaccattctcctgcctcagcctcccaagtagctgggactacaggcacccaccaccgcacctggctaattttttttttcttttgtatttttagtagagatggggtttcactgtgttagccaggatggtctcgatctcctgacctcgtgatccacctgccttggcctcccaaagtgctgggattacaggcatgagccaccgcgcccagccatcaccttctctatttctaaaatacaataaggttcatacaaaaggaggtgatttctgcatgaggctctattggtcttttatctctcatcaaggacccagcagcttggggatcaaggaggaagttggccaaggccactcacatcatccaccaaggcactaatctcctcacttatgtccaagccaggctcttcttatgagaggaactaatctatgagcatgtgtttggtgggtttcaccttggatatagtggagggctactttctttgtagggtgctatttagagtatagctggacactttacaagacaggagacaaacagggaatggccagcaggatgtacggtggctatgtgatgaaattcctctccccttaactccccctaccacccatatggttagcccataattggtaaactccgccattctggtcctttaatatggaactaccctaccactggtcaacaagcagacttgccaggctgtgctgggactgaaacctctcttattcttctgggtccagtcagtccctttatcagagtgacctggatggagagcaagggcatctgctttggagccatttaaaggctcctagagtacctctgtgtcctaaggggcagattagaaagaacagggccaaggaagtgctgagaatataggggagactagaagtcaaggtaatgaatgactctgttatgccggcctaccacagtgtacctggaatgatcttcaggatctgcacaaacccttaggtgtggagggagggagaattgattgctgtgtgctctgtaactgaagcccatgtaggaactccctttatagtccaaagaaagcatattgaaggaaagcttacttgtcctggctctggctccctgaaacaaactaaaaaaatctcttaaatctctcttctcacagggaggaaacaaaacatagtttcatggcaaagcaagagaccatgtcacttaagggacagtatcccatgtgaaatagtaacatccatactcatctaaacaccaagtatgcagatggaactgagtaggtttccaaagcaaatttatcaatttctccttcagattagctccccttccagtccttccattcagtcatccagactcaatctcagagttttcactgaagttgggaggtgagagaggaatgttcatcaaaacctattgattctacttttccatcctattattcctagcctcaccaccaccaccccagtcctagaccttatctatgccactccacccccactccaccccacctccctatactggataccttcttgactgccttcctatcttcaggactagcttcatagtcatgctatctgagcaggctcataggtactcacacttggtttaatgctctgctgttaccaccttgaaagtcctaatttttttttctttaacaaggagccctgcaatttcattttgcactgggccctgcaaattatgtagccactcctgcctgtttctccccatctggacccatcttacacatagtgtttattgccagagtttgtttgctaatgccaataataatgcatctaatggctctccgatgcctccagaatcaaacccaaacctcgcagcctggtcttcaaggccctctgttacctggcctccatctaatttcccatacatcccatataaattctactcattccagaatggaggatggttttactattaacaacttcagcagaatgattaacagctgtggagtctgactgtggagtcagacccagttgaggggcctggttctacacttgttagctgtatgactttgggcaaattccgtagcctctctgaacctcagtttcctcatctgtaaaaaagagataccaacagtgcctatctcataaggtcaatataagaattaaatgatataatcaatagaaataagtctctaagcatagtatctggccggcccttagtaaacactaaataagtattagttactaatattatttgttgtaattgttacaaagctgagtagttctaaaagtcactatgcctaatgcctatctaattggccatattgctggctggatttcaggtaactcacagtgacctgccatggccctctacttccctttcatgtacctctcaaccaccatcctctggatggagatgattataatttgcatgttgttgagctgtgttcaccacctccctctttttgctctctgctagtgtgggagcaacttgatgggccagcagaagctgcagaggcagacatggagaggaagcagcacatttgccaactgggtttcagagggaagcagctctgggaactgacgttcaggctttgaccaacccctgccccccgccgccaccttccccctgccaagatctgtccattctcctgggaacccatggtcggccttgggggatacatagagattttggatgagatttgtccaggcatctgcatgaaacagctccgggacagttccctctatcatatcaggtcaatttcaaatttgcagcaaaggttcatcctgagctgctgaagtaattcacaaagtagtcacagaagtggctcaccctatataaagactaaggaccccagcttaagctttttgcatgggtcctttgccacaccccagctgtggtgaggaaaacagctcccagcagggtcactcccagttccttcccatccatttacagatgtgctttatacttctcttagaacagggatcctcaactccggctgcactttagagtcacctgcagaacttctgaaacataccaatgttgggccaccagtaagactaattaaatctgaatgtctgggagagggaccctggagttggtaagatatttttttttttttttttttacttttaggttcagtttcaggggtacatgtgcaagtttgtgacacaggtaaacttgtgtcacaggggtttgttatacagattatttcgtcacccaggtattaggcctagtacccattatttttcctgatcttctccctccccacctccatcctccagaaggccccagtatgtgttattcccctctatgtgtccatgtgttctcatcatttagctcccactcataagtgaaaacatgtggtatttggttttctgctcctgtgtcagtctgctaaggataatggcttccagctctatccatgtccctgcaaaggacatgatcgcattctttttttatgactgctgggtacgtacccaaagaaatggaaatcattctatcataaagacacatgcacgcagatgttcattgtagtaaaattcacgatagcaatgacatgaagctggtaacattgacaaactcctgaagtgattctaatgtgtggccaggacagagaacaagactatatgagaaatgtagcttcttaaccaatttcctggtgtccatgttgttctcccccttgaacctatgtcacttattacttgaaatgtaaagttcaagaaacctccaatatgaccctgtttattttttgccgcccctacccatgcactctaccctccagccacacctggttctttcccagtccacagacacaacacctatattaatctcattgaaatgttgctcacactgtttccctgacttagaatacccccactacttttccaaaagcagtggttttcaaatgtgagtgtgcctcagaatttcctggagggcttgctgaaatacaacttgctgggatccatctcagagtgtctgatttagaaggtctaatatggacctgagatttgacctgctaacaaattcccaagtgatgctgctgggcaaaagatcacattgtgctgctctctcctcaagtttccaaatggcctcttgcaaattgatagtgtggttccaggaagaaatgactctagtgggatctgcccttggcaaactttggggaagaacaggattgccttcagcattcttctatctcacttcattacctcctaattgccaccctcctacttccaagcactcaaggttttcacactggttactacttgttcaaaatgctccacagcaagcattcttgtgttccagccagactcttatgccctccggtctccatactctactaagatgttctgttgataatataacaacagaacatacagataactctatggttaattaagtgcaacatggactctggggtcaaacaggtctggtggacttgtggatccaccacttctctgctgcatagcactgcaaaatcactaagcttccctgaggctacatttcttcatctgtaatatgaggatgtcatgcatagtttgcagggtaattatgaggaataacataaaataatgtatgtaaagaacaaacctgccatatgttaagcattcaataaatagttgctattacaaatgcattaaaactttactattagtaactggtgagagattgcctaggtagccgttgcattttaacaacaaccttcttagtgaggatctctggggaaaccctccatttttgcactgttgccagaatgatcttttcagaatataaattgaatcactttgtccctctgcttaaactttttctcattgctcccctcttgcttgtagaataaaaccctaaatccttaaatgacttatatgcccccatattcagtggttcttaactggggagtatttggaagtttggggacattttggttgtcataaataccaaggggggcagtattaccatttagtgtgcagggaccaggacactaaacctcctacaaccttgcatatgcaaaccagcactccccacccctatggaaaactgtctcaccccaaagccaatggcactcacattaagaaacacccgagtcaaactctctagcctcacctcctatcacttccttgctctgtgtactccagccaccctggccttgcttttagtcctccacagcaccttggacattctgttctttctacttggaaagcagttcttttctgatggatcatttaactcctactgacccttcaaatctcagcttaagtgatattgcttcatggaggccataattcactccccattatagtatatacctccttagaactgtattccttgccttcagaatatttatcttcgtttataattgtgtactctgtaatgttttttgaattatttgattaatgtttgcctcacacataagaccacaaattccaagaaagcaagcatcacgtctgtttttgctcaccattatatacgcaatacctagcccaatgcttggctagcagtaggtactcactctctctctgagaaatgaatacccacataagcagcccctagtcttaatcaagtctccagggagagggggcagttattaacatgctctgctcttagaggtcttagaacaactggctcctactgaactctttgaggtaggagggggacctagatagagtagaaaagtgcttccatgtaattattctgtttgcattcaagcttattagaatgcaatggttggtcacaatgtttatgtttccaatttctacacgtagacattctgattgattgcttgctcccaatcctaaatatattaaaacaaatgaaagattgtttaaagcatgttgtgtatttactttttgatgcttctaagacatgcggggtacctgtccaatttttgtcaaatttgaaaaataccctgtcaagagtccaacagtcttggaacatggtactacatgtgatagagctacttatacctcaactctctagtgaattctgcattaaaaatcaagacaataggctgcttcagctctaagtagcttggagttggtttgtttgtatgtttaatgccatagtccaggcaataagaaagaacgagaaaaagaaagagcaggagtatgtgtttggtgcataaaagaaatgctgattctagctgggtgtggtggatcaggtctgtagtcccagctactcagtaggagactgagtctggaggatcacttgagctcaggagtttgagaccagcctgggcaacacagtgagaccctgtatgccccaccccccaaaaaaatgctgattctgttccagtgtgactagaacccagtaagcaaaggggaaggtaatcgaagatgaagtcatagacgtagctaagaccaggtcagtgaaaatttttgtccattcctgtgagtaggctgggagccatgggatggttttgagcagaggagcagtgtgatctaacttgttttgaaaacagatcactttcagtactgtttgaagaaaaaaatgtgtggaggaggggtgatgtgtgagcaggttgcagggtataaaggacagaagcagccaggccagttaggagactattgtgataattcaggtgaaaggagatggaaattattgaccagatggtagcagagaaggcagtaaaacctgattggatcttagatatattttgaaagtagaacgtgacgtgcgagagaaaagaaatcaaggattcattttttattcaacaaatatttactgaacacctactatgtgccaagtactgttttatgtgcttaggatatagcagtgaacaaaacaaacaaaaatctccatctaatttgagttcactttttgttttgttttgttttcagtcagagtcttggtctgttgcccaggctggagtgcagtggcaggatcttggctcactgcaacctccgactcccaggttcaagtgattctcatgtctcaccctcccaaatagctgggattacaagcgtgcaccaacatgcctggctaatttttagtattgttagtagagacgaggttttgccgtgttggccaggctggtctcgaactcctagcctcaagtgatctgcccagctcggcctcccaaagtgctaggaatacaggtgtgagtccctgcaccttgtctgagcttactttttaatcaataatagataacatgttttgagcacttcctgtgttccaagcactttgcattcttaacttatgtaattctcactacaacccaataatgtatgtgtgtatggtattacctccatttctcagctgaggaaactaaggcacagagaggcaagtttcttgaggtctcacagctgataagtagtgaagctgtgtttccaacccaggaaattatgcttgagagtctgagttcaaagcacttcattctactgcctctttaccaggccagtattcccacaacaggagcaaagctggaccacctgggtgaaaactagggatctaactgctagatgactcaaagttttttggcctgaaaaactgcaagaatgtacttgacatttacaagagcttgattctgaatataaattggtagcctgggcacagaaagatttgggccagtgagtactctctaaaatgtccaatattatttgacacaaaaatgttgtgtcatagcaccatgtaagtgttagctctaattatccactagaatggttaagtggcattcaaaagggcagaatttatcaggcttgctgagactctgacacactgccaggcaaatcaggaggctttggtcagtgaaatcgccctaggattctttcacagaaatctaccatcaaatgtggtagaaatatatgggaacaaaagtgataaggaaacctgagattaggagatatactgatagaaattgcttgcatttttgttaggtgcttaccatgttgtaggtatctacatgttgtaggacaggatgtacctatcctaagtgttggcaatgtattacatcatctaatcgtcgcaacaaccctaggaagaagatattagtatttccatgtataaaactgggggtctgaaaggtttggtgacatgcccaggctctcctagctcaaatgtggtagcagtgggacgcaaacacacatctgtttgactccaaagcccacgctgctccccaggaggttaaattctcctgctgtgctccccagtgaaccctgtccagatcatctactcacctatatttgaattgtttctaacacttaaatttgtacttctttgtatatttctgtacgtgctttggtaccatctcattcaaacgtatgttccttctctcccatttattttataagctcactgaggttggggccctgatttgcttatcttgctactttccagtggtgttacttatgggcatctccccacaagtgagtgtctaataaaggttgctgattgactgcaataaactgttttagaaatctgctggtgattctaaatctggtatgctttcatccaagacaagattaatatcacagtggcaggtaaaataatagctgccatttctttaagatttaatttgtcctaaacaactataccgtgcaaagtgcttcctgtgcattatctcatttaaccctgaaaatatgagtcagatactctaattgctttttaaatttttattattattactattattttgagacggagtgttgctctgtcacccaggctggagtgcagtggtgcgatctcgggtcacggcaacctccgactcccaggttgaagcaattttcctgcctcagccgcctgagtagctgggatcacaggtgtgtaccaccatgcccagctaatttttgtatttttagtagagacggggttttgccatgttggccaggctggtctcgaactcctgacctcaggtgatccgcccacctcggcctcccaaagtaccgggattacaggcgtgagccaccgtgcctggccagatactctaattacaattcccctatttcatgatctagcagtcccactgctgggtacataccaaaaagaaaggaaatcagtatatcaaatagatactgcactcccatgtttactgcagccccattcacaatagtcaaggtatggagtcaatctaagtgctcatcaacagatgagtggacaaagaaaatatggtacatatacacaaaggaatgctcttcagccatgaaaaagaatgaaatcctgtcatttgcagcaacatggatagaactggagggcattatgttaagcgaaataagccaggcacagaaagacagatatcccatgttctcactcatacgtgggagtaaaaaaaaaattcatctcatggaggtagtgagtaaaatagtgtttccaagaggctagaaagggcaggggggactagggtgtgtggagaggttggtgaacacatacaaaactacagttagatagaaggaataataacttatagtgttactgcatgttctcactcataagtgggagttgaacaatgagaacacatggacacagagaggggaacatcacacactgggaactgtcaggggttggggcacaaggggagggagagctttaggacaaatacctaatgtatgtggggcataaaacctagatggtgggttgataggtgcagcaaaccaccatggcacatgtatacctaggtaaaaaacttgcatgttctgcacatgtatcccagaacttaaagtaaaataaaataaaataaataacttatagtgttcaatagcactgtcaggagactatatataattaacaattcattgtacaattaacccttgatttttttccaaccaaactcagactgaacatacgttcatccattggtatgcatggggagttggttccagtatgttcacatgtaccaaaatccacacatgctgaagtcctgaagctggccctgtggaaccccatatttaaaaagtgcaggttttgtatcctgtgaatactgtatttctgacccatgattggttggaaaaaaaatgtgtgtataagtggacccatgcagttcaaacccatattgttaatgagtcaactgtacagtatttgagaatccgtggatacagagggctgactttttgtatctgtgggtttggcagggctgactgcagacagaaggatgtttggattttggaatacaagggtcctggaaccaacccttcacatatactgaagtatgactatatatttttaaatagctggaagagaatatatacagcattcccaacataaagaaatgataagtttgaggtggtagatatcccaattgccttgattttattattagacattgtatacatatatcaaaatatcacatgtaccccataaacatacatataaataaatatgtccaactattatgtatcaattaaaaattaaaaataattttagatggctaattaggaacagctctggtctgcagctcccagcatgattgacacagaagatggatgatttctgcatttcaaactgaggtcatcaggatcaaagaccaaaggtagataaaaccacaaagatggggagagaccagagcagaaaagctgaaaattctaaaaatcagagtgcctcttctcctccaaaggattgcagctcctagccagcaacagaacagagctggacagagaatgacttcgatgagttgacagaagtaggattcagaaggtcagtaataacaaactactctgagctaaaggaggatgtttgaacccattgcaaggaagctaaaaactttgaaaaaagattagacaaatggctaactagaataaacagtgtagagaagaccttaaatgacctgatggagctgaaaaccatggcatgagaacttcgtgacgcatgcacaagcttcaatatccgattcgatcaagtggaagaaggggtatcagtgattgaagaccaaattaatgaaataaagcaagcagacaaggttagagacaaaagagtaaaaagaaatgaacaaagcctccaagaaatatgggacaacgtgaaaagaccaaatctatgtttgattggtgtacctaaaagtgatgggaacaatggaaccaagttggcaaacactcttcaggatattatccaggagaacttcccccaacctagcaaggccggccaacattcaaattcaggaaatccagagaacaccacaaagatactccttgagaagagcaaccccaagacatataattgtcagattcaccaaggttgaaaagtgttaagggcaaccagagagaaaggtcgagttacacacaagggaaagcccatcagactaacagcagatctctcgtcagaaaccctacaagccagaagagagtggggcccaatattcaacattcttaaagaaaagaattttcaacccagaatttcatatccagccaaactaagcttcataagtgaaggagaaataaagtcctttacagacaagcaaatgctgagaggttttgtcactaccaggcctgccttacaagagctcctgaaggaagcactaaacatagaaagaaacaaccggtaccagccactgcaaaaatatgccaaattgtaaagagcatcgatgctaagaagaaactgcatcaattaacggacaaaataaccagctaatatcataatgacaggatcaaattcacacataataatattaaccttaaatgtaaatgggctaaatgtcccaattaaaagacacagactggcaaattgcatagagccaagacccatcagtgtgctgtattcaggagacccatctcacatgcaaagagtcacataggctaaaataaagggatggaggaagatctaccaagccaatggaaagcaaacaaaacaaaacaaaacaaaacaaaaaaagcaggggttgcaatcctagtctctgataaaacagactttaaaccaacaaagatcaaaagagacaaggccattacataatggtaaaagggtcaattcaacaggaagagctaactatcctaaatatatatgcacccaatacaggagcacccagattcataaagcaagtccttagagacctacaaagagacttagactcccacacaataataatgagagactttaacaccccactgtcaatattagacaccaaagagacggaaggttaacaaggatatccagggcctgaactcagctctgcaacaagcagacctaacagaaatctacagaactctccaccccaaatcaacagaatatacattcttctcagcaccacatcgcacttattctaaaattgaccacataattgaaagtaaagcactcctcagcaaaggtaaaagaccagaaatcacaacaaactgtctctcagaccacagtgcaatcaaattagaactcaggattaagaaactcactcaaaaccacacaactacatggaaactgaacaacctgctcctgaatgactactgggtaaataaggaaatgaaggcagaaataaagatgttctttgaaaccaatgagaacaaagacacaatgtaccagaatctctgggacacatttaaagcagtgtgtagagggaaatttatagcactaaatgcccacaagagaaagcaggaaagatctaaaatggacatcctaacatcacaattaaaagaactagagaagcaagagcaaacaaatgcaaaagctagcagaaggcaagaaataactaagatcagagcagaagtgaaagagatagagacacacaaaaaaaaaaccttcaaaaaaatcaatgaatccaggagctggatttttgaaaaaatcaacaaaattgatagaccgctagcaagactaataaagaagaaaagagagaagaatcaaatagatgcaataaaaaatgataaaggggatatcaccacccatcccacagaaatacaaactaccatcagagaatactataaaatatatataaaatacctctatgcaaataaactagaaaatctagaagaaatggataatttcctggacacatacaggttcccagaactaaactaggaagaagttgaatctctgaatagaccaataacaggttctgaaattgaggcaataattcatagcctaccaaaccaaaaaaagtccaggaccagatggattcacagccgaattctaccagaggtacaaagaggagctggtaccattccttctgaaactattccaatcaatagaaaaagagggtatcctccctaactcgttttatgaggccagcatcatcctgataccaaagcctggcagagacacacaaaaaaagagaattttagaccaatatacctgatgaacatcgatgtgaaaatccgcaataaaatactggcaaaccgaatccagcagcatatcaaaaagcttatctaccaaaatcaagttggcttcatccctaggatgcaagggtggttcaacatacgcaaatcaataaacataatccatcacatcttcagaaccaatgactaaaaccacatgattatctcagtagatgcagaaaaggcctttgacaaaattcaagagccattcgtactaaaaactctcaataaactgggtattgatggaatgtatctcaaaataataagagctatttatgacaaactcacagccaatatcatacagaatgggcagaaactagaagtattccctttgaaaactggcacaagacaaggatgccctctctcaccactcttattcaacatagtgttggaagttctggccagggcaatcaggcaagagaaagaaataaagggtattcaattaggaaataaagggtattcaattagcaatcaggcaagagaaagaaataaagggtattcagttaggaaatgaggaagtcaaatcatccctgtttggagatgacatgattgtatatttagaaaaccccatcgtctcagcccaaaatctccttaagctgataagcaacttcagcaaagtctcaggatacaaaatcagtgtgcaaaatttacaagcattcctgtacaccattaacagacaaacagatagccaaatcgtgagtgaactcccattcacaatggctaaaaagagaataaaatacctaggaatccaacatacaagggatgtgaaggacctcttcaaggagaactacaaaccactgctcaaggaaataaaagaggacacaaacaaatggaagaatattccatgctcatggataggaagaatcagtatcatgaaaatggccatactgcccaaagtaatttatagattcaatgccatccccatcaagctaccaatgactttcttcacagaattggaaaaaactactttaaacttcatatggaaccaaaaaagagcccgcattgccaagacaatcctaagccaaaagaacaaagctggaggcatcacactacctgacttcaaactatactacaaggctacggtatccaaaacagcatggtaatggtaccaaaacagatatatagacaaacggaacagaacagaggcctcagaaataatactacacatctacaaccatctgatctttgacaaacctgacaaaaacaagaaatggggaaaggattccctatttaataaatggtgctgggaaaactgactagccatatgtagaaagctgaaactggatcccttacttacactttatacaaaaattaattcaagatggattaaaggtttaaatgttagtcctaaaaccataaaaaccctagaagaaaacctaggcaataccattcaggacataggcatgggcaaggacttcatgactaaaacaccaaaagcaatggcaacaaaagccaaaatagacaaatgagatctaattaaactaaagagcttctgcacagcaaaagaaactaccatcagagtgaacaggcacggcacagaatgggagaaaaattttgccatctacccatctgacaaagggctaatagccagaatctacaaagaactcaaacaaatttaccagaaaaaaacaaacaaccccatcaaaaagtgggcaaaggatacaaacagacacttttcaaaagaagacatctatgcagccaacagacacatgaaaaaatgctcatcatcactggtcaccagagaaatgcaaatcaaaaccgcaatgagatacaatctcacaccagttagaatggcaatcattaaaaagtcaggaaaccacagatgctggagaggatgtggagaaataggaatgcttttacactgttggtgggagtgtaaattggttcaaccattgtggaagacagtgtggcgattccttaaggatctataactagaaataccatttgatccagtgatcccattactgggtatatatccaaaggattataaatcatgctactataaagacacatgcacacatatgtttattgtggcactattcacaatagcaaagactgggaaccaacccaaatgtccatcagtgatagactggattaagaaaatgtggcacatatacaccatggaatactatgcagccgtaaagaaggatgagttcatgtcctttgcagggacatggatgaagctggaaaccatcattctcagcaaactatcacaaggacagaaaaccaaacaccgcattttctcactcataggcaggaactgaacaatgagatcacttggacacagggcatggaacatcacacgccggggcctgtcagggggtggggggctgggggagggatagcattaggagaaatacctaatgtaaatgatgagttgatgggtacagcaaaccaacatggcacatgtatacctatgtatcaaacctgcacgttgtgcacatgtaccctagaacttaaagtataataaataataataataataattttaaaggctgggcacacacctgtaatcccagcactttggccaaggtgatgaatcacttgaggtcaggagtttgagacaagcctggccaacacagtgaaaccctgtctctactaaaaatacaaaaatcagcttagtgtggtggcaggtgcctgtaatcccagctactcacgaggctgaggcaggagaattgcctgagcccgggagtcagaagttacagtgagctgagatcgtgccactgcactctagcctgggcaacagagccagactcagtctcaaaataataataataataataataataataatgttttaaaaaacaattcccatatttcagatgggagaataagatttaaagaggataaaaacctcaaagaaattcagctagtaagtgacagccataggtctgtctaactccacagtcagttatcttagccactggggttaaggtagaaattatgccatatgataatttttctcaatgagtaaatgcaattttaaaaaatgtatatcttcaaatgcttaaagctgctttcttgagatataattgaaatgcagtaaaaatatttaaagtgtgcaacttgatatgttttgacatatgtatgcacctgtgaaaccatcaccacaatcaagataaatagaaatatccatcaccttcaaaagtttccatgcttttgtaagccctccttcccaccattttctagtcttaccctgtgcccaagcacaaattatttttttgaatgtgcaaggtagtaacttgggaaagtctctacttgccaaaggatcatactggctctatccctcatatactggattcatttgattaatgtcacagttagctgatctgtgacttgtgattctcagtgctgaaccctaaattgagtctgacatccaagctaagtacagtaataagagtgatgataaattctctctgagttagaaagctaatctaagaagccagctgggctgattgatttcttcttttcagaaacaaaagatgtagattatttattagatagcctgaaaccctagggatctttttgggctcctgtgtattaggaaaaatgggcttggtatttataagcttttgaaaaaatctctatattgcccagtagagagatttccaggctatgacaaaggtagcatatccagtcagcagctaaattcatttttttaaaaaaacctatcaaattatttatttgatgaatagacctaggtgtgatagattgctgccaggtttttagaaaatgatgtgcaggagccctaaagggcttttctttatcaaattgattcatctatctactttgctcatttgctcatggtgtcctccacccaaacgttaacctaacattttcactctaagtgggagaaaaaaatggtggtgaaggattgtatgaacatctgagccttgatggaccattgcctttggccactgtcccccattcgtctaaatctcagccctgtttatgaaataggatgatagagaaagaaggttaacattatctaaatgatgagagattaatctgtatggttcagctaataagtcataagagtacagggaaaagagcagtcactgtgtactgaggtggtcagggaaggcttcttgaaggaggggctagatgtaggcccagaggaaaatgggaaagaattccaaatgcatctagccactggcatgaccactgtggtaccggcaggaatgagtataacaaatgcaattggtatagaggggaaagggagcatctccaggactgaaggtctctaacagccctgcattgctgacctagaagagatagagacacaaggaaggaaagaggaaagagacagacaactggtgggagtaaaagagtagtttctgatcaatttttctgtctcttttacctcattcagtggcaatcggatgtctgggtcttttaatttcagacaagcccttgcctacccatcaaagataaagcagttctgcttagagcagtttctactagcagcagcagttagcataaaagaaaagtaagtcgcacgaggaatttctgcagagaaaacatttttccttgatttttctgtcaaaagatggaagtatgccatggtgggaaatatctgagacaattcgatctctctgtagtaggccatctggtaaccaagcacttctgatcctccactgatgcccagacatagctcatgcaggatcccagaaagcaatcattcatttaagagagctgaagagaacatctttgcttgttttcatagacacacggggttgaaataaaggtggtctgctctgatctcccaagaaaaaaatttacccaaagtgggctcctggagattgtcttctttatctccctgtcttggggccattttaacgtgatctatttatcccagagaagtgtgcatctccatctcaagagaattttgagatactgttgcaacctttcactactgaatttctccttgtatcttaaagccatagaattattattattatttttgagatggagtctcactctgtcatccaggctggagtgcagtggtgtgatctcggctcactgcaacctctgcctcctgggttcaagtgattaacctgcctcagcctcccatgtatctgggattacaggtgcccaccaccatgcctggctaatttttgtatttttaatagagacagtgtttcaccttgttggtcaggctggtctcgaactcctgacctcaagcaatctacccaccttggcatcccaaagtgctgggattagaggcatgagccactacacccggctgcaaagccacagaattttagatttcaaaggaaccttggagactacttagtctaactgtcccttttaaagaaaaatagaatgttcttgattttagaaaactagataaaaatatttttaattcggaatagaacactacagataaagctggcaactttctcccaatccaagaaaccttcttgtgccttcattttccccccaaaggtaaaaagtgttattggtttctgaattttcttacagaacattttgatacttctacatatgtgaaaatatgtagtattatttttgtgtgttttaatttgtttcaaagatatcatacagtatgcatcttgctttcttcattcatcgttttgagatctagatcattccttttaactgcagttcagtattccactgtgtgaaagcatcacattttctttatccaattctctcttgattcatatttacaaatctgctttatggagagagaactgcatagagaagttgcaggattgcctcaagataagctttggtacaactaaaactagaatctacatctaagatgagaggcagatgaatagatgaatttctcaaaagttatcttgaatgagttaggctcattcatgaaagtcttaattggtccaatatgaagttgaaaccttggctttaagagtgtgaaaattctgaacattcttacttcctagagtgggcgagccaaaaaactcataacccatggtcttatgtgctaaagatcttcaggggtcactcctgagaaagaaaatagctgtgacagagttacatttgtgaataagggaaagcatgctggaacactgtacactctaagaagcatcatgcctcagcccaaaatatttcctctaactttgctcatggggtctgaaaagcctttctttccaacttacagctttgaatcttgaaggtttttcatctgtaaattccctgagaattaaattgatattggccattaacagacacttgatagcttggtttactaggttgcttgctagaacaaagtcattatggaaaatgggtataggatatgcatccaggtacatcgtcaggatgaggcaaagggaacaagaaaggaagaaaatgaacatttattgattacctgctatgtgccaagcaacgttctaggaactttatacatatatttgcacaatgggattagtaatgctactttccatattaggaaacaagagttcagggagattaaataacttgcccaaagtttatttgttcattcatttcctcaataaaattttttccagctacttttgctctatgccggaatctgtgctcagtgaggaaatattttggtgaatatgagacaacaagttttgtcttcatggaattaaaatcaaagaaaatatgtaccatgagcaagccaagataagcatggtaaaggacattggacagtaggcaaatcatatgcaccttgaggtctcatttatttagcgaatatatattgaatacttactacattcaggcaatgagcctgaccctttaggggaatataaaaatgaataagatgctccatactcctaagaatgcttagggtataacatgttcactcaatatttgaataccagcctaaaatctttacgttcaagttcaagtgacaactcatgtttccaagctatttgtcttgtcaggtacaagggtaaatttgtgtcaagcagaggaagaagaaaggaagggtgaaataggtacaaaatgactaaatatcagctaccatctccattaaactggagtgctctataaaagattgcaatcaatagagctagggacaagacagtttttttcaccaactgactgacaggcatatggcacctaattgatataaggtgtcagcaggttcttgttctctgactgtaagtaaaatgacaaaggggttgccagtgtgtctagatatgaggtgttttatttttcctaagatccagagcaaagagaagcatctgctttagaggtagaaaccctgcctaccaccaggataaacttatcagaagccaaatacttgttctccatccagtggtgttctggtaaatgtttaacaaccagatctccagaaaaaatatctatttgctgctttatattgctatacataaatcgtggtggttaattttatgtgtcaacttgactgggccgtgggatgcccagatatttggtcaaacattattctatgtgtttccataaggatatttctggatgacattaacaattgaattggcagaatgagtaaagtagagtgccctctccagtatgggtggccttcattcaatcatttgaaggcctgtatagatcaaaatggcttaccctcccataagcctcccatgagtaagagggggctcctcttgcctgactatttgaactgcaacatcagtcttttctggacttcagactattgttgacgaatggataaggaaattgtggtgtacatatacaatcgaatattattcagcattaaaaagggagatcctgtcaattgcgacaacatggagaacctagaggacattatgctaagtgaaataaaccagacagagaaagaaaaacactgcatgatctgacttatatgtggaatctaaaaaaaaaagttgaatgaatagaaacagttgttggggtgtggggagatgaaggtcaaaaggtacaaaggtgtggttatataggatgaataaatctagagatctaatgtgtagcatggggtctatagttactatagttaataatattgtattgtgtactggaaatttgttaagagaataggttttaggtactcttactacaaaaaaaataaagaagaaagaaaaagaaaggtaattatatgagatgactgttatgttaatttgcttaaaagtaacaattgcctcactatgtatacgtatatcaaaatatcatgttgcacagcttacattatacaataaaaaagtcttaatctaaaaagacactaatgactttattttcagtagtaaagagagcactgatggtccatggtgtgatctggcaatagataaaagcaaaatatcatattgaatactcctaatcaaccacttataagaaacaaagatctggatgatttgtatatgatacacccaaacatttttttgcaaaccaacaaatgtaatgagattgtctggctgctcctgatgttgctagatacaatagagaaagaaaagaatgagctcagggattcaaattcccaggtcaagtgccacataaatgatctgaaagcttctatatgtgccctgaaggagacctttatctcctgtatccataggactgagattgctgaaaatcaaatccagagtttcaacctgaaactggctgaattacaatgaaagttaaacttccagctttgtagattgtctactgataaagtgaaggcatttattgggaagagatgaggtcctgaattttggagtggggatatgtgggaagcccataacgaagctagggacatagagctcctaaattatgacacttctttgccagttaagtaggcctctgtacccccagtggtagcgacttctctacccttgtctgagaggattaaccctgcattgcctgggaaaagtgtaacggcctcccctgaggcagttgctgtgcaggacaatgctgagtcttctcagaacttactcccaccactcctttttgcttctacactgataagtagattcaagccccagcaggcccctaaaagtgaggtacaaaccatgaggaggtatactatactccagaagaactatttgagttttctgtcaacagacagaaatccagggaacatatgtgggaatggatattaagaatttgggataatggtacctggaacataaagttgaatcaggccaaatttgtcgatatgggctcactaactagagattctgcatttaatgttgcagcttatggagttagaaaatactgtaattgtttgggtgaatagctgaaagaaggaccaaaaggcctccagtggcaaattgaaaatgccagacctaccttagtttgatgtagagtttaatgtagaggaaagattcaaaagtttagagattgggatgtttcagtggatttgtcatttaaggtcttctcatttatccttgaaaggtccagaagacatatcattcacataaatttgtgaggggagtctcagcattcttgaagaattctgtggttgctcttctctgtaggccagaccttacagtgaaaactgcagtgactgaattgggaaacctaaatgctatgggagtacctagattctggtgtggcaggggccaagtgcagcactcaactgccaaagacaaggtgggcatggttaccataagggacaacagagtcaaagcagcatcagaatgatctgacttgtgcagacctatggtattaactacttaatcacggagtccctaaaagtgaagtagttaggaagcctactaaattcttacttaatctggatgagcagaaaatttctaggtaaagtgagccaaagtctaacctgaatcataaaaacagatagtcaatcaattttctgactttagccagtttacctacccagaaccccttgaatgaaggggaaaccaggtctcctagaggaaggaccctgatacactgaaaaaatttattctgttaatctttatcccagccttccccaatggggcctatgaccttttaccaaggtaattgtgcatttgggggaaagaaaataatcagatatttgagggactacaagacactggctctgaagtgaaaataattccaaaatatcaatgtggtccactagtcacagtagggggttatggaggtcaggtgatcaaagaagttttagctcagatctgtctcacagttggtctagtgtgtcttcaaacccatcttgtgtttatttttccagctccagaatgcataattggaatagatatactcaacagctggcagaattatcacagtggcttccagacctatagagtgtgagccattacggtggaaaaggccaagtgaataccactagaattgcctctacttcagaaaatagtaaaccaaaagtaatagcacattcctggcaagattgcagagattagtgccaccattaagcacttgaaaaatggtgatggtgattcccaccatatcctctttcagcttgcccatttggcctatgcagaagacagatggatcttcatatgacagtgtattactgtaaacctcttgcagctgctgtactagatatagtgtcattgtttaagcaaattaacacatcccttgatatatacatagtataaatgtattagtctggcatatgtctttttctccatccctgtacataaggcccaccagaagcagttcgcttttatctggcaaggccagcaatacaacttcttggtccaacttcagagtatatcaactgttcacccctatgtcataatatagttcagagggattttgatcacttttcccttccacgagctatcacactaattcattacattgatgatattctgctgcttggacccagtgaacaaaaagtagcaactattctaggcttattggtaagacatttgtgtgccagagagtgggtaataaatctgacagaagttcaaggaccttccacctcagtaaaatttcttggagtccagtggtgtgaagcctttcaagatatcctttccaaggtgaaggataagttgctacatttggcctttcctacaatgaaagaagcacaatgctgagtggacctctttagattttgaagacaacatagttctcatttgagtgtgttactccatcttatttaccaagtgacctgtaaacctgctagttttgagtggggcccagaataagatccaggctgctgtgcaagcttctctgtcgcttgagctacatcacccagccgaaccaatgatgcttcaagtgtcagtagcagatacggaggttgtttggtgcctttggcagtcccctagaagtgaatcacagcgcaggcccttaggattttgccatcctctgtggttaactaatccccttttgagaaacagctcttagcccgctactgggccttagtagagactgaatgcttgaacatgggacagaaagttaccatgcaacctgagctgcacatcatgaacttggtgttttctgacacaccaagctataaagttgggggtcacttcatcatcaaataaaagtgatatatacgtgataaggcctgagcaggttctgaggacaaatgtaagttaaatgaagaagtggcccaaatatccatggttccctctcctgctacgccgtcttctgtctcccagcctgtacctatggccttatgaggagttctctattatcagttgacacaagaagggaagactcaggcctggtttacagacagtttgacacaatatacaggcaccacccaagagtaaacagctgccacattacagttcattttaggatgtcccttaaggagagtggtgaaggaaaatcctctcagtgggcagaatgttgagtagtgtacctagttgttcactagcttgaaaggagaaatggctggacatgagattatatactaattcatgagctatagccaatggtttggctggatggtcagggacttgaaaggaacatgattagaaaatttatgacagggaaatttgggaaagaaatatatggatagacctctctgaatgggcaaaaaagtgaagattttgttccccatgtaaatgctcaccaaagggttacctcaacagaggaagattttaataatcaagtggacagtatgatctgttctgtagatagcagtcaggctctttactcagccacttccatcatcaccaatgggtttatgaagaaagtggtcatgatggctgtgatggaggtaatcgatgggctcagcaacatggactcccactcaccaaggcgtacctggctacagtcactgctgagtgcccaatctgatagcagcagggaccaatacctcctgcaaaaactatcattcatggacttacagaatgctttatccaccatcatattattccacacagcattatttttgatcaaggaactcacttcacagcaaaagaggtatagcagtgagtccatggtcatggaattcactggtcttaccatattcttcactatcctaaagcagctggcttgaaagaacagtggaatggccttttcaagactcagttacagaatcaacttggtaacaatacttttaaggttagggcaggttcctccagaagggtctatatgctctgaatcagcatccaatatatgatgctgtgctcccatagccaagattcacagttccaaaaatctaggggtacaaatgagagtggaatcgctcattattacccctagtaacccactagcaagatttttgtttcctgctcccatgaccttatgccttgctgacctagaggccttagttccaaaggcaggaatgcttctaccagaagacataacaacaactccattgacttggaaattaagactgttgcccagccactttggtcccctcaagcatcttaatcagcaggcaaagaagggactcatggtgttggctggtgtgattgagcctgaataccaatggaaaattgaactactactccataatgaaggtaaggaagaatatgtctgaaacacaggagattccttagaggatctcttaatattaccatgccctgtgattaaggtcagtgaaaaactataacccaatccaggcaggatgcttaatggcccagaaccttcaggaataaaggtttcagttatcccaccagataaacaaccgtgaccagctgagatgcttgtgaaggcaaagggaacacagaatgagtagtggaagaaggtagttataaatgctaactgtgaccacatggccagttacagaaattagaactataattatcatgcgtatttcttccttattttataacgaatattatattattccattctcacactgccataaaggactacctgagactgggtaatttatgactaaaagaggtttaattgactcacagttccgcaggctgtacagaagcatggctgaaaggcctcaggaaacttacaatcatggcagaaggtgaagaggaagcaagcatgtcttaccatggtgaagcaggaaagagagagcaagagcgaggggggaagtaccacactttaaaaccatcagatcttgtgataactcacttactatcatgagaacatcatgggagaaatttgcccccatgaaccaatcacctcccacctggtccctcccctgacatgtggggattacaattcggcatgagatttgggctggcacacagagccaaaccatatctaataagtttgtgtttatatatattaagcaaccatctttgtattatttccttttttattcctttatcatgaaatataaaatgtattaactttacatcgtggtaattaagttgtgagacatcaaggcaaagagtaaacatcactcaaggattttacctcctcttctagaaaaggggttagtgaattttcagttgtacacaggacagttgcatcatgttaggctgaattatgaccttgttattgtttttatttggggatgaagtgtggtttaatgagatgtgtttaggtgccaaattgacaaatggtggacatgtgatgcttaattttatgtctcaacttaactgggccatagggcgccaagatatttagtcagatgttattctgggtgtgtctgtgcaggtatttttggatgagcttgacctttgaattggtaaactgagtaaagcagattgcccctgttatgtgtgtggacctcaatccaatcagttgaaggcctaactagaataaaaatgctgactctcttatgagcaagtggggactcctcctgcctgaccacttgagctgggacatcagtcttttttttgcctttgaacttgaactgaaacatcagctttttaggggtctcaagcctgctggtttttgaactggaacatgcatcatcagctctcttggttctcaggcttttggaatcagactagaactacaccatcagctctcctgggtctccagcttgctgactgcagatcttgggatttctcagcttccataattccatgagccaattatttataataaatctctctcatatatacatatacggatatatacatacatacacatagatagtcttctctgtatatacatatacatataaatttatgtattagagttctccagaccaacaggatgtgtgtgtgtgtgtgtgtgtatatatatatatacatatatataatatatatatatattagtcacagtcttcaggctaatgggatgtgtatctctgactaatacatagatatattgcagattttattgatataaatgatgtgtagcacacaatttagaaataataatgaaatatacaatactctattgtaaattccatatagcctattgaatctcacaaaatgctttcaatgacttttgctgaagcttgtatccttagctgggctatgtttgtaattgatgaaggagtcaagttttgatatgaacattggttgatatttttatttaagttaatgagtgaaactaaaatgaaaaaacaatgatgtatgttgaaattttattcatccatcaatgacatgaatgaattcattgattaatctgaattcaaatactaaaagaatatttcctcaatttttgtgcaatttacaattttaataaggtatagaacatataagaaactgcacataaagtgtaaaatttggtgggttttgacatatatcccattaaactcctgaaatcaccacaaatgaacatatctatcacactcaaaagtttcctcctgtcccttttgtaatgcctctgcatccccatcatccacaggcaaccattgatctttttctcactatagattcattttaattttcaagaatattgtataaatggaataataatgtgtatactctttttctcttgcttcattcactcaccatacttattttgaaatttatcaatattgtagcatgcattgacaatttattccattttactgctgaatagtattccattatatgaatacacctcaatttacttatccatttacctgttgaagaacaactggattgtttccagtttggggctattaaaaataaagccactatgaaaattcacgtacaatttttttgtatggacatatacattaacttttctgggataactacttagttatttttagactggatcatacggtacatgtatgcttacttttaaaagaaattgctaagctggtttacaaagatgtaccattttttcattccctctagcagtatatgagagttctagctccttcacattctcacccacgcttggtatggtcagtcattttaattttaggtttaacttaatagatgcataatggtgtcacattgtggatttaatttgtatttacctaaaaactagtgatgctgagcaacttctcatatgcctgttttccatttatatatcctttttggtgaagtatcttttcaaatattttgcccaacttaaaaaccagattatttgtttcaattttggggtgttttaagagtctttatatgttctgaatgagtcctttatcagattatgatttgcatatattttcccagtctgtaactcatgttttcattttctcaatagtgtctttagaacaacagataattttaattttgatggagtgtgattaatctttcctttcatctattatagattatacttttgatgttatatcgaagaaatcattgcttagctcgtggtcacaaagatttttcattatatcttattctagtcatttatgattttaggccttacacataggtctgtgatccattttgaattaagttttgcatatggtgtaaagtatggctcaaaggtccttattttcacatggaaatccaattgttccagcaccttttgttgaaaaagacccttctttatccacgaattgcctttacctttttcagacatcagttttgtatatatgtgtaggcatactactggactctttttttccattaatctatttgtctctcttgatgctactaccacatttcttgattgctatacctttatcaaaagtccaatgtgtacatctttcatttcttattatttccttctagcactagccaaaacatccagtataatactaaataaaagttgcaagagtggatatctttgctttgtttctgatcttaggtggaaagtattcattcttccataatgaagtatgatgttagctgcgggtcttttttaaacaactttattaagatataattgacatataaaaattatatatacttaaaacgtatgacttgatgttttgttataaatatacattgtgaaattattaccagctaattaactaattaatggtaacctttacatagttaccatttgtgtatgtctgttgagatataatttaagatccagcctcatagcaaacttcaagtatataatatagcattttttactattgtcaccatgttgtatattataactccagaacttattcatcttgtaagactgaaattggggctattaaaaataaagccactatgaaaattcaccaacaatttttttgtatggacatatacattaacttttctgggataactacttaggtacttttagactggctcatacggtacgtgtatgcttacttttaaaagaaattgctaaactggtttacaaagatgaaatgttgtaccctttgaccaacattacccaattcttccctcctccaactatccaactctcttcttccttgaatttgactatctcagattccacatattaaatgagatcatgtagtatttcaatttctgtgtcttgcttatttcacctagaatgatgttcatcagttccatccatgttgtcacaagtggcaagattttcttcttctttaagactaaataatatttaattatacacacacacattaaagttatttccatattttggctattgtgaataatgctgcaatgaacataggagtgaatattaactctttgtgatgctattttcaattcctttggctacatacacaaaagtgggattggtggatcttatggtagttctatttttaattttctgaggaactttcataatgttttccataatggctgcactaatttacattcccacaagagtgtacaaaaattcccctttctctacatcctcaccaacacttatattttgtttttttttgtaatagccatcttaacaggtgtgaggtggtatcttactggggttttcatttgcatttctctgatgattagagatgtttaacacctttgcatatgcctgttggccatctgcgtttcttcttttgagaagcgtctatttaggttctttgcccattttttaattgggttatttgtatttttggtattgagttgttatgagtttcttatatatgttggatactaaccacttatttgatacatagtttgccaatactttttcccattctgtgagttgcctttttgttttcttgattttttcctttgccaggcagaagctttttagttggtgtaataactcttgtctatttttgcttttgttgtctgtgctttcggagttacatcctaaaaattatagacaagatcaatgttaagaaggtttttccctatgttttcttctagcagttttgtagtttcacgtcttatgtttaaatctttatttaagttttgtgtacagtgtaagatatgaatttaatttcaatttttgcatttggatatccagttttcccaataccatttgttgaagagtctatcctttttccattttgcgtttttgacactccgaagatcagttgaccataaatgtgtgcgtttattttttggttatctgttctattctattgatcggtatgtctacttttatgctggtaccgtaatgttttaattactataatataacttagagtcaggaaatatgatgcctccagcttatccttttgcacaagactgctttggctgtttcaggtcttttgtagttccatacaaatattaggatttttttttctattttttaaaggccatttgggattttgataggaattgcattgaatctgtagatcactttgggtagtatggacattttgaaaatattaattattctagtccataaacttgggatctcatctcatttatttgtgtcttttctagatttcttcatcaatattttatgattttcagtgcatacgtcttacaactctttggttaagttaattcctaagtattttctttttgcttgttcttgtctctaatgtaaatgggatttttttttttaatttttcttctggataggtcattgttggtgtatagaaatgccactgatttttgtatgatgatgtatttttctacaactttactgacttatttattagtgctaacagttttttgtgtgtgaattctgtagggttttctacatacatgatcatattatctgcaaacaaataattttacttcttcctttccaattttcatgccttttatttctttttcttgcctaattgctctgggtagaactttcagtactacgttaaatagcagtggtgagcatgagaatccttaccttcttctggatcatatagaaaaagttttcagtttttccccattgattatgacgttagcctcgagtttttcacatacggtctttattgtgttaaggtaagctttttctatatttatttacttattttattatttatttattcagagacagggtctcactctgtcagtgagagtggcactccaggctggagttcagtggcacaaacatggctcactgcagcctcgatctcttaggctgaagtgattctcccatgttagccttccaagtagctgaaattacaagtgcacaccaccacacctgggtaatttttctattttttacagagacaaggttttgccacattgcccaagctaggctcgaactcctgggctcaagcaatcttcccacctcagcctcccaaagtgcaggggctataggtgtgagtcatcatgcccagcctccatattcattttgttgagttttatcatgaatagatggtgaatttcataaaaaaatttttctgtatctattgagatgatcatgcagcttttttattctgttaatatagtatacgacattgattaattttcatatgtatatgttgtattctcctttcttagggataaattctacttcatcatgtaacatgatttttttgttgttttttgttgttgttgttgttttgtttttcttttggagacggagtcttgctctgtcgcccaggctggagtgcagtggtgcaatctcggctcactgcaagctccgcctctccgctttgctccattctcctgcctcagcctcctgagtagctgggactacaggcgcacgccgccacgcccggctaatttttttcttttttgtatttttagtggagatggggtttcacagtgttagccaggatggtcccgatctcctgacctcgtgatccgccctcctcagcttcccaaaatgctgggattacaggcgtgagcccccacgcccggctgtaacatgatctttttagtctgtcggggggtgtggggctgggggagggatagcattaggagaaatacttaatgtaaatgacgagttgatgggtgcagcaaaccaacatggcacatgtatacctgtgtaacagacctgcacgttgtgcacatgtaccctagaacttaaagtaataatatataataataattatataatatggcacctatggaaatcatattagtcctccttccagggtttattgctattgctgtttgttattttgttgttgctgctgttttttttttttctatttagtgaatttcccggactaattttaaaaagtttgtgttctttattgtatacagtcactcaagtctctgctcaattatcttagtcgccagtgattggacagagatttatttaaatgccttgaactaataattctcccaccttttgctgacgtggagcaaccctcaattccctggcaagcagttaataattctgccttaatcttcatttcttgtttgtgcagagcatcaaggtcactcttacatgagtgattagggccttctcaggtgctttctgggcatagacacagccatacatttgtcccccacccttcagaatcccaggaaaatttcagagctctttaaagctccctgtaaacatctcattcccgatattttccttttaagttttttgtcatcctctattttgctccaactagtattatttcctcagggaactatagtgttaaacaattgccatggattttgtaaattattttaaaaacaatttttgtgggtacagacagtctacggatagggttttcctcactgacaaagccctggagtaaggtcaaaataaagacaagcttttcccgggattttccagacagctcatatagtcacagctctctggtgatgggtctttggggagctccaaacccattctgtcttctccagtggttactagcctgctgaattttccagttgctgtatttctgaagttgcacgttttcaaagctaccatcaagcaggagagtggattatcagactacagcaagtaaaaatgccacagtgctatctgttccaataaagatttaactgtttttcttgaataaatgcttcttagattgttgcaagtgtttggttaatttccagagttctgaaaagtcattttttttttcctagtgttctcattgcttttatgggggaacagattaatgttctccttaatacctatggaagaccctgtgcagatatttggggtactttctctgtacaactatctcttatccattaccctctcctgtgatctctagctaccttcaccagaagtccaccaggctctgcttcagttccctctccctgaaccatgacctggaaactctctcaaggtagcaagcttagaaaattatagaacccttctaccttgtttcccatcactcagagaccactgcttttcattggctagtgccctgtgtcctgaaaatcaccatataatatgttttattttattttttggttgtttcaagtaggagattaaatttagtccctgttactctattttagccagaagtataaatcccctccatgacacacttttaagtttaatatgcattattaatattttcctcatcacttctttaattctaaactgtcgacagaacagtaaatctagcactgatttatagcatttgccaacttatattgtatatatactcccgctatggccaatttcaagttaacaacatatgtaatatttctacaacatatgtaatacaatagatataaataacctcaggagcatagattctcctgtaaatgaagtaaaataaataggaaattactttgttttcattattactttgtttctaatgtaatttgtttaattgtaagttgaaataatttaatttttaataactatttaaaaacagcttacaaagtttctgaaaatttaacaatctgttcttgtgagatagtatgagccatctgtagtacactactgcttctgtctctagagattagaatcactgtggaaacatcactataagccagtatgcaaggagaagaattcatccacctagggatatgtgtgcatgctccctgctcaccaagggcattaagctaccctaacaaatataaaaagcaagcgtttcaccacttttttctctccagaggaaaaatattattctcagaattccaccattaaaaattcattactaaagatcttgaagtcttttcaatttctaagaatcctctattaaaatggcaaggtatttcctgtgagcagtaatactttaagccttttaatcggctaatacctttatggatggtacatagctaagtaagaacaaggccttgtgtcattagctcctaggctctgtgcttggcagaggcagtggaaatagatgtaggagggaaattaaaaagggaaagtagcaatactccaatttaaaagtgtctttttaattgactttcagaaagtcagtcccaatatatccatatataggactgagtttttacatactaagaaaatagctggtgcctcctcctatcttggcctgactacccactagcagtgaaggtcacatgagctgctaaccattttgtcttgctcatctccaggagaacattctaatgttggaggaaaaattgaaagaagaaaaagataagaagtccatctataaacctcaaaagtttaaaatatctttacaacagtagccatgccaaaatattaaaaagctagaaatgttcagcagtttatgtaagaaaaggaagcccataatgagaaacaagagaaaaatgaggaagaataattttctaaagacaagggggtttgtgaggaaattgtcacttttgatgagttcaagataatattttttctcaagatttaaaaattaaattagaaatgggtgatatttggcagcccattcataaatatgtagaatgtatacaacctttgaagaaggagggtgccacaagccagaccaagctcctctaaccacaatcagcaattcctgtacaaagctgttagacccacgcaccaagcacgcagtgcaaattcccagtcagctacactgagttcccaggggcagaacaatgctgacctttgcccctgtaaaaattttgtatcgctctctcttgtgcctcatactcacgtagtaaagttttcttcctacttcctaaccccaaaccctaggcaacctctcaatgcctactatgcgtggagtctattaatagtaatttagcctgcaaaactctagaaggaaatgagcagaattgacttgtccccatctacacagctgttggaatatgaataccgtcttcagatttctgaatttttctaaggcaagaagaaatctaaagtggggaaggtctctgtcactaaaaaggattgtaagcacggtccaacttggtaaagggcccaaggaaagaatcatctctggagcttaaaaggaacatggtggcagaagggcaagagatgcaagacagggtaattgtaacctgaggcagtgggagaggcagaacactgaaaggcagccaaagtttgcagccaagaaggacgcatttcatatcagtatttaatccatagaggaaggtagatgcgatgggtatctgggagaatagatagcatgagagaaggaggattgaattgagtcaggagatgaaaaacgtgttgagcagagctattatatgtgttagtgtgctcctttatttacatgggggctcagcacatatcgaagaactagattaaatgcttaaagaaattaaattaaacttacagcaatattttatagggcccatagagagcatcctgacttccaggtgatctttcctccagatttctgaagtactgaggttaagttatgaatgatagaatcataagcaatcattaacaggcaatagagagaccctgggaatagtcttaatttttggaagggacacaagggaagaaaacctcttataacaacatactcctcagagtttctattagaggaaagatcttgggctggtttcccttaagatggaaatcacaatgatcaggattcattaagatgcctttgagcagtatgactgttatttctgggaaacagcactcaagaggctacagtcacagacctcaagatatcagagcaactccatctctgagttgagatgtactaccttctgagtacaggtttacaatccaaacttggattgcccccgccccagtgtcaaaaggaattgagattctatctggattatctagtttatttcatctataaaacagcctaaactgataactgaatctcaaacttcatttcttttagtctgaatcatcctgtttgcctgtcttcatagtataaacaaatagctaactgataaatgtgccctcctttggtgctgtatctaacccaatagtctctaagtaccataattgttggtaatactttgcaaacttttatcgtgttaataaataattgatgttagggctgacatcgataacaatcaccttgtctatcgccctcatttttcagaaaaggaaatgaagacataaagaagcggtaatgtggccgggcgcggtgactcacgcctgtaatcccagcactttgggaggccgaggcgggcggatcacgaggtcaggagatcgagaccatcctggctaacacggtgaaaccccgtctctactaaaaatacaaaaaaattagccaggcgtggtggtgggcgcctgtagtcccagctaatcgggagctggggaggctgaggcaggagaatggtgtgaacccaggaggcggagcttgcagtgagccgagatcgcgccactgcactccagcctgggcgacagagcaaggctctgtcaaaaaaaaaaaaaacggtaatgtgacttgcctgagttcacgcttcaagttagtggcagagctgggactacaatccacgtctcctaattcccaggacactatttttaaactgcaccaatttacaaatagaggtacataccattgctttcagaaatgttccctgataagtttttctctttcattttgaagctgttctattgtaacattttaagtcttaatgttttatgtgggggcaggcaggaatgtgcagaattaaccactttgcaggaaacatgaccttgtacaaaagtaaaactctctgagtaacaataagcttgacctggttttagagcacccgatatgcaaaatgagaaatttataagataatcgcactgaaggtgattgcagtataagggagtactcagcagaacttcttgagtgcatttaagcatttaagatcattatttggcagaactctctggggccgagaaacaaagttaaaacgttaaaagttactgccaaatgaaaaccaaaaaagcaaattaagcatctttgaagaataatagaagtcatgaagaaatagaatctatttgacaggaactcagattctcctggaaatatcagggccctagtcatcagccttaatgaatggcctttctcagtcacacagatagcagcactgtaactcctccagtcaccagggcttaaacttggatattatttgaaggttcctcctatgcctcattctctagagtttattcactaacaaggcttgttttatcttcctttgaaataactctaaaattctcgtcttctccattcagactgccaccattctagatagaatctataaacgtatgacacagtcccattctcccctactctggttcaccattgacacagccataggagtcaccatataacatacagctttcttgatcacttctttaagaacctagagtgtctcttcaatgcctataagatcaagtcacagcttctcaaccagatgttcatcaccctccaacaagtaggcccagcttacttactcctacattcttccctctctttctaaatattgccctatccaaaacagtaccaattctcacccctgacttccacccctaccccacatataataaaagttttctcctagctcctacatctgtctatctatatcctacccagcctttaaaaatcagctcaagttctacctcttccatatacctttcctaaccaccacccaataacttcagctaacactgatctttacaatttcatttagtgctagcaatgctatagacactgatatcctccatgtatttttataattggaaaaaaatagcaggtaaaatttggaactcatttaacaaagtcctgccctgaaacagaaggatggtcaaatgtttatacaagcatacctcggaggtattgagggttcagttctagaccactgcaataaagtgaatgttgcaagtcaaatattttcatctcccaatgcatataaaatttatgtttacactatactatagcctattaagtatgcaataacattatgttaaaaaacaatatacaaaccttaattttaaaatactgtattgctaaaaaatgttaacgattatctgagttttcagcaagtcataatctttttgctggtggagggtcctgccacaatgttgatgactgctgactgatcaggctgactgataagggtgggggttgctgaaggttgaagtggctgtggcaattttttttgttttgttttgttatttatttattttttttgttgtttttattttattttattttattttattttattttattttattttattttattatactttaagttttagggtacatgtgcgcaatgtgcaggtttgttacatatgtatacatgtgccatgttggtgtgttgcacccattaactcatcatttagcattaggtatatctccaaatgctatccctcccccctccccccaccccacaacagtccccagagtgtgatgtttcccttcctgtgtccacgtgttctcattgttcagttcccacctatgagtcagaacatgcagtgtttggttttttgtccttgcgatagtttgctgagaatgatggtttccagtttcatccatgtccctacaaaggacatgaactcatcattttttatggctgcatagtattccatggggtatatgtgccacattttcttaatccagtctatcgttgttggacatttgggttggttccaagtctttgctattgtgaatagtgccgcaataaacatacgtatgcatgtgtctttatagcagcatgatttataatcctttgggtatatacccagtaatgggatggctgggtcaaatggtatttctagttctagatccctgaggaattgccacaccgacttccacaatggttgaactagtttacagtcccaccaacagtgtaaaagtgttcctatttctccacatgctttccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggtttttttgtttttttcttgtaaatttgtttgagtttattgtagattctggatatgagccctttgtcagaggagtaggttgaaaaaattttctcccattctgtaggttgcctgttcactctgatggtggtttcttttgctgtgcagaagctctttagtttaattagatcccatttgtcaattttggctttggttgccattgcttttggtgttttagacatgaagtccttgcccatgcctatgtcctgaatggtattgcctaggttttcttctagggttgttatggttttagggctaacatttaagtctttaatacatcctgaattaatttttgtataaggtgtaaggaagggatccagtttcagctttctacatatggctagccagttttcccagcaccatttattaaatagggaatcctttccccattgcttgtttttctcaggtttgtcaaagatcagatggttgtagatatgtggcattatttctgagggctctgttctgttccattgatctgtatctctgttttggtaccagtaccatgctgttttgattactgtagccttgtagtatagtttgaagtcaggaagtgtgatgctttgttcttttggcttaggattgacttggccatgcgggctcttttttggtcgctatgaactttaaagtagtttttttccagttctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattccttggtattttattctctttgtagcaattgtgaatgggagttcactcatgatttggctctctgtttgtctgttattggtttataagaatgcttgtgatttttgtacactgattttgtatcctgagactttgctgaagttgcttatcagtgtaaggagattttgggctgagatgatggggttttctagatatacaatcatgtcatctgcaaacagggacaatttgacttcctcttttcctaattgaataccctttatttccttctcctgcctaattgccctagccagaacttccaacactatgttgaataggagtggtgagagaggcatccctgtcttgtgccagttttgaaagggaatgcttccagtttttgcccattcagtatgatattggctgcgggtttgtcacagatagctcttattattttgagatacgtcccatcaatacctaatttattgagagtttttagcatgaagagttgttgaattttgtcaaaagccttttctgcatctattgagataatcatgtggtttttgtctttggttctgtttatatgctggattacatttattgatttgcatatgttgaaccagccttgcatcccagagatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcatcaaatgagttagggaggattccctctttttcgattgattggtatagtttcagaaggaatggtaccagttcctccttgtatctctggtagaattcggctgtgaatccatctggtcctggactctttttggttggtaagctattgattattgccacaatttcagatcctgttattggtctattcagaggttcaacttcttcctggtttagtcttgggagggtgtatgtgttgaggaatttatccatttcttctagattttctagtttagttgcgtagaggtgtttgtagtattctctgatggtagtttgtatttctttgggatcggtggtgatatcccctttatcattttttattgcatctatttgattcttctctcttttcttctttattagtcttgctagcagtctatcaattttgttgatcttttcaaaacaccagctcctggattcattaattttttgaagggttttttgtgtctctatttccttcagttctgctctgattttagttacttcttgccttctgctagcttttgaatgtgtttgctcttgcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggattcaaagaacatctttatttctgccttcatttcgttatgtacccagtagtcattcaggagcaggttgttcagtttccatgtagttgagtggttttgaatgagtttcttaatcctgagttctagtttgattgcactgtagtctgagagacagtttgttataatttctattcttttacatttgcggaggagtgcttcacttccaactatgtggtcaactttggaataggtgtggtgtggtgctgaaaaaaatgtatattctgttgatttggggtggagagttctgtagatgtctattaggtccacttggtgcagagctgagttcaattccttgatatactttttaactttctgtctcgttgatctgtctaatgttgacagtggggtgttaaagtctcccatttttattgtgtgggagtctaagtctctttgttggtcactaaggacttgctttatgaatttgggtgctcctgtattgggtgcatatatatttaggatagttagctcttcttgttgaattgatctctttaccattatgtaatggccttctttgtctctttgatctttgttgttttaaagtctgttttatcagagactaggattgcaacccctgcctttttttgtttttcatttgcttggtagaccttcctccatccctttattttgagcctatgtgtgtctctgcacgtgagatgggtttcctgaatacagcacgctgatgggtcttgactctttatccaatttgccagtttgtgtcttttaactggagcatttagcccatttacatttaaagttaatattgttatgtgtgaatttggtcctgtcattttgatgttagcgggttattttgctcgttagttgatgcagtttcttcctagccttgatggtctttacattttagcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagggtgttgaatattggcccccactctcttctggcttgtagagtttctgccaagagatccgctgttagtctgatgagcttccctttgtgggtaaccccacctttctctctcgctgcccttaacattttttccttcatttcaactttggtgaatctgacaattatgtgccttggagttgctcttctcgaggagtatctttgtggcgttctctgtatttcctgaatctgaatgttggcctgccttgctagattggggaaactctcctggataatatcctgaagagtgttttccaacttggttccattctccctgttactttcaggtataccaatcagacgtagatttggtcttttcacatagtcccatatttcttggaggctttgttcatttctttctattcttttttctctaaccttcccttctcgcttcatttcattcatttcgtcttccatcactgataccctttcttccagttgatcgcatcagctcctgaggcttctgcattcttcacgtagttctcgagccttggctttcagctccatcagctcttttaaggacttctctgcattggttattctaggtatccattcgtctaattttttttcaaagttcttaacttctttgctattggtttgaatttcctcctgtagctcggagtagtttgatcgtctgaagccttcctctctcaactcgtcaaagtcattctccgtccagctttgttccattgctggtgaggagctgcgttcctttggaggaggagaggtgctctggtttttagagtttccagtttttctcctctgttttttccccatctttgtggttttatcttcttttggtctttgatgatgttgacgtatagatgtgtttttggtgtggatgtcctttctgtttgttagttttccttctaacagacaggtccctcagctgcagctctgttggagtttgctagaggtccactccagaccctatttgcctgggtatcagcagcggtggctgtagaacagcggatattggtgaaccgcaaatgctgctgcctgattgttcctctggaagttttgtctcagaagagtacccggccgtgtgaggtgtcagtctgtccctactggggggtgcctcccagttaggcttgtcaggtgtcagggacccacttgaggaggcagtctgctcgttctcagatctccagctgcgtgctgggagaaccactactctcttcaaagctgtcagacagggacatttaagtctgcagaggttactgctgtctttttgtttgtctgtgccctgcccccagaggtggagcctacagaggcaggaaggcctccttgagctgtggtgggctccacccagttcgagcttcccggctgctttgtttacctaatcaagcctgggcaatggcaggcgcccctcccccagcctcactgccaccttgcagtttgatctcaaatggctgtgctagcaatcagcaagactctgtgggcgtaggaccctctgagccatgtgcgggatataatctcctggtgtgccattttttaagcctgttgaaaagcgcagtattagggtgggagtgacccgattttccaggtgccatctgtcacccctttctttgactaggaaagggaactccctgaccccttgcgctgtccgagtgaggcaatgcctcgccctgcttcggctcgcacatggtacgctgcacccactgttctgctcccactgtctggcactccttagtgagatcaacccggtacctcagatggaaatgcagaaatcacccatcttctgcatcactcacattgggagctgtagactggagctgttcctattcggccatcttggctccacccccggcaatttcttaaaataagacaacaattaagtttgccacatcgattgactcttcctttcataaaagatttctctgtagcatgagatgctgtttgataacattttacctgcagtaaaacttctttcagttttggaatcaatcttctcaaaccctgccactgttttatcaactaagtttatgtaatatgctaaatctgttagtgtcatttcaacaatgtttcacagcctcttcaacaggaatatattccatctcaagaaaccactttatttgcttatccataagaagcaactcttcatgcgttaaagttttatgagattgcagcaattcagtcacatcttcaggctccacttcgaattctggttctcttgtagttttaccacatctgcaggccatcatttgaagggttcctcaatctttctttcccacaagatggaagtatcatctattggaacatcttaaatgtacttcattcatgacatatttttcatctattacagaatcagagaatcttaagactatatgagaggggaagggactttggatcataaatcatacattgtacatgaagaaactgaggttcacttctgtttcctgggatttctttttttaattttatttagatttggggatacatgtgcttgtttgttacatgggtactggtggggaatgggcttctagtgtacccattatccaaatagtgaaccctacctgatagatattttttcaaccctcattccccttctatcatccccatttctggagtcccagtgtctattatttccatctttatgttcatgtgtgtccactgtttagttcccaattagaaatgagaacatgtggtattggttttctgtttctgagttagttcacttaggataatggcctccagctccctccatgttgctgcaaaggacatgatttctttctttttatgtctacatactattccacatttttttaaatccagtcaactgttgattgtttcctgggatttctgatatgttttcattccccttagaaagccactgctgttaaatcaataaaataatttaggaagaagttcagcagtatgtgttgagagctttaaaaatgctgccaggttttggtccagtaatttgacttctaggaagctatactgagcaaataacctggatatatgtgaagatctttatgtacagaaatatctctctcagcttcatttacaataatatagatcaatgaaagaaatcttaaatattcccaagcttgagactagttaaatacattgtagtatacctgacatgaccgaatgaaacattatgtagccattttagtagagtattttaacacagaatggtagaaagcatactatctcaatctcacctgtcagagctacttccccacaagagaaattggtggtgggaagggcagtatatgcaaagagtgttattacagataattatgtatgaaaaattcctacacaatattaagtaaagaaaactgggtagaaaaatgtgtattaaggatgagttaatttaaaaatgcataggggaagaagactggaaagatttattttaagccatatagttttattttatgtattcatgatttgctggtttaagtaattttttgcaatttttgttttgaaataatttcagacacatagaaaaattacaaaaatagtaaaaagaactcccatgtacctttcatccagattccctaactgttatcatttaaaaacaattttgtaggccgggcacgttggctgacgcctgtaatcccagcactttgggaggccaaggcagacagatcacgagatcaggagtttgagaccagccttgccaatatggtgaaacctcgtctgcactaaaaatacaaaacttagccgggcatagtagtgcatgcctgtagtcccaactactcgggaggttgaggcagaagaatcacttgaacctgggagatggaggttgtagtgagccgagatcgcaccactgcactgggcaacagagtgagactctgtctcaaaaataataataataataattaattaattaaataataaaataaaacaattttgtaaagtagtccctttgtcccatttaaggaagtttggccaataagctcctgtgtgaacattgtcatattacattccaaagtaaaggggcaacggaaatgggacaggctcatttctgatggcctgtgggatctgggattaaagacaatccaagactagtaatgaaatgcaagacttttaacgaattacgctgcttattatttgctgtttcagtgtgtttccattctgcttttaccttgactacttcaaagaatatcacgcagacaaagtgataatgagtgttgagcaacagatttaaaatcccccatgcagctgaatgacttaagggaaacaaatatataactttttacttatgtcttcacctcagtgaaaataaaatatattgatttcatccagatgtcagtggttatacaaacctcccctggacattggagagaaggagaggaaaaagcttacaaaaataaaatcacacgtgtttatagccatgaaaatacattattcaaatgaaagtactgacattttaacataggcactgcatttttaaccttaaaattgaaagagtcccctgtattatagtccttttagagtcagaagagaaatttgggtcatttggcactatccaataaaactttccacaatgatgaaaatgttttatgtctatactttccagtacagtaaccgtgagccacatgtagctattgagtgcttaaaatgtggatgatgcaactgaggaattgaatttatttcattttaatttatttaaatttaaatagccacttgtggctagtggctactgtactagacagcgtgctagactaccatcctaagtagaaatttcttttccagttcccctgatctctttgcattctccctcgtgatcatatcaattcctaacagctccagttaccacttataatatgatacatcatcctggctgcatgttaggttcacctggggagctattttaaaatgtcattgtggagaggaggggtgacctaagcatggatatttgtaaaagggtatttaatatgtagccagggttgagaacctttgatcaatatgcaatgattcccaattttatattactagctctcaatgataagcttcagatgctgactggatctcctcctgatgtcccccaccccaaagaaagcctcaaacaccaacatatccaaatgtgacatgattatgtcccatcgccctcacccaaatcctttgaattgtaactactggacttgcttctgccattttgccatttgttttctatatgtcatatattttttgttcttcaattccttcattaataccttcttttgtgtttgactttttgtagtgtatcattttaattcacttctcatttcctattctagctatttcttagttattttcttagtagctaccatggaggttaaaattaacatcttaaatatatagcaaactggcttgaattaataacatagcttaaatagtataaataactctgttcctatgcagctctcttttcctttatgttgttattgtcacaacttttttatatcatatgtgtccactaacatagattcataattttggtttcatgcatttgtcttttaaatcatgtagaaaaaaatagggcttacaaaccaaaagtacaataatactggcttttaaatttagctatgcagttacatttatcagcgttctttatttcttcatatggcttcaaattgcaatccaatctcaaggactccctttagcatctattgttggacaggtcagtaaacaacaaacttcctcagcttttgtctaagaatgtcttacttttgccttcattttagaagaatcattttgcaggatatagaactcttgattgaagatattttatttcttttagcgcttatcatctactgaatttggatctctgtgtgtggtttctgaagagaaattggatgttaattttattgagcatcacttgtatgtaacaagtcacttccctcactgatttcaagattctctgtctttggcttttgacagtttgattgtagtgtgtatcagtgggaatttctttcagtttttccttcttggaggtctttgaatttctcggatttgtagattcacaaaaggcaatcacttttgcaccaacctaataacttagccttagactaattaagactcagtccttgaggtgaaggaggggcttcttgcccgagcccatgactgcgtggggatgtggttaatctcacaaacaaaagcagggctctgccaacagagcattctcccatctctatccccaccattctttcatggaataattcaatacatatttattgggagcttactatgtgccaggtactgggaataaaatagtgaacatgactgatgaggttctggctattatggagtttacatttgggttgggagagccaaatgttaaaatagtgaacaaataaaaatgtagtcaattcaaataattataagttcttgaagaacttaccttgaaaaaaatgtagatggaaatgaagctaggatagtgagatgtagaatgacatgtgtggggcttgaaagcgtggtcttgaaaggcttcactgaagagaggacatttgttctgaaactatacaataggaaggaaaatgtgcagctttatggaagaggactaaagtgtaaggacccctatgtgatcacatgtttgacaggtttaaagagcagatagaaggccagtgtgttcttaaataccattgtgttttatatacccacatctgagcacatgctgtgtctacaatctagaaagaccatccctagatcattgctatgtaggaaactcttatcaacccttcaagacacagctcagatattacttcctctgtgatgccttcccttatctctaacacttaaagttgaatacttccttctttgtatccatactatcaattagaatatctatcaccctgcactatgtttaacttatttacatttttgtctccccctctggacttggagttgcttgatggcaagggcaatgtcatttatatatgcatatttgtgttccctactaccaagtgctctgggcgtgacaaatagtagatgcacagcaagcacttattgaactgaaacactgaatatctactattgctggcactctcatagattttgtggagcatacaaaagaatctgccttcattgaagtagtcaggaatgtagactctggtgccagaagcttgactccaatcccattcccaccacttactagctgcgtgaccttaaaaaattacttaacctctctgtgcttcaggttccttatctgtaaggtgggagataacagtggtaactgtctaaaagtgagtattaatttaaataatgtatacaaaacatttagcacacacagtatccggcacagaataagtgttgagtcttaccttatttataaattaaggaaataattagattgacaagatttatacacatgaaaaacaaactactgcaaatatattactatacagaactgtttaaagtacctcctgaaccaagatgttgcagcactatcacctcaacaaagcattgctgaatgaatgaatggactaaaaaacaaaaagccacagtataatctgtgctgatctgaccatttctagagcactatgttcacttctgaacattacactttaagagaaacaaagtactttataactagaagcagaccagtaggatgctccaaaatctggaaagtatctaataagaatgactgaagaaactgagaatggttaggtagaggactacattactgctgacattaaacatttgaaagttgtcatgtgtaataaaggggagctttgcttgatgctgctctagagagcagaacttgggccaggggataaaggttataggcaggtgatttcagctgaacataggagagtatttgctgaaagtcagtgttcaccacgcaggtgaggaagtggtgagttttccatctgtggaggtgctgattaaccgaacaaccacttaacaaggatactgtcaaggggactttttcattgggctgggggttattctagatggactttggagttctttgcaggaggttcaagatctggacctttcagggaaagaatagtgtcactacattaaaattagttctcaaagtgataatctcaagccaaaatgctctcaaaatcaacaaccccataactttcccacgaccagcccacccctgtgcttttatacaagaaatttccactataggcactttttggactgctcattcaaggtccctgttcaaatattattttttttcctaggagaagtatggttttaagccactcagccattatcatcagcttctattatagtgcccggtatatattaagaattatttattcaatgtgttaccagtcattcacacctgagatcgtacaaatttatcagattaaatttacttgccttagaaaggccctggagagataaacaactggacagataagtttggaaaattgtgagaggtcacaagggttttaccatttaagcttcagtcttcatgacacgtggtgcaagccatgcacagataccacgacactctgaaggcactgatgttttcttagttaggtagaaagccagcctttcctcctcacagatgaagtcttatgctgggcagaaatctgggctgggatttgccaaagccattttgtgccctggccttctgccaagtccatcgatttagctctttgaatcgcatcatttaagcccacaaatgtcacagattctattagacaaacgcctctggccagcagcaaagaaaagagggaacatgataagccctctgaggcagcctgttagacaattcttaatctttcatggttggagaactacattgcgagcgggttcactggcagaatggcaagaaatactggcaggttttgtttctttggttaagaatatacctagaggcttagctttggttaatggcagattagtgcatctgccaagtataaaggtaaagggtcatggggaaaaaccttccaaataatacattcttaaaagataccagaaactccatcactagttacttattctcagaataatggcagagtaggcctaacagcaagcatgcagagaaaggattggcctctgagcctggagtgaggctgaggctaaagctatgagtgagggtcaagtggctgcagctgtgggggattggaaaagggcaaagaattaggcaagtcattagacagctatgtgagtctgcatgtcaacagacaatgcaggaaatccatttttgcattattctttattcgtagtatagagctgggcataactatttaacagagttttccaaggctggataccagacctctcctttaccctccatcacttcacccgcattcttttagccagacattgctttaattccaaagtcacagcaacgttcctaatgagggaattcatgttaatatattactagtttttagccatgtgatttattatttcatccaggggtagttttggcaatgtagtcccttaaagcaagagtgactctaatggtaaaatctcaggcaaacctttgtagatttattttttctaaagaggaatactattgaagcctcttacaacagagcccactggaaaattacatagaccagactaattccaaatgcaagagatgaaaattaaaactggactttgaactgactatatatcatccgattatacttgcctcaagttacaaattaccatgattttactgttgtctctcttcactactttaacccatgcatctggcacatagtgagagttcaatgaatggtactgcttgttgccttcattatgattaccattagaggcagtggtagtaatagtgccactccagtacctggcaccatgcctgagccacattaagtattcaaaactaatgattatttttataactttattgccccagcttctggcacagtgcctggcacataataggacaccgattgagttagtttccttcattctcacctttccctgggatacaatattcttctgcttccccccacaactgtgccttactaaaggggttgcagatcttcctgtagcagtaatgcttcctataccagtaacaccaccagtgacaccatctgaaaggacatctagccttttcttccatggtagcctcttaaatggcaaatgggcagcaagtgttcaagaccatttttcagatgaggataccaagattatgagctattgccttggaatgttagctcacctctaatccctatatcctattaagctgaaaaaataagaccccttgcattccccccaacccatcacccaactaggccataactgatctcatctttcttgttgcactcggcagtgcctggactgcccccacactttcatgtttaattcatcctccaaggattagcctaagagctaccatctttatgaaactttctgtgaggcctccagccttcaatgagcagggttgtattgtttcctatcccctagcaggggctagcagagtgctagacacaatagaggctctcagtgtgtttgtattgattaaataaatagaagctaattgggttgttggtcctcactttaggaggtcacactatcccttctctcccccactcatttttgtttacaaggtaaaggcacagaggcagtctacaattagtatcattaaagttttgtgctgtgtattggcaaatgcttactctaagtgctgtttgtttagccactttcactactttcactttacttgaaagtagtggaagaatgtatcagtgcttcttcaggcagtgaaacagcaccctcttctcttgggatttagatgtggagagagatttgtcatttgggtcttgaggcagtgaaacagcaccctgttctcttgggatttagatgtggagagaaatttgtcatttgggcctgctcagggcaagaggcaacactcatcttcaaatactaacttcccagaaagacacaagcacatgaattgcaaataccacttgatataaggtaggcctctccctctgccaaagcagggatgtcattacctggaagactgaggtaaatgttggtggaagcttcatgtctttatcttttcttacatccagaaggtgagaaaaggggctctttagcacatttccatgtcctttagctggcaaaacagttaagtaatgaaagacactggaataggtccatcctaactcagcctccagagtggcctggaggcctcagggatgaggggaaaagtggagccaacacctaatagatctgagcctcattttctcccttggagaagataatcattcccatctcacagggatgctacagggagttaatgaggaatgtgtataaattttacctgtaaactatgaggcaagagctctatactgcgattcattctatgtgattgaagacaaaggctatctttttacctttgtctcccagagacagtttaaacacattgtaggagctcaataactaggtttttactttaaaactaattctattaaatataacctggatttaggtatgatacaaataaaacagaccattcacttatcagaatttaatcatacagattctcagatctgttagcttttcatttgaaatggcagaggaaaaaatcatgagcaggcacagagggtacatgtttatcttttgcagttggctttggcctattggagtcaatacccctttccccattgagcagcagcaagaagcagggttgcagttagaactgaaataggatttcaatccaggatgtgcatgtgggacagttacaaatgtaatcctgaaaattagcataggaccagagacctagagcctgaaggaaattggccaaagaagatttccaactttgcatcactaatcagaagtgttaccatgaatattttcaggcaccagaagagaaggaaggtaggaattagcttatgccatgtcttaggaggtttaccctatgccagttgctttgataatgtatatcttatttaactctcacaatagctttatgaggtaggaattattgtgtagcacaggacctggcacacagtaagcagtcactaaatgataactgcgagtaatattattaagattgataaccttagtatcatcaaccttagtaataaataaagcacagagggcttgagtaacttactcaaggccacagaactggtaagtcataaaaccaggatttaagcccaggtcttcctgaccccaaagcctgggctttttctgttatacttctttgtaagcggaaaaaagacggcgtcattgaagtagtttaggattttctaaccccttagcagggctgcctccataactggccacttgagacctccacgtatctaaggatattttggtctttctctgtttcctcactcagatttctgcattgctatgaaccatggcccaactgtactacaaaaaggtcaactactcaccgtacagagaccgcatccccctgcaaattgtgagggctgagacagagctctctgcagaggagaaggccttcctcaatgctgtggagaagggggactatgccactgtgaagcaggcccttcaggaggctgagatctactataatgttaacatcaactgcatggaccccttgggccggagtgccctgctcattgccattgagaacgagaacctggagatcatggagctactgctgaaccacagcgtgtatgtgggtgatgcattgctctatgccatacgcaaggaagtggtgggcgctgtggagcttctgctcagctacaggcggcccagcggagagaagcaggtaagagaaattcctataggctgggaaatagccaggcacaacagggcaccaggtcagaagccctgaaactagggaaggttaggtggtctggaattgagatgccctatctcagaaattgcaccagtgatctcaggtagcatcctggagctaccctacgtggcccatgctgagttttactgatttaccttttccttattagtgtttgcccatatacattcagtactcactgaatgtacttagcaacccaatgatgtgttctttgtttccagactatttaagccccttctaactttcgtataccctgctttctatcttctgtttcctcctctactcaaaggttatattctagaaaaggagagacaaaatacagacttggtctttctacttctcattagcctctctctgaagacaacacaggaggcctttaaacttgagtgccatggtgcagatgcttatggaataaggcctcatatattttcccagtacctgtcaagtgacttcattccacttccaaatgtttgggattttgcctctgtgattctcatatcctccaaggcacctaggtttgatactctgaagtcatcttttatttgtctggctcccttgcccccatgtccaatccccgagtcctgtggttccttccttccaaatatctttcatatactttctctcctctctagttcgtctttcaccagtctggctctggttctcaacatctctctcttagatgagtggttcctaaagtgcggtcccttgactagcagcatcagcattacctgggtacttgttagaaatgcaaattctcaggcctctgccacagccctattgaatcagaaactctggggtggggccccaacaagccctccagaggattctcatgtacaatcaagtttgagaactgctgtcctagattaacataaagctcttctgactggtctccttgtctctagcatgttcccctctctcaaatcccgagcaataatatcccaagaataaggcattattctccctaaatagcattattctccctaaaataggatatgagcctgccattcctgtgcatccttttgcagcttcccttctgctgtctaaaggttcactaaaaatgaacttacaataggcagattaataggagaaaatggcatacaaaatttattaacatgcatatggacatggaaaccatacacaaagtttgaggctcaaagaaaagtcagatgtttgagacataaatactttcttcataagggagaaatgaatggacctgggaggcaaacattattttataaatgattatctttggactctggacggtgccaacaagttaagggaaagtgaggggtggaactatacaagaactaatgctgtcttttttgttcttaaatttccatagattattgcagagcaggtagtgtttggttacatgagtaagttctttagtggtgatctgtgagattttggtgcacccatcacctgagcagtatatactgcagcctatttgtagtcttttattcctctcccccttcccatccttgtcccctgagtccccagagtccattgtgtcattcttatgcctttgcatccttatagcttagctcccacttatgagtgagaacctatgatgtttgtttttccattcctgaattacttcacttaggaaaatggtctccagtctcatccaggttgctgcatatgccattaattaattcttttttttttttgagatggagtctcactctgtcacccaggctggagtgcagtggtgcgatctcggctcactgcaagctccacctcctgggttgatgccattctcctgcctcagcctcccgagtagctgggactacaggtgcctgccaccacgcctggctaatttttttgtatttgtagtagagacagggtttcactgtgttagccaggatgttcttgatctcctgacctcgtgatctgcccaccttggcctcccaaagtgctgggattacaggcgtgagccaccgcgcccagccaactcattcctttttatggctgagtagtattccattgtataaatatatatatatatatgccacagtttctttatccacttgttgattgatgggcatttgggttggttccacgtttttgcaattgtgaattgttctgcaataaatatgtgtgtgcaattatctttttcgtataatgacttcttttcccctgggtagatacccagtagtgggattgctggataaaatgatagttctacttttagttctttaaggaatctccacactgttttccatagtggttgtactagtttacattcccagcagcagcatagaagtgttccctgttcactgcatccacaccaacatctactattttttttattttttgattatggccattctagcaggagtgaggtggtatcgctctgtggttttgatttgcatttccctgatcatcagtgatgtcgagcattttttcatatgtttgttggccatttgtatatcttcttttgagaattgtctattcaggtccttagcccactttttgatgggattgtttttgttgttgttgttgatttgcttgagattttcattgtggattctggatattagtcctttgtcagatgtacagattgtgaagatttttttcccactctgtgggttgtttgttaactctgctgcctgttccttttgctgtgcaaaagctctttagtttaattaagttccagcaatttatctttgtttttattgcatttgcttttgggttcttggtcatgaaatctttgcctaagccaatacctagaagggtttttccaatgttatcttctagaatttttatagtttcaggtcttaggtttaagtccttaatccatcttgagttgatttttgtataacgtgagagatgaggatccagtttcattctcctacatgtggctagccaattatcccagcaccatttgttgaaaagggtgtccttcccccactttatgttttcttattatgcagataaagtcccttaggtaatctcttgcagctgtcatcagacaaatacatgaaaagtccatcgggtcatggtgatgactgcccatctcttctccatggttgatctttcttggttatttgattagatttctagggagggagtcttaagacaattgcatttcttttggaaagaagcttctttactcagataaggaagttacagagagtccctcagggtgtatccttaaaaaggatcagagagacagggaggtggacaaaggtcagaaagagagctcagttctgaggcttatttttgagacctttccactttttttcttttttttttttttggagttggagtctcactctgtcacccaggctggagtgcagtggcacaatctcggctcactgcaacctccgcctcctgggttcaagcaactctcctgcctcagcctcccgagcagctgggactagaggtgcacaccgccacgcctggctaattttttgtattttagtagagacaggatttcaacgtgttgcccaggctggtctcgaactcctgagctcaggcaatccgcccacctcagcctcccaaagtgctaggattacaggcatgagccactgcacccagcagcctttccatttttctaagcactcagcatgcttaagtgccatattttggggaattattttctgtaccccaacactttcaataactgtagttattagaaaagaaaccaatccgtgaagcttgcacctcaatgccctcaggcaatggtctttccagtcctgtattcccctagccccttctaaacacccctcaagtcagacaggtctctcttcactgtctctcttctttaggaacacagaattctgcacatagtagggacaaaaaaaaactaaatcatcaaaattggaatacctcaacactttccaaaaagtagaaatagtacataacaaaaccaaaattgcaaatgtcttagaaatagtaataatagaaacactcagcatcaaatctaatggcatatggccaaagctgagtctaaaggaaattcatagctttcatatttgcctaattaaacaaaaaagaatgaaaataaacttaattataactcacggactaagaattgtaataaatggagcagaaagcaaagacactatgtgataataaaagttccttgagtaaagggcctgaatccccctccaccatcagcattgaacacagtactaagagagcaggactttctctctcttgttcactgctgtattacatcactagaaaaattattggtacatcaccaacacttcataaatgtatatttaatgaatgagtaacatacaacccacactgtgctaagtatctgacatggcttatcccattcaatcctcttagcaactctattagatagacagtattattatcatccctattttaccataagaaaaattgagaccagctgcagtggctcatgcctgtaatcccagcactttgggatttgtccgaggtgggcagttcacttgagctcaggaattcaagaccagcctagaagaaacccggtctctactaaaaacacaaaaattagctggatgtggtagtgcaggcctgtaattccagctactcagaaggctgagacaggagaatcgcttgaacccaggaagcggaggttgcagtgagccaagatcgcaccactatactccagcctgggtggcagagagacactctgtctcaaaataaataaataaataaaaaagaaaaattgactcacatgatgattaggtcaattgtccaagatcacaactagtaaatatgagagccagcattcaaacccaggcagcttagctcttgaacacactctcctaaccactaagccacactgcttccctagcagtctgagtaagtcaggattcccagcacagaagttctgagacaaagtagatcaatggaggatatatcagccctctggaaaggaggggcctgaaggatttgaatgactagcaaagcagagaggtgtgaatatgttcctgacctgactcggtccacctcactatctccattaaagctggtatgttttattccccatttccccagatccctgccaagtgcctgggtgatttaatgtgctattctatactaaggcttacccagctacactgctccagaatgactttgccaacctctgagaatctgcagcctattggcttttcccttcacttgacaccaatcacatatcattttgtactattgtctagccttacttgtgtaaatgtctgatctctgtaattaaattgtttctcaaatgtgaggcaaaaatctcatgttcaatggtttccatgtttccctcatcagtacttaacccagagcctagtacatgatgggtgatatataaatgtttgctgaggaacatgaaagagttaagtgaattttccagaaaagcacatggcttgctgattgaacaagaccctctggactttcatattcaacttgatttagcttcattacagttttgggaatgaggagatcacagagaagtttccaagaaggaggctagtaatgccagctctgtctgagttttgaaagtgggccgagttctcatttgatggccctcatttcctccatctttcctctatgctctactaaatgctgaggctctgccagtcaggaagaaagacactaggcaaacttacactaaggtgcaatcaaaggcatgaccttcctggggaaaggtactacttaacttacagaaatgaacccactgacagtggaaagtcaatcctatggaacctgggtaaagctacttggctcaggcaggtttttatcaggaccctttcatacacattcccaatataagacctactttgtccatacttagctatcacactgtatgtacaaacccacaaagttatcagctccattcccaagtctcttcagcagccttctcctccctttcttctctctccctctaacccccaacatgagcctctgctaaatttcattttcttccattgctctgacaatctctgtgataagtcatatgtctgtaactgtaactgtcacagtactggagctctgtctttctgggagatagaaacaaaatttgtttacttgggagccatcagggatgtgagcaaacacagactttctgaaggacctttggtttagacgggcaagccattttcagggaggcctttctcccacacttggaattcaaacaactactctttttcactgagtccctcccttatctttccaggatattgggcacaattgacctccatcactcttgggaagataaaccactgccttccttggctttactgggcaagggctttagctccaggctagaagtaagaagctgtctgctctatccttatcccagactcttgtgctcttccccgtcttttagtctatcatctcagacaaaggtcaggggctgggcataaggggctgacagtaacttcaaggatcaactttgatatggagactttcatttttaataagaacaaaatctttaaaaatatgatgacactctatcaggtagaattttcctcaccaaacaggggtgtgtgtgtctatgtatgtcggtgtgtgtgcgcacacatgtgtgtgtgtatgttatatgttactctgtggacttgttgctccagaaatctgaccctcttggcccactacctaatcactgtggcctgtttacttaggggtagatttttgacaaccagggaaatttgtgatttttgttgggtaaatcatctgaaattggtctcagaagtcaaaattcttgagacaacataaggtctaatgcccacctatttctggtctagtatgcttgctacctttgagccactgactgtagaaaccactagaggagtactgttatcagggagagcaaatccaaccgcaattcagagaggagactcgcgtctgtgtatgctcaaaaccagctctaaatcaattgttgtgcacatgagcaacttgtcaaaatgcagatttctgagccccactacatacctacagattcagaatcttggagtttaggtctgaaagcagaattttaacaaatgcaccccaacctgtttctaggtaagaggtccacgtacctctctgtatttgtttcctagggctgccataacaaattaccataaattgggtctcttaaaacaacaaaaatgtcttctctcacaggtcaagaggtcagaagtctgataagaatgtatcagcatggctggtttcttctggagggagaatctgttccatgcctccctgctagtctctggtggttgctgataatcctctgcataccttggcttatagccgcatcactacaatctctgcctctgttgtcagagttctcctctgtatctttcttctgtgtctctgtagttttcttctgtgtctctttacctaaatcttcctctcctttttattatgaagataccagtcatttgatttagtgcccaccctaatccaggatgacctcatcttaacttgattaaatctgcaaagacccttcttccaaataaggtcacattcacaagtaccaagagttaagacttgaatatatcttttgggggacacagttcaacccactatactctctatgagaaatatttgtctaaacaagtggttcttaaacattttcagcagtagagtctttcattaaatgaaaacccactcagatgcaaaacagacccaagcagagtttccctagtttaagtgcaggttgtatttcaaacccacttgttcgttctctctctctctctctctctctctctctctctctcacacacacacacacacacacacacacacacacacactcttctactcccacacctccttggcctctgaggagtgaacacagcttaaaagccactggcctacaagacagagtgacagactctaattcaccgttaatggtgcaagccagcttgtagctaacagtgtgaccttgggcaagtcacagaatctctctgtagctcaactccaccatctgcagaatgaagctaacaatgcctagccctacctaatccagaaacctattgtgagaaagaaataaggttaagatatgcccaagtcttttgaaaaaaagctttgaaaaatgctacacagaggtcaataactattattttcagctttactccatccatttgacttagcatgtcgtatggtatggagagaccagctggcaaacggtactcctcacaaggcaccaccagtggagtgagaggaagaggctggtaaacaagccaacttagttctaagattacctccttctgcctggccctgatggcaatgctctcccgtctgttgccaggcaatctgcacgacctcaaagtcatccttcctttttcactagagtctaaggatttgagcaacagggaggtagagctgctggcctctatatcaacaacccacccaagtaattttctttcttggtcacttgcgtcaatgcaagcaggtgaaaagaggctaagccaaccttctccccatggcccgcccctctgggctcttccataattactcatttgtctgtggcagatggctcaaaattaaaattggtctcacagatgagctagagagattaaatctcaacaacactgataagtgtttatgttgagattatagaaaatcagcaacaggacacttcatttactcctcctatctgtttttttgtctcagactgagattacacagtgtggagggggacagcgagggcctggagaaaggtgacgggatcacggagaaggaaaataaaatgtctagcctataaatctcaaacatttaatataaaagcagaaattcaaggagaaaattataaaagtcatcctgctatttatagatagcctgcagtggtagaaagaccataggctttgaagtcagacacttattagatgtgtttccttgaacaaataatttaatctctccaaaccccaatttcttcatctgtaactaggaatgataatgaagtctatttcatagtattacagtgagaatcaaatgaaataatacatgcatattactcagaagagtccatgatatctagtaagtactcaataaatggtagctagtactactcctactcctactagttgaagccatgctgctcaaatcacctgctgactaatgtcatttattcattaaaaaaatgtattaagcacccactagcacatagtggttaataattcagactgaacgaccttgggaaggtcatttaccttgtttaagcatcagtttccttacatgacaaataggtttaatgatatgatatcatgataattctattatttgctttgattcccattccaaagtcaaacttctaggtgaaaacaatggattttgtcaatcaaatcaagaaaataaatcgtttagtttaaattgagagaaaaggacagaatgactgcatggcatcatactggccaaagtgataaactgagttacctactctcatgtatctgtgctaactttcagtaaacatagcttacttcattcacagaatggaattgtagggagtttcaagatcctgtggtctgaagtgaccacacttcaaggtcactcagctgagcctgaactgacacaaatacctcctgccccccaagctactctttctaccaccccactttgcctttgaggaatcatcagaaatgctaccatttacaatggagctgcaaataaataaagcagctacaagtagtgtctatctagaacaattcattgatgacagagtttcagcaaatgattaactctatttagttctgttcaactttctaagtatttttgactactaatcatatgcctcacaatcaaattgaaatatccagttagtgctttcaagaaatgtatactcagagtgacatcatcaagagatatggctgatgagaggtacctaacattcatcccctccacaaaaagtacgaaaacaacaattaaacaactacacttcaactagagtgtctaagggagaacaccagaatatagcaagggactggtgaattccctgtggagcagggaaactcagaatggcagtgtagagagggaagtgaagcaccctgcctccatgaccctgtctctcttgctgagactggctcagagacagcatgggcttctcatcatggggaaaatataaacagaagatccccagcagccctcattactgccattgacacctgcagtccttgctacagcagagtcccacagtcctcacagacactgagcccagtttagggagctgcctggagtccgtgtggctgcattgttccagaggaggagcccacatggtgcaccatccctcacagcactatcttgagactagagccactgctagaatgcatcttgctctgggggccagtagccactgtatctccccctctctgacgccccactgtcattccatcatactcacacaagtggctgcaatgccacaccccagttgcttggagcctagaccaagtagaacagctgtgactttgacacccaagcctatgcagtgccctgcatttcaaggaacaagcgaccctgcacagtggagaagccacctccacgactggtggaaatgccacactttgcacatccctgacctaaccagcagcatcattatcagcaaagccacaccaccacaatacccacagcctagggcactgaagcacttgcagacactgttgatattgattatagctgaagaaattaaacagagactaccttactgtgcttatacagaagcaaagccaaagcacccgaccaaatcaacaccctaagacacatcttcaggaaaaagtctttccctactgttaaaaatcacacaagatctataaatttaggaaacaagactatttattttacaggttagagcctgcaaggtggtcatatcacaggctgggaagaataacctccagaaaagaccagagacaggcacattgaaggaacggttggagtaggaacttcatgctgaatggattagctaaacatatatagttaacaggttataggaggtgatgtgaatatatatgaaggtggtcctgtcatgtgcatattggcaaaacatgcaagcaacatacaacccatgttcattttagggtggagacttaacatttaaatgtattacagttaggtcctatatgtcaaaaggtgaagcggggacatcaagacactcaagtgtgcagcctctgtaaacccaccaggaccagtccatagttggtgcccttttgatcaggaaaagttactgaaatcagtcttttgtccaatcaaaggatgagtggctgggggccagttagcatacattgaaactgaatttgctttaacattgcttatctcaagcccagtgcttgtttagctgctagagaaaaagaataacctcatgacagacaaaacgtagtttattcttttttttttttttttttttagacgtagtcccactgtgtcacccaggctggagtgcagtggtatgatctctgctcactgcaagctccacctcctgggttcacgccattctcctgcctcagcctccctagtggctgagactacaggggcctgccaccacacccggctaatttttttgtagttttagtagagacagggtttcaccatgttagccaggatggtctctatctcctgacctggtgatccgcccacctcagcctcccaaagtgttgggattacaggcgtgagccaccgcgcctggccggaatatattttttgctttacgtgtcagggtgcgtgacttcatgcttgccagacatggccttaggttttgtttataatttggtacaaagagtccagatcatcccactgcactccagcctgggcaacagagactccgcatcttctcgaaccacaatggaataaaccagaaataaataacgaggtattctggaaactaaacaaacacatggaaagtaaacaatatgctcctgaaagaatagtgggatgatagctcctatcttgagatacatgaacctatagaaattaagaagaaaatttttaaattttttgaaagaaatgaaaatggaaacaaaacatatcaaaatttataggatacaaggaaggcactactaaaaggaaagtttatagctataagtgcttacatcaaaaaagtagaaaaacttcaaataaatgacctaatgttacatcttaatgaactaccaaagcaagagcaaaccaaacacaaaattagtagaagaaataataaagatcagagcagaaataaatgaaattgaaacaaaaaatagaaaaggtcaatgaaatgaaaagttggtttttagaaaagatcaaaatcaacaaacttttagccagactaagaaaaaaagagagaaggcgcaaataaataaaatcagagattaaaaatgagaaactacaactgatgcctcaaaaattaaaagtatcattagagcctactacaagcaactatattcaaataaatggaaagatctagaagaaatgaataaatttctagatgcattcaacttaccaagaatgaaccatgaagaaatccaaaacctaaatagaccaataacaagtaatgagaacaaagctataataaaaagtttcccagcaaagaaagacaagcccaggacctgatggtttcactgctgaattttaccaaacatttgaagaagaactaatcccaatcctactcaaactattctgaaaaatggaggagagaatatttctaattcattctaagtcctgtactaccctgataccgaagccagataaagagccatcaaaaaaagaaaactacaaatcaatattcctgaggaatattgacgcaaaaatcctcaacaaaatactagcaaactgcattcaacaacacatttaaaaggtcacttatcatggccaagtgagacttatcccagagatgcaaggatggtttaacatatacaaatcaatcaatgtgatacataatatcaacagaatgaaagacagaaaccatatgattatttcaattgatgctgaagaaacatttgataaccttcagcatccattcatgataaaatccctaaaactctgcatgtacaaggaacacatttcaacacaataaaagccgcatacaacagaccacagctactatcgtactgaatgatcctttcctttcctctaagatctggaataagacaaggatgcccactttcatgactgctattcaacatagtactagaagttctagctagagctatcagacaagagaaaaaaataaagggcatccagattggaaacaaagaagtcaaattatccttatttgcagatgacatgctatatttggaaaaacctaaagactataaaagagaattttagaccaatatccttgatgaacattgatgcaaaaatcctcagtaaaatactgacaaaccgaatccagcagcacattaaaaagcttatccaccatgatcaagtgggcttcatccctgggatgcaaggctggttcaatacatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatcgcaaaataataagagctatctgtgacaaacctgcagccaatatcatactgaatgggcaaaaactggaagcattccctttgaaaactggcacaagacagggatgccttctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatcgtctcagcccaaaatctccttaagctgataggcaacttcagcaaagtctcgggatacaaaatcaatgtacaaaaatcacaagcattcttatacaccaataacagacaaacagagagccaaatcatgagtgaactcccactcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcgcagaattggaaaaaactactttaaagttcatatggaaccaaaaaagagcccgcatggccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatgggggaaaggattccctatttaataaatggtgctgggaaaactggctagccatatgtagaaagctgaaactggatctcttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctcatatccagaatctacaatgaactccaacaaatttacaagaaaaaaacaaacaactccatcaaaaagtgggcgaaggacatgaacagacacttctcaaaagaagacatttatgcagccaaaaaacacatgaaaaaatgctctccatcactggccatcagagaaatgcaaatcaaaaccacaatgagataccacctcacaccagttagaatggcaatcattaaaaagtcaggaaacaacaggtgctggagaggatgtggagaattaggaacattttacactgttggtgggactgtaaactagttcaacccttgtggaagtcagtgtggtgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaagggaacatcacactctggggcctgttgtggggtgtggggagaggggagggatagcattaggagatacacctaatgctaaatgacgagttaatgggtgcagcacaccagcatggcacatgtatacatatataactaacctgcacattgtgcacatgtaccctaaaacttaaagtataataataataaaagaaaaaaaaaagaactgataaacaaattcagtaaagtgcaggatataaaatcaacatcccaaagtcattaacctttctgtatgccaacagcaaacaatctgaaaaataaatcaagaaagcaatctcatttaccataggtacaaatcaaatagctagcaataaacttaaccaaagaagtgaaagacttctacaatttatactataaaacactgaggcaagatactgaagaggacacaaaaaatggaaatatactccatgttcatggattagaagaatcaatattgctaaaatgtacatactgcccaatgcaatctatagattaaatgcaaataccaatggcattcttcagagaaataggaaaaaaatcctaaaatatgtttagaacaacagaagacccaaaatagccaaagccatcctgagcaaaaggagcaaaactggaggaatcacattacctgacttcaaatcacactacagagctatagcaaccaaaacagcatggtactggcataaaaacagacagagaccagtggaacagaatagagaacccagaaataaacccatatatctacaatgaacttattttcaacaaaggtgccaaaaacatacactggggaaaggacagtctcttcaataaatggcactgagataactggatatccacatgcagaagagtgaaagtagacccatatctcttgccatatacaaaaatcaaatcaaaatgaaataaaggcttacatctcagacctcaaactatgaaactaccatgaaaaaacattgggaaaactcttcaagacattggtctgggcaaagatttctccagtaatacccctcaagcacagggaactaaaacaacagtagacaaattggatcacatgacattaaaaagcttctgcatagcaaaggaaacactctacaaagtgaagaggcaacctacagaatgagagaaaatatttgcacactattcatctgacaacagattaataaccagaacatataaggagtttaaacaactctctaggaaaaaaaacgattagtcttcctatcaaataggcaaaagatctacaaagacatttctcaaaagaacacatacaaatggcaaacaggtatatgaaaaggtgctcaacatcattgatcaccggagatatgaaaatcaaaaccacaatgagttatcatctcatcttagttaaaatggcttttatccaaaaggcagtaacaaatgctggtaaggatgtggagaaaagggagcccttgtacactgttggtgggaatgtaaattagtacaaccactatagagaacaggttggagtgtcctcaaaaaactaaaaatagaactaccatatgatccaggattctcactgctaggtatatgtccaaaagaaaggaaatcagtacactgaagaaatatcttcacttccatatttattgcagcattcttcacaatagacaggatttggatgctaactaacttgtcgatcaacagatgaatggataaagataatgtgctgcatatacacaatatagtactattcagccataagaaagaatgaggtcctgtcacttgcaactacctggatagagctggaggacattatgttaagtgaattaagctgggtacagaaagacaaacttctcatgttctcactcatttgggggagctaaaagttgaaacgattgaattcatggagatagagatgagaatgatggttaccagaggctgggaaggatagtagttggggtgggggaagtggatatgcttaatgggtgcaaagatagatagaatgaaaaagagctagtattagcacagcagggtgattacaaacaaaaatattttacggtacattttaaaaataactaaaacggtatattggaatgtctgtaacacaaagaaatgaaaatgctttaggtggtgtataccccatttatcctgatatgattattatgcatggtatgcttgtatcaatgtatctcatgtaccccacaaatatatagacttactatgtacaaataaaattaaaaattaagaaaatcagctcaaaattgtttaagacataaatatgaaacctgaaaccataaaattactcaaaaaaaaaaacagaacaaaacaaaacaaaacaaaaaaacgaaggagaaacactttatggcactggttcgggaaagaattttttggataaaagcttaaaagtacaggcaacaagagcaaaaagacaaatgggattgcattaaactaaaaagcttttccacagagaaggaaataacagagtgaagagacaacctaaagcgtaggagaaaatatttgtaaacgatacatctgacatggggttaattctcagaatatataagaaactcaactcaatagcaaaaaggcaaatgtctgattatacagtgtatacatgtattgaaagatcacactgtaccccataaatatgtacaataatgaatcaattaaaaacaaaatttaaaataataaataaaaataaattattttgggggatgttacaaaaaaagaaatttatagtctcatgagaagaatagttatgcatatgctgaccagtcagatcactcctcttaggcatggctctatgtttcaagggacacaaaagacttaaaacagtgatgcttggctctcagaaagaaaaatataattatttaaacttgatctaacacggaccaagggagttggctgcacacttcacaaggaataaacagtgaaataacctcgaaagcaattcacttaatgaaaacacatgagtgtttttgtttgtttttttgtttctgttttttgccacagcccctctttcttcatggttaccatcaactcagggcttccctcccttaacctcatgcatcagggttatatatagcccttatgcacatacacatgtcccattagaaagtttcctattgtctgtccctgggcagatatgtctcatctgcatatgatgtcatgtcctctcccttcacttcacctgtacagttgtctagtgggcagccattttgtctcattttcaccccagcccgctcaatatttactctgttattgtttttttccaacttatgactcttattgcaagctcaattcaagtgtgaaacatcagtgcaaaattcacagccacctttccatctctcctcagagctattgtatcccagcccaccaaacactattctgtactgatttatttccatatgctaacaacaaacatgagacaataacagtacaaggaaatgtatgctacatcatccaaaatgtgtgaagtagacaatataagaggccacacaggatgccagtagatagggcagttcaagtgaggaacgtttcagaaaataaatagtctttgagctggaacagcagaaagaagatggcacgctggtcagaaggaagtgaatgcacaatgatgtcgggagtggaaatgatggtagcttgttcacagtgggtactggagtgaaaagttggtgatgaaatcagtgcttgtgactcatgttaccctcatgagattagcctcatggaggaaggccctggatatttcactcagcagatccaggacactgggctaggtcggtactaaatctgatcacaaatagctgggttgctgtgctcatctgcccaccctctttttttctttcatcttagttgggatgtgtctatggccattgattgaatggctgtttagttgggaccttggtgaacagtcagcatcatcccagaaggttgttagtagttttctgactggcagtcaggacagagaggactagagtatggtgaaaggaaagggccaggtccactgattacccaggggtctagttgggcagggcttccccttagcaaatattggtgagaagctggccatgttggtctttgacactctcttctttcatctgtcttcttccttagatgacactctttccctccactcctatcaccccatacacataggtccaatgtcggtgtcccatttttaacagctttattgaggtaaaattcatgtattaaaaaactgcatgcatttcatgtatccagtttgatgtgtttggacatatgcatatacccatgcaccaaaatcaaggtgataaacctattcatcacctccaatagcttcctgatacccctttgttttgtctgtgtcccatttttattggttgatattcattgattgacaacaattttgacacccatgataccatgcctaagtagttaccttcttctgtctctgtccattgccttcatctctttttcagaatccttatctttttctcctttaaatattggtgctgcccaggattatttcactcctccctttgcagccaaatatctgtcaaaggcccatgatttattttgtaactttcagctagatatacccacctggatggactccaaacatttaacattctctgtgtctagtaataatattagcaaacacactttgggcatttactttgtgccagtatccatcctaggtatataacatgcattatcttattcgatacccacaaccatcctgtgatgcagaataatgctattatccatatttacaagtggagacatcaaggcacaaagaggttaaataacttgtccaagctcatacatctagtaagcggatgcactgggatttagtacgatttaatgtttgtagccaccatcaactctattattcatataagaattgtggatagaactttggagctaaaaatgatcaacagagctcctctgagcctacccttgtcagcaaatcagccttgtactcaaaccaccaagtagatagtatctctcttcttcgcaatgtgcctgcacagggaaggaagggtttcaatgtccactgagagatccagagtttagaatagtctgagctttgtctacccaagcaaaatgaagatacgtcatatttacttaagcaattttctccctctaccccctaatttcttaactccaaatataagatgtgaaattattcaatcacaagggtcctaggtcaccaccacccttctccacattcatttgtttatcttgaagttgtaaaaataatgcatgttagctataagaattataacaacataaaagcatgtaaaggaaatcatcccctatttcccactctcaaaataacgccctagaagtcattactatgaacaaattatgtgtgtcctaggtattttctctacatagtaaaacagaaacacacacaaatacacaaagacttttttttttaacaaatgttctacaaacctgttctttttaacagtacattatggatgtcttgccaaagctagacacaacactgatgaagtgacatttgcactgcatctgctgcttggcctggctgtcatctccccctgccttcctccctgtcctcctcctcctttttggtaaccttgagagcctgatgactttccaagcacaggccagtgaaccatggactttacctctaagcatgtgattggccacttccagggtgattggggccctatccctcatcctccattggcatgcatgcctgccgagagcaccaggtgattttccagggcaatggcttccagtggggctacatgagtcttgatctgggctaccgtctccaaaccttcttgagggtgtgcagatcctgggcatgaataaatagctgcaggctagctaccaaattgcagctaccactgccactgccctgaagatggagacaagaagagccaaggaatatgtcctcatcacctgctgtagccacattgctgctcagaaaagcattgttttttattattttttttaaagacatattctccctgtgttgcccaggctggagttcagcggtgcaatttcggctcactgcaaccccagcctcccgggttcaagctattctcgtgcctcagcctccaaagtcgctgggattacaggcctgcaccaccacgcccagctaatttttctaattattattatactttaagttctgggatacttgtgcagaatgtgcaagtttgttacataggtatacacataccatggtggtttgctgcacccatcaaccatctctacttaaaatacaaaaatcagcttttctcaagaagggctaatttttgtattttaagtagagacggggtttcttcatgttggccaggctggtctcaagctcctggcctcaagtgatccacccgcctcagccttccaaagtgctgggattacagtcatgagctaccgcacctggccaggaaagcatacttaataaagaattatatactagagaaatcagcctgagagtgttgagtagtgtttgatgaggaagaaggaaatgtggccacccaatttcaaaaccacaatctcaacactggagataaatggagtggcatatcaccacatgtttgagcagaggcagaatggctactgggcaggagtgttactgtatctgttaggaggctggactatgtcatctccaaggtctcttctaactctgtgattttgcagtgtatatatcaactatgatttatgatatgatgaacaaagtctgaaagtggaattctcatattgacttcatccctcaactgttgggtagctggagacaaatactcaatctctctatagcttaacgtcttatcactgaataacaaaggaataatgctaaataatcccacagggatgctgtgagaaaatgagcaatattttgaaattcttctaaaagtacctgataaacgcacattaaataggtgctgtgcctgacatataattggcttagtagagaggcaagaatacaaagccccagtaaatataaaaaccacagtggagttataattccacaggcaggaatgtcactgacacatttctagcataaaacatctggagttgtgagggataactgtttagctgtggtccacttgatcatggaatcgtcaggattaaatgaaatatagtggcaatctagtccattcttctgtcactgcaatcaatccaagctgtattaatctctagcctcagaaagagttaaacatgccaatgctaatttgatggaacacaaccttggcacggtatgaaagaagtcccaaagcaattctgtggaagagtcagttgcccagaattctcaaatgtatgtctggggcctccagggagtctcaagtatatgaatgaggccacagatgaggaagagttggctgggagctagggctcctccttgcatacctattcactgttgctgcccttttctaacaaaagacaagcaatccctgcatcggtggagccctgcaagagctgagtgcactatttccttctccacttgcaacttttcatccatctttgagattcttatcccctattaactaaatatggaggagaaaactaagcagtagtaaatttaatttagaaccccagtcctttttaaggcctcttttgggttatccctggcatgtgttcctgaaaaggtgctgcagagtgaaagactgctttgaagctctgaggtgtctggctatatgtgtttcagatagatggacatgttttgcaagtgattgaaaattcatcattatgtgtaaactgtctttgctttctcaagtttcagatgtggggcatgtctgacttcagggaaataagaacaagacagccgatgtttccctaattcattcttgatcagcacctagcttatttttctctagggagacagcagcccacacccctagcctaagagcatacagtgagaaagctaggcaagagacagcagccgtagagctagaagcccaaagcagccctcccttctcccaactacaacaaagctcctgctcctttcttttaacacttggtccgctgtgacaacagcgaaaggtatactgcttgagactgcactattgacaatgcagctgccagttcaaagcaataaaattggaagtaatatcagagagagagaaattatgggatagggacattgttcttgagtgttttttttctctcaaaatgtaatagagggaaacatgtgagtaaaggcagtacattataaaaatattagaaaacatttgcttgtcacagattatgtttggaaagaacttgcttgcagttgaatgatgttaacatgatgagcataagttcaatcacaaaatgacttcagctacttttcctggtaaccacaagttatatattttttaaatgacttctgttttattagtgacccagtaatttaatcctggccattgtgtactgaataatcaattgtttatcatgatggggcacagtcatggccatgaaacagagacttttgaatcctgtttttctgctaaagaaggaataaatattcttgaaatgtgtcacattaagatgtctgtgctagatgaacttaggcattttgatgttattcaggcccaggcgtgttttctcaatggcttcccaaccctaatcaattcttgctacagagtgaggggctcctgggtgcatggttgtttcttagagaagccattcagaaatctcaaatggggagttcaagcagaaagatcctgaatacaaaattgccccagggtgcttccagtagtaccagctaacaaaactgtttcccaccttggggataatagttaaaaaaaaaaaaaaaagtttcccatcattaatagtagtcattgtaggtttgcctcatgtttgcctagaatatccataacttacggaatttttattctgatgataatcaagggcctgtggtgttgccatgagatacatgtccactgacttctttttagtgtagctaagagtaatagcaccatgccatggagaggcagtctccataatgacctgcccagttccctgtcagagtagcccttcagtcctccacagccccggatgaagacacttcattcccatggattgactcttctatccattactaagagatgacttttctagtccataatctgagattcatcctgtttctagccatagagactcttagaactagggcaatagctcagcagtgcagcatcaaatcacacaagatgctggtcccttctgaatcttgtattttggtagctatgcctgagcccttgccttattgtcatgtgaccaagactgttttatgatctacttcaatggttccaaaatgcaagtgattttgccccccagggggacattttggcattgtccccaagggggacattttggcaatgtctagagatgtccttggcttttacacttggtgacaaggtgctattgttatcaagggggtaaggccagggatgctgccaaacaccctacaatgaacaggatggctccccacaatgaaaaatcatctgggccaacatgtcaagaatgctgaggttgagaaaccctggactaattccaataatggagtccctgtcacatatccttcccagtatccccattcatgtttctagacctcacaatactaatcacctaatcaccttcctcctagaccactgcctacatttacattatactgacgcagtgttctgcccacatactgagaaccctctcttttatctactgtcagcataactgggctgcttctgatgccaccaggaatccatcatcccacctgaccaccttgagtctgtatagcatgcttgtttaacaacccaagctttggatccagcctacttgaatcaaagtcctggctcctccatttaatagctgtgtaaccttagacaaattaccttacctttttgagcctcagcttccttatccatgaaatatgaatagtggcaactcctacctcataaaggagataatacatgtcaagagctcagcaaacttcctagcatatttgtaagtgtttggtaaatgttaatcactgctcgttgctaagacatttgtggattgattcagccggcctcttgtacagtgattatcaagcttctagagcagcattatccagcagaactttctgccatgagggaactgttttgtatctatgctgccccgtaaggtagtcatatggctatggagtagttgaaatgtagacagtgtgactgaggaactttattttttaaatatttttaaaattttaattgtcagacatggctagggatgttatcataatgcacaatgcacttttagagtttttcaaactcaacatcccaccaaaaataaaattccaacaaactctcctgggaaagggaggggcattcttactctctccttccagacattgagaaccattgtcctagtgaggcactgtactgatgggagtatgttataatcctcaggtgggttgggaaataagaaggagctaagactggcatgactaattctagctagccctgcctccccctgctccactgagccactgtcaaaaaagcctcatgcccagaacccaaccagggccatagtgctcccaggagacatttggcaatgtccagagatatttttggctatcaattctggggtagaagggagagctgttactgtcatctagtggatacagacaaaggatgctgctaaacatcctaccgtgcacggaacagtcccccacaacaaattattatctggcccaaaatatcagtcacaccaagaatgagaaaatgccctagagagatccctaaacaatcccacacaagggagcatcactatgtgcttaaaagtctccaaaggtaaggggtctctaacctccctgggaattcggttcaatgtttccactaccttcagtttactcccttcaaattacctggaaggaaattgttcccctccatattaggagtagatattaaaaaccaacaattcttcaatttgggaaaatgcagacaaaggagagaaacttctaaaatgatgatagctgcagagagggagaactgggtttggctcaccaattgttaggatatcagaaagaaaagagtttttgaaacctgccagaattttactataagcaacagaccatgattcccacagtatacaataaaacaacttgtccttattaccccccaaaagataatacagtgtaaaagggtaaagatgttctcaaaaggggttggatttagaaatgtttgcggcttctaaaactataacagtctacttataggagccagaaatattaggaccacacttctttgaaatcgatagcatataacgaattcctgatctcttccaacaccaccttctgtgcctcagacacagaaatctgggctgaaaggcccatggagctgagccagtcattggactagatcttatatttctgggtcacctgaacttctccatgctgcagtttaggtacatcttttcctgtgtcgtcgtcaaggaaaaaaattgaaagctactgtgttcactccagaaaactaaactggataggtaattcaaatcataaacccatatttcttctcctatatctgagcttggagaaactgaactgtcctacataattgtcccttactttctcctgtgctttgtctaactacatgataaatgcctctatgtgacagcaatcagcaaggctgaaaatgcaaaatttaaccctgcagatgcttttccactatcagaggtttgaaagatagtaaaggaccctttaatgtttatttcctgaaaagatcaaggatagccacaggaagaggaattaactcctgctgctctggaggactatgcttacatttagggcaactgccaacaggtcagcaacagtattctacctctggagaccagcgtcagctgcctggcctgcctcaggtgtggataactgagagaaagaatgtgagactcaataattgtttaatgaatgtgacaaaatctcttctttcaacccttatcctccaattgtatcatgtaaccttacagtcagatggctacatatgaacaaagcaaccaaacaaacagcatttgacaggtatacggagcatggaatgaaaatcatggtggggaaagggaatgcttttgatgttatgtaacatgaattttgcttctagatttctgatctggtttcctttttacctcttttttttttttaaaggcctctccttaccgtgaggctactttcaggcctttttctttattcaggcgcagcccacactgcttttgtgagtgaaggtcagaactgcccttttgtaacttttcttttgcactcttagacccaactgagttcatttttgtcacccaaggtctcaactcctcttctttattcattctgattttgttttgctggcaaatgtgctcttatcaatatcagtacccattagaaaaaatataaaataagaagtgtttatttatattgagtcctataatatacttactagtaatctggttaccctggccctccaatgatactgtctctatatctgggttctcagccctgtccagaaacctttatcatgatatccaatctcacactagtcatgtgataagcagtgatgtggaaaactctaaatcagcttgtcaccatcctctttccaggacagcaatctacaagagaaatttaatttaaaaatcacacattgatttatacaaagtgaaccaagaactattatggctgtcctagaaagctatttgtatcaagctccacagtagggccacctacaaagctaactggacaccctggtagagtacggcttccttcctctgtgcaatgctagggacgcgttgattagacctttgcttcttacatttttcccatctcaataataacccacatctgctgattgactcattttttgattcatcacatcattttcacaatttcctggaaaacgtcagatctcaactgcatgcaaaatgccttcagggagggctgtctctccaaaggccggccactctgtattcccttcctaccttggagccttttaccttttttggttttttgtttgtttgtttgtttctaatatccatcccagggtggaccttacttttggaatcagtggttcccatcactcattagaacccatattttatgaagaaaatatatggaatgcttcattaaactgtgacaaaaatgcctttccaggttttatcaaactaaaactcacaaattacaaactttcataacctatggaattagtcatgaattttttttctcatagatttagctcctatcttttgaaaacttcagggcctctatgtgatgaaaactcaagaatagttttgtgggctgccaaacgttaaacaatgttatgtaatgtttgtctggtttaaggtagaacattaggttaattaacatccaacaaaacctgcaatatgtacttaagatatgtctgtatattcagtgttgtgatgtgattttaacatttgtttattgatataataaatcaaattgttggccttttgctggttaggggtggagctgtatagtggttaacagtacgggaggctttggtaccaaactgcctggggtcaagctctgggctctctacgtcctagctatgtgacctgggccaagacacttagcttctctatgactgagttcctcagatataaaatgggagtaattattatgcctatagcatagagctatagtgaggactaaataaaatactccagcattgtgcttgtgcctggcatatggaaagtgctcaacctccagtagccattagtattacttttatccctgctgcttaggctaatcctggctattgttttatatatataattgatctgtatgtatcaatattgacatttttaaaggccagtgggttctgtgacattatccccaagtaaatgttgtccatttcagtcttccaatctaaattatatacaccttggccttgaaagctgagatcatccagcaaatcctaactctgatgcttctgtttttaccagattctgagaaacagatacttttccatctcatgccaatggttgctccaaagtaacacatacatcaccactactagctaactaacctgatagataggcagagcaggaagctggtaatgtgaactgattagatgctggtgtttttcacttctgagtaatacagagaaatgaaatttcatttccacacgttccttggactgctgaacactgattttatctggcatgttaggatggagggaggagaacacagaaggtgaaaaaagagggattacaatttcactaaatccaggcataagacaggaggttcattttcaacatgatgctatcagaccagctgtgtgaggaagtgccagttggagaggttgggtctgtgagcagacaacattgtgtgtatgaatgaggcggctcctgataagggtctggccattaattacaaatgggggatttaatttcagaagcctgtgataaactccaccaagggtaacgatagggttcagaaaaactccaattagcagattgtgtccagtgatgaggttaatggaaatgaatgtatcatttgagcccttggtgaataaccttgtaaaagctttagccatttctgacagtggggaaaaaggagtatgatctatcctctaggctgtcctctggcaatagaatttagctgaaaatacagagaagctgactgtagctcaatctattcgctgcattgcaagtgttttatgtgatgagctctgagctgagtggctctgtcctatgctcattcatccagaaggatccttgaacaggatcctagcttttctacaaggaatccttggacagatccagtagcaaactcattatggcctgaatgaaaagtcccagggaaaggcaagacagtgtaacttctttagtggccatgtccttagcccacatcattgcaaattttaaaattcaatcgagttggttgatgtaccaggtttctttagaagtacagttatagataatataagccaaatctaaattcttggcctattgatttccttccctcttcctcacctccccctatctttatttttccttttaaaaaacatgattttaaacagaaagtccaagatctttcagtatgattttggagtttaaagagaaggcgaaatttgataataaataatcaaattgaatttttcacctgacctcaatctgaacacaaaatggctgttaaaagataatttcaaaaaaaaaaaatgttaaatcgtaatcttcatacaaatttaaagtaaacatgacaaagattttattcaactcattaattaatgagggaaccagtaggtaggccaagagtctgcaaactatggccttcagtccaaatctggcctgtcaactgtttttataaataaaatttattggagcacagccatacccattcacttacacttatggctgctttcattttacaatgaaaatgaaagtttcatttcattgtaatgaaacgacattgtaatgtaatttgttgtatggtccacagagtatcaattactgtctggctttttacagaagaagtttgctctcccatgatacaggctattggaaacatagaaataaactcacaaatggatacaaagtagtctatatccacaaggcaataatcaattatattccacccaataagaaatagttgcattacaatttatagagttttaaattaagtcaaagagaatcaaaggcatggataatccagaaaatatactagacaggacctctagtttatgttttttcatgatccaaagtctttcacaatttttcttaatagctactaggagaaaccttatgtacagagccaccagtagtagcagaatccactctatctgaaagtggagtaggaatcaagctgtacagtggattgtgaggcctgagaaagaccttcaccaaacttaagtccctaccagcctagtcctccttgaaattctcattttttttggctaatgccaaggtgttctttctaggtgccaccagttaaaatgtaaataccccccgctcaggacagctccagatattgttatcaatattagtaacttgtatggattttttttttcaaagaatagcagaccagtcacctaaagggacccagaagtccagggacctggatgggaaactgatacaatttagtaaacctaacctaaaatataagaacaatccataaaaggcagtactgattaagcctgcacaggaggcttgcaagacagcactgggttaacttgtattaagttaggtagaacattaaaaagtacacaaaatagaattgaaggggggtgctcttacggtttccatatgtcacagttttgcccaggtgaagactaaaccattactgtgctggggagtttgcttttgattaagatacattttttttgttgttttgttgagacagagtctcgctctgtcacccaggctggagtgtagtggtgcgatcttcactcactgcaacctccatctcccgggttcaagtgattctcctgcctcagcctcccgagtagatgggattacaggtgcgcaccaccatgtccagctaatttttgtatttttagtagagatggggtttcaccatgttggccaggctggtctcgaactcctgacctcaagtgatctgcccacctaggcctcccaaagtgctgggactacaggcctgagccacagcacctggccacttttgtaatacatttgttgttataatgataggaaccatgtttgttgagaacctagtatgttctaaaacaaacttatcaaacctgcgacctgcaggccacatgtggcccaagacagctttgaatgtggcccaacacaaattcataaactttcttaaaacattatgagatttttttgggtgatttttttgtagctcatcagttatcattagtgttagtgtattttatgtgtggcccaaggcaattcttcttctttcaatgtgggccagggaagccaaaagattggacaactctgttctaaaccctatgtagaaaatacacacacaatctcatttaatccttataattttgcccagctgctgtcattttcccattgtataggcaagggaattgagatacaaaaaggctagtaaatgacaaagccaagcaagatattcttaaattgcactgtgaaagtgtgtctggaattcattccttctggtgagttcatggtctcactgacttcaataatggagccgtggagctttgcgttgagtgttacagctctaaaagatggcacagacctaaagagtgagcagcagcataatttattgtgaagaagtgaaagaacaaagcttccacagcatggaaggggacccgagcgggttgccgctgctggctggggtggccagcttttattcccttatttgtccccacctatgtcctgctgattggtccattttacagactgctgattggtccattttacaaacctctagctagctacagagttccgattggtgcatttttacagagcactgattggtggattttacaaacctcttataagatagaaaagttctccaagtccccactagacccaggaagtacagctggcttcacctctcagaagccctcctcaaaatagtgtggacacagtcactcctctttccatctcctgatcatctgctgatttagtcgctatccaaagtactctgattatcttggcccctagatcacagctgtcctcttcagcccaatacgtgtcatcactctggacaacttcagcacccacccatgtggacaatgcagccagcatcctgacccatcagctccttgacctccccactccactgacctccacattcactctacttcagcccactgtgcccatgaccaacccacagctggtcaccattcagcactgctccactgtggacatcatatctactagcaccctactctctgtccacagtctcccatcctcccagtttgcctactctgtcttttcacttcaaagagacctcaagtccctcaatgtctccatttcctcccagacttttagcccttacctatctgatctggtcttcaagtgcaatcacctgaactacttcatcctcaacttcttctcacgtctggcaaaaccacaatcctgaatctatccaaaacctgaattttccatccccacatctggactgtcaaagctgctagagagaaaaaaaaaagccacattcttctgtgcatcactgccattataaatttacagctgctaatttacccaagacttcaggactgctaggccatccttttactttcctttgtcttcctctttctttccccttagcaaatcttccatacattgaactctccccacacaccctgccaacttctcctccctcactcaaagcatctgatctcacctcccatttcaatgagaaaactgcatttttagatgggaaatacttcagcttccagccctcttcaataacaaactactaacacctccattcaactcaccttttttcctccagtctctgaggataaggcatccttattccagactaagatcaacctccacctcaccccaacctttgctctggacctcatctctcctcatctcttcaggcaccctgatctacccacaagccccctctttcccttgtctacagcctcttccctcctccccgggtcctcccccaatctaatcaaggtgctcaagatgcagcctcatctcttcacagccacatttcattaaagaggcttgggatattaggccagaaactcagacaagggtgaagccttgttttaaaagctagggcacaggtgcagaagaagctgcaattcagaaactaacagaacaagaatgtcccattgcaaaagcctcaacagtaggaatttggaatgatggaacctgaggcaggcctcctgagtgcttcttatttcaggccttggttgccctggaaactggggctggacagagtccttggagtagataggtggagccacttgtgaggaaacaagggcaggcagaggctgatcctgtccactcttggtttcaactactattgctggctgaaggctctcacatctatattttcagccctgacttctccttcaagattcatgctggagttatacaatttcctgctgctttcccagtagggacttcaaagttaacaagcacaaaactgaacttttaaaaaccttaaacctgctcctgtatgcactatctcaattagtgacactactgttcaaccaggcattggaatatggagactcaatacccttgatttcttctccctgccttccctgacacatccaatgaatgccttaaatttgttattttttatctatctctagaatcactatctaatttaagatccttgcatctattcacctgaactgatgatatcttttaattagtcttattctgaaacacatggtggtgtgcttggagctggcttgcaccagctggcgagagcgggttatctgctcctcttcccaactccatgttccaggatgtcatattggtagcatgaaactggccacagtgggagtatttacaccacaaaaactggcaaacacacaaaacaggatattttttcctcccctgtggagagctggttgttaaacatttatgagcatgattaccactgcccatttcccacactgtggccaagctaatcaactatgccactctcctgattaaaaccctcagtggttccccgtggtcaacagataacatataaattccttagcatggcatatgaggccttttatcatttggcccttgcctaaatatccaatttcttctcccatctctttttagtctcacaacttatgtgctagcacgaaggtcacaaactggttcactggagccaaatttgtttcacatatgtattttgcttggcctgcacactgtctttaaaatttttgagccaacgtttataactttaagagcttctacccccaaatccatgtttccggcttcttttcaaaaatttataacactgctcctcacttgtgtttatgacaatttacaggagctgagtagtagctgccccctttgagagggtctctgcagtttaccagtttctatcattcactcgcccaaattatgcgtatacacctacacctggtcctgatttctgttacctgtttggcctgcattttagatagattattatcagaatcttctaaccctcattatagaactttctcttcctttactttggctgtcctgatgatagtccgtggtctctgcacagcctgggaaggaataaaaacagcaagatgatgaaggaggacaaagcagaaggggtagaaggaataaaaagaaacccgtagtctatggatcagtccccactttgaagcaatagaattgtgaaaaatacaggcagaaatgtcccaagtttgtgagacctcgtagtagttccctgcagagctaatcatctaacccttcttggagtcttgggatgtctgccttctcagctggacatgggaaggagaggtccaaggaaattagctcatattgacccaaattgtgggagtcaggtttataaacaatagagtcaatttctcttttcttttctttacttttttattggagacagggtatcactctgttgcccaggctggatggagtgcagtggcatgatcacagctcactgcagcctcgacctcccaggctcaagcaatcctcccatcttaacctccctactagctgggactacaggtgcttgccatcacacctagctaatataatgtttttgtttgtttgtttgtttgttttttagagacagagtctcactatgttgcccaggctggtcttgaactcctgggctcagatgatcctctcacctcagcctcccaaagtgttgggattacaggcatgagccaccacgcctggcccaagagagtcaattccttaatgtgaaaacaggaaatttaatttatttttgctgagtgcctgctgtgtgtctagcactgtgctagatgccataggggaaacaagagcagaccaggacaactctgccttcaaagagctcataaccttatcaaggaggcaaaaagtacgtgtgtgaagtaatttgagaataatgtaagacagcatcagaaaagtgattttcttgcatgtaaccttgtgcccacagtatttgagcgggcagcaagagataagctcaaagttaagaggaggagctattgaagaagccagaacttgcaatggcccctgagtggcagagaaatggggcgagagaccattccacacaggggatccacaaggatatacacacagaaagcaacctgtgagtgacaacactgataggaggagaaaaagcagtctgggcgggagggcaaggttggtcactgtagaccagttttctttttaaaaggtttcctctctggtgttaggtactcaggaagccgaatggagaataataaagttccttgttagacaatataatcgagtagtttcagaaagcatttcatattctaggcatagacaacaacaaccttttggctctatcatacaagtggggctaaacactattcacgggtactgctgtgtgtattggacaggactggcagcactgccttagaagaaaagaaaggaaaagagtaagaaaagtagaaagaataaggaagtggcggggagagagagagagagagagaaagagagcgaggaaagaggaatagcatggtaggaagcagacccatacccataatcgaacccagggaatcctgtgctacaggttagcctctcttcccttctgctcaacacttttagaccctgacagagatgaggaatgcctctgcctggagaaagggcagatttctcatctgagctcgcttcttcctgggcagactgtgacaaatttctcacttccccatctctcccaactctaggctttatgctgatagtgtttatgttcatttccagacccactcagacctacttcttccttagcctgtaagcttatgttaatttctgagattactctttcctgtgtccaatttactttatgagccagttgctcacttcctgctgtcttgtttgtagctgctccctctaaatgtttaacagtgtttactcgctgctccatcctagccattaatgaccattatgcagtcatctttcaactattcagaggctgatgcaagcactcagtgaaggaaacaggtttcttgcaaactcctcctcctccacctttctcctactgtatgttttctggccacttccctgtttgagaatcctgcgtgcaaggtgggagggaggcaatgatgttgaaaaacagttaactcatccctttgtcagttcgccagtaactgtgggttgttgttttattttttaaaggagttttgagagtaaaaagaacctattgattaaaacacgatttgtctctctgcttacatttacagagataaaaaaatctaaaacaaaacaaaaatcccatgatttgtctattcgatgagactcccaattatccatggtctgtcctacccagttaaaatgaacatttggaacttttttttcctaaagtgtaataaaaatcaatatttcccaattttctggaatcctagacatgttttgaatactcggctccacctcttaaagcctctgttgcctctgttgactattccagccctccccttctctagctctagatcctaccacacttaaactcttctgtgagtctagcaagctgcctcagtttccctactggactgagaaaagactgggtcccaaaagagacttttttttttttttttttttgagactgagtcttgctctgttgcccaggctggagtgcagtggcgtgatctcggctcactgccagctctgcctcctgggttcatgccattctcctgcctcaggctcccacgtagctgggactacaggcgcccgccaccatgcccggctaattttttgtatttttagtagagacggggtttcaccgtgttagccaggatggtctctatctcttgacctcatgatccgctcgcctcggcctcccaaagtgctgggattacaggcgtgagccactgtgcctggcaagagacattttaaagtcgaaagattttttaattcattgatcaggttctgcacactcacccggaagtgctcctgaatacccaaagaagcccccatctttcacctatagctgctatttacactaaacattacatcatggacatagcagttttatcaatggtactgttgctatcagtatcccctccccaagccgagaagtcttcattttcagagtacttcttcctgaccctaacgaatcatctttaccttcctgggacctacaggaagttggacgaaccctgtctggccttgggctttggtcccctgaagttatatatatagtctctactgctcatttggaactgagcagataatactatgtactgttaccagttttatgaaagtttgctctacccaagtaattctccaggaggtcaggaaaaatgtcctttacttctctgtattctccagtatgtctcagacagaaatgggcatgttgtcattgcataattgacaatttgactctagagcttggctctagagtcttgcttgggtttgaatcctggctctgctgactaaaaactttgtaaccttaggtgtgttctttaatctccctctgtctcagcttcttcatatgggaagaatatttacctcacaaggttgttgtggagattaaatgagtaaagacatgtaatgtgcttagaatagtgcctggcacacaataagcatcccacaaacattagctataaggaaggaggtttaggaggtcaaaagaattgaaacaagaatggagactctaattcctgaatcgccagcattttataggccctatgcttctctctccaaactttaatcctgcccttctattcttctcatttcttgtacctaggtccccactctgatgatggacacgcagttctctgaattcacaccggacatcactcccatcatgctggctgcccacaccaacaactacgaaatcatcaaattgcttgtccaaaaacgggtcactatcccacggccccaccagatccgctgcaactgtgtggagtgtgtgtctagttcagaggtagacagcctgcgccactctcgctcccgactgaacatctataaggctctggcaagcccctcactcattgccttatcaagtgaggaccccatcctaactgccttccgtctgggctgggagctcaaggagctcagcaaggtggagaatgagttcaaggccgagtatgaggagctctctcagcagtgcaagctctttgccaaagacctgctggaccaagctcggagctccagggaactggagatcatcctcaaccatcgagatgaccacagtgaagagcttgaccctcagaagtaccatgacctggccaagttgaaggtggcaatcaaataccaccagaaagaggtaagctgagctcatgtctgctttcagggaagcttaaagcctccaaagtctggagcagcagagcaagaatcagcatttttctaccatttagccccctaacaaacaaatggttgggcaggcctcacagctaggcccatttatccgaggcacagacaacctttttgtattttctttatggccagataagtaaccatctgattctttggtggaaaagcattcatgcatttaacaaatgcttactgagcactgttcggagtgtttgcgatacagaagacagacaccgaccctgctttcatggagcttacaagctggtggtggatatagagtaaatgatcactttaatgaatacataattacctactaagatatgtactctgaaagaacagtgctctgtgagagcacataacaaaggatcctatcctatatactggggacatagtgggcagtgattacaggagggtcgctgcctggatgctggtaattgttggcacaactgaatccctggcagccccttagcgagaaggctaaaaaacacatttgaaagatgaagtcatactcaaggtttgtaggtcaatgaaaggctgaagcaggatctgctatggtatgacctccaaaatgttaggttccacgtctttgagggaggtcagttcaagcaggtcacaggtgaggctttgatttccagttagggaagatttacaatcaaacaggtgtagttctatgccaacttatcagacagtttgggagagcctcctaacaaggctaacttagccctttaaggaagcagcatgataccacggaaaaagcagggactatggagccagagcaactgaggatagaattttaacccactagctgtatgacctaaagaaactcactcctattttcagggcattagttttctcatttataaaatagagatgaaaatagtttcttcacttcataggggattgtgggaaataagaaaagctaacattcagtgcatggcaccagaagtgctttgatgtccatttccatctcttttccatgctacctggagtcaaagcagctgaggggtgcctgccagctgaagggcaactggcagtgccattccttcatggatcaggctctgaggcaaacgtcattgtgtgtttatctggtccctttttctcaggcaaaaataaaactaccacgccttagaaatgaggcaaaaaacaaataccagggcaacctggaatgggataaaaaatgaaaaagagcaacatggagatcgaaagggctatactggaggaagtggtaaatggttaggcccacccatgagtccccttattttatttttgccatttacctgctttaagttatttcaataagcctggtgttgtgctcacctccctggagaagtgtaaagataaaataaaataggtaatatacttacgcacagcgaaataccgagcatacagtagcagtcaataactattagctgggcggggtgtggtggctcacgcctgtaatcccagcactttgggaggccaaggctggcagatcatctgaggtcaagagttcgagaccagcctggccaacatggtgaaacccagtctctactaaaaatacaaaaattagctgggcgtggtggcaggtgcatgtaatcccagctactccagaggctgagacacgagaatcgcttgaacctgggaggcagaggttgcaataagtcgagatcatgccatggcactccagcctgggcgatagagtgagactgtgtatcaaaaaaaaatttactattagcggctataattattcatttttatttttacacatggaggactcgtggtatatggtctaattctgtgcagtaaaatggcaggtaatagatatagtaaaggcccatccttctcttatccctccctctctcccacagccctgctgttgatgtgaagtatcagttatcgtgttaagcagtctgccgtatctacactttgatatatgtatatatttccattaaagatgtatattattgtttcagtgttttttcactttacataaattgttataatactgtgagaaaaaaaatcacagatatttgtagaacatgaattgcttccaagtgacagaatggttaatgggaataaaatagtttttaaaaaatagataattgcagaatacaactaaagtttacagtcctcaccccactgaatatgagatcaactttacaattttaggccccccgttctctttaaaattgagaatgcatttatttgcaaacaatttcactgcaatatttcatcaatttttgtgttggtaggtcaccttctgttgtatggcttgactccacttgctcatatgatcttcatttgccagttttagttaccgttgcatttgacaaccaatgtgatgactttctcactctcatggggatctgcttgtcatatgatcacttttggattctacattaactgccctccaatcctcattaaccttctcattattttttcctctttcttttagtccttttgctgtccagaaattttgtcccttgtgttctttattccataatttcttatcattgtttttacacaatatctttatgctactatattttcgtatctttctcaactctcatcccactaatctgaatgtgccacagggttttatttcttcttgttctcttgattaagcatcagagattccaacattgtttccagggtccattcctgtgtacattgaagtggactttttattgtggtaagatatacctaatataaaatttcacattttaaccacctgtaagtttacagttcagtggaattaagtacattcacatcgtgcatccatcgtcactaggatgcatttttgaagatgcacaagttttggagtgtctattttactttcaatagtgaacttatctaagcatagtttcatatttcacaaggacacacttaaaaaattaattaattaatttatttatttatttatttatttatttttgagacggaggctctctctgtcacccaggctggagtgccgtggcacaatctcagcttactgcaacctccgactcctgggttcaatcgattctcctgcctcagcctccatagtagttgggactacaggcgtgcaccaccacacccagaaaatttttggtttttttttttttttttttttaattaatttatttatttatttatttatttttagtagagacggggtttcgccatgctggccaggccggtcttgaactcctgacctcaagtgatctgcctacctgggcccctcaaagtgctgggattacaggcgtaagccaccacacccagcctatttttattatttttggagacaaggtctcactatgttgcctaggctggtttcaaactcctggcctcaaactcctggcctcaggtgatcttcccatctcagcctcccaaagcactgggattacagatgtgagccaccatgcccagccagctaaattatgtttaatccataacactggcaaagtagcacctcttaactattcaatattatggatattcagcagtaatttcaaaagtaagtaatcaaagtaatttcaaaagtaaatcactttttgaaaagtaattcaaaaagcactctatttatgcaaagatcaacaattttaggcctggtgctattcactgatatttgtgaatcaaataaatgaaaaccatggtatttagtagactgaattatttcaatcaggtcacatcaaactctagctccaggtatacagccgggatagtgagtgactgtcaacttcaatgtcaatagtgataaagaatataattccaaagagccaccgaaactcaaatatggcctaaagtttagcctcatagccagagacttcagaatcatttggagatttatatttatatattttgctccaaattttccaagataaattatcttagcaatggccatacatcaattttaacataattagtttctcttcaaactaagccacgatgattagaaaggcaggcttgagaaatcatatatatcttaaagtttacactccaaaggcattgcttcaggaatgtaaaacataatttatactcatcaaactctataaatcccttctgaattgtgacttcatttctagaaaaaaaaactgtaatccttcctaatctgtgaattagagttttttaaaaatatgtggtttcattgagtctcaaatgcatacaacctctaatttctctctattcaattcacatgtctggtttaaggctgaataatcccaccttcttaaacaaatcagcaatgtcctttttggggttgtgtttttgtgattttaactttagcatataaatttagctcaatgatgtgagctactgaggttccaacaattcaagtgtctgtgagaacttcattctcaaaagtccttgatttgaggaatcagactgataagtctgttcagtaaatatccaaaatctggtcttaaaaaaaaatgaaacactcacacagtgcttagggccacaagcataaaaaagtcatgattttgatctttattttatcacattatataatacacttgatttttgcagtataaactcttctcatgtaggattggatgaaagtaggcaaaccaatctttcctttcgatgcaaataaatgaatgaaacctaactttatgcttccattattattattattattatttatttttatttttatttttgagacagagtttcactatgtcacccaggctggaatgcagtggtgccatctcggctcactgcaacctccgtctcccaggttcaagcaatcttcccacctcagcctccttagtagctggaactacaggcatgcaccaccacgcctggctaatttttgtatttttagtagagacaggttttaccatgttggccagctggtctcaaactcctgacctcaggtgatccacctgcctgggcctcccaaagtgcttggattatagggatgagccaccgcgccagtcctatgctcgcattatgtttatggcaagttaactcagcttttccatgttagacaaaatttctcaaattctttgaaggcatatagtttatgtgtgctaactcatcaagaaaaaaacatattaacatcttaagtgggtcacaccccaggatctagtggaacacatttaccctgagggttacatatcaggagccccaaaccaagatggaaaggacattttcttttttttttttttttcaaatgaccttcatacccgaaagaagcctgtaggggaatggacaagaattatttcccaggaacagaattattcaaagagaaacagcctctagatgataatgaaataactgagctaaaagagaaaagttgtcttttccacttgattccatgcttaataacagttggactgtgaggttctgtcttcaaggataggtaggattacttcctcaatgtctgtaatgaggaataggacagagcagaagcattacttctccactctctagtgccatacctgatgacaacttgctaaatcttttaaagtgtgctgtgattccaactggggaaaaaaatgaagaaatacccagtacaaatggaatttttctcgatgagtcgaggtttgtgggggagaagcatcaagaactctggcacctgggataaggacccaaagataagccaattcacatcttaagtttcaaatagacaacatgtctttttaaaacttgagattaaaagctgtatttcacacagaacattttttttcttcataaaatgtgctgcaacagagctgatttccaaagctggaagttgggggtttgcctacattaaaaacttcgaagttatagtttcaagaaaggcgtgttcccccaagtttaagtaagaataaggttactagaatgaccagtatttccagaatctgtcataatacagaggtatgtgtatttacacgcgttcaacaacagattttgttaatgacaccttttttttgttttttgtttttttaaacagagtttcgctttgttgcccgggatggagtgcagtggcatgatcttggctcactgcaacctccacctcccaggttcaagctattctcatgcctcagcctcctgagtagctgggattacaggtgcctaccaccgtgccggctgatttttttgtattttagtagagatggggtttcaccatgttgcccaggctggtctggaactccagagcttaggcaatccgcctgtcttggcctcccaaagtgctaggattataggcgtgagccaccgcgcccggcctgttaatgacatctttgattagaggaatctgaaacactaaagttatgtttcataactgtggcccccttgtccaccttatatgaatatttgtggtaaacttaaaattatctttgagatgccttcagtatttttctttctttctttttttttttttttttgagacagagactcgctctgtcgcccaggctggagtgcagtggcacgatcttggctcactgcaagctccgcctcccaggttcacgccattctcctgcctcagcctcctgagtagctgggactacaggcgcccgccaccacgcccagctaatttttttgtatttttagtagagacggggtttcatcgtgttagccaggatggtctccatctcctgacctcgtgatccacttgccttggcctcccaaagtgctgggattacaggcgtgagccaccgcgtccggccgccttcagcatttttctagggtctttaagatgaaattgtgaccaggtataagacttcagtgattttccttatcttgtaaaatgcagttccaaccttcataagtataatggcagtcacctccaaggattatttattaccctgaagagatgtgatattggaaactgacagttttatttatcaatacaagtaattcacaaataactaacttcaggaactagaagtcattttttctttctttagggattttctgttggttggttggttggttggttggttggttagttggtttgtgaactttctgagggttaaatagacagaagaaaaccagttttaaatatgggctggagggagtaggatctctgaaaaaatataagcagtattcccaagaggtatcactaagtacatctagtctattaaggtaagactgtcaatacaaaaacacaatagctttcatgtaaaaaaaaaatcataaaaatcaagttggatcacaatgggttaataacgttcagagttacataaccccctcaggaacaaaatcttagccttaaatggaatataattatttcctgaagggctttttcatattgttttttcctcattattattcctactagaactcaagtagactccccaaaagaattcaatttggttaaaaaaaaaaaaaatcagctccaaagaatgaaacaatagctgattccaaactctaactttggcatgaagtagaataagaaagctcttatctcttagaaaacaggtgtaaaactattggataattatttcatatcaaatagactttcaggtattgtcatacaaactttttgcagatgggtgaattttctttttaagttctggggtacatttgcaggatgtgcaggtttgttacataggtaaacgtgccttggtggtttgctgcactgatcaacccatcacctaggtattaagtccagcatccattagctgggaatccattcttgatgctctctctccccaccccagcccccaacaggccccagcgtgtgttgctcccctccctgtgtccatgtgttctcatagttcagctcccacttatacgagggaacatgtggcttctggttttctgttcctgcgttagtttgctgagggtaatagcttccaactccatccatgtccctgtaaaggacatgatcttgttcctttttatggctgcatagtattccatggtgtatatgtaccacatttcctttatccagtctatcattgatgggcatttgggttgattccatgtctttgctattgtgaatagtgctgcaatgaacatacgcatgcacatttttcagatattcctgaaaagtcgtgatttcatatattctgtctcaatgccagatatgtcatgccaaaggctttgaaaactattatttcatttgttccttattatcactgaaggtaagcagaaaatttattaataaccctcattttgcaaatgagaaaggactatgtttagagatttgcttaagatcatctgacaaagccagaagtataacttcagaatcctggtacaacattctctcttattatgctctgctaccttacgttgagtgaagttcttgtgggcccatttggtagcctccaaattcaccaccaggtaatttaagatgaccacacgtttttttgatttgtgaatgaaagtttattagttaaaatctcttgaaagaaaacaataaaatggtttagatcaatagctaatacagattgtaaacaatcataagataataactagcagtaatcatcacacataagaatttatataggcacaactccccacatattttaacccaaacaaatagggatgaaaacttgtactacctaatctaatgccatctaccagcctatcttccttgattttcacacctttaagcttgtctcagaatgatgagcccctctcttttctgccatgctatataataattggctttaacactggtcttaagaagatacagaaaagggctaatttgcataaaggatcagccactcactccattctcctggaggagatgcaggatttcaatcagcgatatccagtcagtggactaaactagttaataattctccatctaattgagctttcagatacatgacttatgtcaatcgcctaccagctgtttatagcaacatcttagggttggctaatttgcagaagacaaaaacagggctttgttcataaacctgtttagaaactaactccatatcatggctttccatcataaaccgtcgcataactgttgacaatttattaatttgcttctctctcctgaaaacaccgtccccactagttcttgttcctaaatattttcttatttcctaaatatttcttttcactattaactctaattctgctccatagagcaaacatacttaatacaacaatccattccttggagcgggggttatatcttaacaatccttaagcacataaaattacagaatcaaagcaaacactggaatatatcttatctagttcctgaggtaccattacagtacaatctgttcaggtgacccaggaaaacaagggtccagccagctccacatattatggggttgtagcatcttcctgctttgatgcctaaggactatatctagtccatagatatttagtccaatatggtgagtgtttgtctttccattggtgaatagtccttgtagggctttgcttagcccttctattacttctctctttgattatttggtatagtgtgccttttccatttggggaataatagtgcaaagtagctacaatgtggtcagaatttgcaagaacagtcctgcactggaactcttggtcccagctttttcagttttctccttggcaacagtcatttgaaaacctttcttcacttttattatctggtagatagtactcttttaaaattacctcccttagtctgctatagcattttttgtcggacacatgctttcttaaaggataagtaaggagttatatcctttcaaataaaagtatcccaacactgtcttgttaatgtgaatgtattcatttactgtaatgctaccctgggggatattccccttttcatttgcattcattggagagcagtgaaattagtcccaagatgtgatagagttcgtcagttctccactccataattaggcaaggaatttcttttctttactattgtttgctcccatcatcagaaattctagcatgagagtaagtacaggtaaagggagacctacatggcaaaagacagaactttctgaataacaacaaagatgaaaaaagaccagcttttgctagaagtaaatcaaatctcacttgttatatgggttattagtaatgaaaatgtgcagaactatgagaaaacacatattgctaatatacagaaaataagaatatattaaaacagagaaatgatcagttttcacatccctggggacgggggcagaaattgggtcttagtcacctgttaagtcatcatttataccagagactgtatcttcatataagttatccatgtctaacatagcctgatctatatcaaatattaggtcttcatcctctcttggtgtaagtattgagtctaagtctgagagatcagggagatcaggtagcgaaggctcctcgggaagaggtgcatctgcttcagtctcttctgctctaccattttcttctacataaggaacttcttgtacttgtagaatgaattgtaaaagctcatcagctattcttattaactgggctacacaagcaacaagtccatcaatgagtacatgaattaacacagaatccatgctgcagtgctcttctaaatagataaaatatcactaaaagctctagcaaatggactcttggtgacaatggatagtataaggggctaacaatggttctgtggttggtttaggccagaaattaggatgttgatatgattatgatggtgatcaagtaaagaatgagaacagtagaacaatataactttttgatgatgttggtaaaccgcgcacagaatttatgtatggtactcttgtttgtactaatggtgaactgctgttataatgaccatcaggcggactgtcacagccaagagaaaacagcaaagcagacctaataataaaaaagagagatataaagattagtatctttgagcctttatccatcctacaggctatggctactggttacccctatcaagaattgctgttaaggttgaaacgatatgtctaactatagcccctcctttgttgctggccttgtgaggctctactacttctctttcctttgaaaacctcatggtctttatctcttgttaagagatttgggagaaaagtgagtataggtagtttgtctgtctttcttgagcatctcttttgaggaaggatacactcacgcagggtctgtcaattattagcacctttgcctcattgccatttatatctgggtgctgctgaattctttctgtgtttctaggaatccattcattaaagtttccagatgccctgcagcctggggagtttatggtaaatgaaagtcctatattctccatattttgccaaactttggagaatttcagttataaaactagttccttgataatttcctattactgccccacttccatatctagcagctagttcttccaactttatctaaagccatggttgtactattttcatctgcgtgtctagtgggctttgcaaacccactttctgagtaagtatatatttgtgtaaggcaatattatttgtttgaaaatctagatattggctcaatataatctacctgctacatttgtctggtttaccactccccaccacacttaaaatgaatctgctgaggatgcaagaagtttttaatattttgatatcactcatatttcttactcacttgtttatttgattcacaggttttctaactctttcttctctgctaacctggcacatacatgcccatatgccctgaggtttcacaagcccatcctacaaccttaaattgaactgaaaagggagctgagttgaaacttaaagtccccgaagcttcagggtctacattagttttgggggcctagattatctcccctctcattccaaatagattattctgcttttctgttctaatgagctgacacatgtctttataagaatttctaaattctttcaccaatttattttcatatctcccttcaccagattgtttttcctgcaatagtccaggtctatatggctgatcagtgtagctatatacctttgaccagtttttttcttgggtatatctacatgttaaatttctggctattaattctgtaaattgggctaacttcctttctccagtcccagtcaggcttttcctagttgaaagtcttaggaagtagtcatctatataactcctttaggattctaccaagtctattattgcccagttttcagcagttctgaccagagtggggcccagcaagccacaggcttcactttcagctgactataatccttgaatatttattggagtacagaaaatcatcagccagatggtctgtgatttgcacatacagcttgctggtcttcacagggccttttttgacccactcagttgtatagtatctccacttagcctaagtcctatcagatcactacattttttttttgtccaaaatcctaccagtacacatggggtttgtcctgatgataagggtcacaacgataatgaccagaaggcacgattttgttggaggcaattttccatatggaatataggagaacgggtactagaggcagagcagtttgttttattaattcaaaggatctgtttgtttgatttaagagaaaaacgtctcatgtaagaaaatatggagagaaatcaaggaaaggaatttggcatttatttagaacatgcatcagctcatcagaaggaaaacacagaagaaagatgtgtgttaaatattgtaagagagcaccatcacatttttcaaaggaagcaataactactagatggtatatacagcccaaaggcacaagaagatgacaggaacacactcacacaaaacctatttaacttctgacttcccattcacccagttttttttctcagcttctctatcttcctctgggactcttttattcctcctcttgatcaatatgcttccatttattcacttatgtgtttcattctatttcacaccctctctatctccatctactcttaaccttttccatcatcttttcttgtctctctctcctaaaactggaaaaaaattggaataaattatatttgattcatcaaatttttattgtatttattgagttgtacattacacaacctaaacataaaaagcagagaggtagaacattccatattttgctctcttataagagaaatgtagttacttattactttatgtggcccatgagtttttttgtggggcgggggactcagtcacttttgatgggaaaaaaaattagtgaccttgccttaactttcttgacccttgtattagctttttttttattttttattctcaatctcagaatttagcaactagtgggtgaggagagggcaaggagaaacttgaagaaactgctaagtattccaataataagaaagagtaagagtgtggcatcagcttatgccagttatggtaatttccaaagcaaccaactctggacaccttaactagcctaaaggggtcttttggatagtttatgcctagccttaactcactttaagggactttttattagctatatcctctgcctgggatccctttctccttggtgggggaggagtggggaatgatttcgtgtcattctgatatctactttaatattatctcctcagatttcttacccctcaacctgggtaaagcccctaatcattcctttcccattacacacaaatttcatttttgcatgatggtatctataactagctcacattttcttgcttaattatttgtttttctgtctctcaccttacccccacatacatatagactaaaatgtaattgtcatgagactaagaaatctgtctgatttgttttctgctatatccccaaagaacagaagagtgcttgccagcatagtatataatcagtaagtgtctttgaaaaaaagaaataatggaaggagggagggaggaacaactttcagctcattcattcagtaaatattatcaagcttcaaccatgcatgtgggaaacaggggatacaaaaatggacaaactcatcaaatcatacagttaataaaatgaacaggcaacccagagactgagagaaaatattcacaaaatatatatctgacaatgaactttcaaccagaatatataaagttcattgtcagatatatgtgtgtgtgtgcgcacacacgcgtgtgtgtctatatatatatatatatatatatataagaacccctacaactcaataataaaaagacaaacaacccaacttaaaaatggccaaaagatctgaacagacaattcaaatgaagagctaataagcacatgaaaacatcctcaacattattagtaatcaaagaaatgcaaattgacatcacactaagataccgcaatatactcagtagattggctaaaattaaagactgacaacatcaaatattgacaaagatgtagaggaaccagaattctcacacacatttatactactggtaggagcataaaatcatattatgtttttggaaaaacatctatcagtttcctataaaactaatcatgcacctatctatatcccagcaattctactcataggtatttacccaaattaagtgaaagttcacaaagtgacttttacaagaatagctatagaagttgtatgcataatcaccaaaaagtagaaagagctcaggtaactatcaagaagattatgaataagcaaactgtggtatattcacacaatgtgatactaataagcaataaaaagaaaggcactactgagagggacaacaacatggaggaataatcaacattatacttaatgaaagaagccagacacaaaagattatatgctgtatgattccatccatatacaattttagaaaatgcaaaataatctatgtagaaagaaatcagaatagtgcttgcatttatgggagtaggaactgattgggaaggggcataaaggaactttctagagtgatggtaatgatcatgtttaggtacggttgtgggttacacaggagaatgcgtgtgtcaaaactcattgaatggtactctaaagatttgtacatttcactatatgtaaattttactcccctcaaaaaagtaaccaagcacaatccccagcctctgaaagcatatgtcagatgcaatgatgtacccataaaaatttttctaataaattgtcacattaatgggagacctattgtgtgtcaaggactgtaaaacccacttttcttatattacaggttgagtatcccttatccaaaatgcttggtaccagaagtgttttggatttcagattttgaagtatttaaatatacataatgagatatcttaggaatgggacccaagtctaaacatgaaattcatttatgtttcataaacaccttatacacatagcctgaatgtaattttatagaatatgtttaataatgttgtgcactaaacaaagtttgtgtacgctaaaccatcagaaagcaaaggtgtcatgttggtgctcaaaacgttttggattttgaagcatttagtatttcaaatgttgagattagagatactcaacctgtagtacatttaatcctcacaataaaatcagcctatgaagttataggtggaaaaactgaggattagagagattcagtaatttgcccatgatcacataagtaaagatgcagagctggatgtcagcccaggtcggacttctaaagtcctgtgctagagggcacaaatttaggtgactacaggagcaaatttgccttattcagggccagagctgacatctcattctcctaagcaggaatagaactgagaatgttaatgtcatttgctatccctagaaactggctgaattccaagttgaatgtgacttaggcagatcagtcccctaggaaatccccaatatctgtgactgggaggttcagggatatatccattacctatctttccactgacctactgaattggcccaaatgttcataaactacttacctgtgatagagctgagagggatgcggatatcaaggctcggcctattaaacaatttgcagactttgtttccaaacaggatgtgaacgctcctgcaacaacaaaaaaaaccacacccgcccccaccaaaaaaaaaaaagataaattgcgaaatcgataggtttaaggataagcaaggacgagattaaagagccctttctaagtgaactgacaatcaggggcttttttcctttcctgtggcatttgctaattctgggcactgttgaagatgaagcttggctgtaaggcagaaggactctcctgaggaaaggagaaatgagcataactttgggccattgggagacactaaaataatgggctggaaacttgagaagcccaaaatgcagggctagtttttcttacctgaagtcacctgagttctgggctggtgtctgggtaggaaaagcacaggaaaatctcctgcagtctcctggtacttcagagacaaattctccctctagaggggaactgccccaaacaggccaccggtctccaccttaaaaggttacctagattttgaagttagagggacaaagggaaaactaatgagtcaaaaagatcaaaaccactcccaaagggcaatttggacaaagtgattctaaaatgcataagaataaataaaggctagtaatagtgaaacatcttcaggaagaacaaattgaaggacatatgctaccagatatcaaggctagttacagagctagagaaattaagacagcgtagtactggctcaaggacagacaaataaatcaatggaaccatgacccttacctcataccagataccaaaataatactaataatgatttgaaatgaatcataggcctaaaaatgaaagtcaaaacaacaaagcttctagatcacaccaccagagaaactcttcatgaccttaggtaggcaaatatttcccagaggacaaaaaacattaaccatgaaagaaaagattaattaattataccttaagaggataaaaagccaaccacagactgggataaaatattcacaatatatatctaacaaaggacttctatccactacattcatacattttttaaactacaaatcaatacgaaaaacataatcaatctaatttttaaaaaatataaaagaattgaactggcacttcatagaggagaatatccgaatggctcacaagcatataaataggtgttcatcactattgctcatcagggaagtgcaaattaaaaccacaatgagatatgcaaaacccaccagaagagctaaaatgaaaaagactgacaataccaagcactgaaaacatggaacaactggaactctcatagattgctggtgaaattgttaactggtaaaactaccttggaaaactatttggcagtatctactaaaaccaatcatacctctatcacatgaccctggaatgctactcctaagtatataaccaaagagcgtacaaatatccaccaagatacaggcacaagaatgttgaaatcaaccagatgcataaaattagctaccatatcactacatttacatgaaatccaagaacaggcacacaaatctacgggaacaaagtggttacctctgggtagggggttattgactgggaagggatatgaggaagccttctggggtgctggtaatgttctatatcttgatataatcacatatgttaaaaaataaaagcattgatatgcacccttaaaatttgcgcaatttactatatgcatgccatacctcaaaaaaaatagttttattttttaaattttaggcctacatcctataaaaactaatgaggacagcaagacagtgataagagtcttaccaggattcagcaagccagtcatcaaagttaatgaaaatggaatgaaatatgaatgtgcagggcagtgtccctttggcctgtgtggctctctacttcatggcagtgctaaggcaagagaccctgatagctaggccgagtttttaattgatacaagatgagataacctatatcttacaagtagctcataaagacccctgaggcagaggccatactatccatctggtaactgagatctttgaccccattgaatttttattaacctctcttgggactttttttgtctgcacaactaatcaaaagtcaccatttttcttttagctgaaagtcctacctggcaattttgcaatgctcctaactggaaaactggcaataagtgtctaacagtaggatggaaaaggagcaaagaaatccaaatcctctgggtctatctttatagttgataagcttctttgtattaggtaaggtaaattagttcatatccaaggagaacagaggcagttatgtgggaaagattaaaatgcacctttggtgagggtgggtgccagattcctatttacaaacaggaaaatttttttccatagtgttcccttctccggtgctgcagtaccatttggatacatgcattcaatatagcttgttttaaaaaacacctacagacatataacttctcgttaccctcttcaccccttgaggaaacatcaagagaactttatccacaaagggcaaatgttcacaattttgacataacagaagcatctctatgggaatacaatgaataaaaaagagtatttacactttaaactctttttgaaaaagctacaaacttttgcctttaaaaaaataactgtgtgcaatacagcatttgcctgttataggatctgacatttaaaaatccccatgaagcatctttaatttatcaagaaagaaaggaaagaattgtgcagctgaggagctaaacatggccccttcttgaaaatatatgaaaaattcaaaactaaaactaaaaaaagggggagtaggaaatgtccttatggtcaatttaaaccaaattctactgaatttctttcctcctccaaatttgttcattgctgcagagaaaaatcacagactggcttacccttcagaaaaacaacttagtagaaaaatacaactacttttgaaaatacatcttggttattttcctagacagatacagtgtttcctcaaaacactgttcaaacatgagaatagacactcaatcttaacctggtaggaccctacacaggcttgtccttgaggcttggctgctatgagaggctcccaggcccttagagagtctggaaagagatgtaatacttctagaaagatttttttggttttcaaatattacagcgcagatgacagggtctacaataagggaaataaaaacagaacttggaggtaacaggaaaaggggttctatttccaagtctttcttcagctttctgagagggaaaaaaagttgtggttgtttgtttgtatatgctttttgggagagatataaaatgatactagtggttataagaataggatctggtatccgaaaaaaaaaaaaaaaaccctatatttgaatttcaacttcaccacttactaactagaaggttgctaagctactctgtgtcagtttcctcatctgtaagatgaagataatgacagttatgagaattacattagttagttagcacaacgaatttaaaatggtgtctggtatataattagcacctaataaatgctagctgatataattgcactggagaaattccaggatctaggaaatagtatgtggtacatcatgactagtgaatagctgcccatggaagacaggagaagagatggctgcaggcattacaaaaattggaaggacatgccagagacacaattcatctcatagttagaaccaatattagatgatgactttgagcttgggtaaaaatgtgagggaacaggactgtcttgaagctgtagttcacaaatgaccctttcaggagacctaagaacaatcaaagactgtagggaatccttgaggattagcaaatcctcctagtctaacttcctctgaagcacttccttattctggctttgagctctggtggggctgcagctcacatgcaccactcctggcctggcgaaagctaactatattgtgggctacacattggctatgcctccaacacactgccagttgcacagagaatgccctccacctcgtattgtgacaatgattctttcaaagcattaaatctttagaaacatccacttggaaagtaattggcaaggtcattgagacaagataataaaggtccattatcctatatctagcatgacttcacccaaaccaacccaaagtttcaagtattcctttgtgaatcatttggataagaaggagagcattatgcaaacatcttcgtatactttttacttcataccatcctagcatggatttagtccctaacttcaggaatatatctcagaaatttgataagagaaagactaagcaccagttgtggcctcctctatgtttctgtggcaaatgccagcttgccaagaaagaacaggttagtttattttaccacatggaaagatgatcaccgattacagattgcttccctctgcctgcaaatgtgcttaatgcctgtccaccaaaggaaaggcccttctgtttttaatgatttcaaaataacattccatagcatcccttggtaactcattcaaatattttatagtttccttcttctggtaattatatcctcaaatatgttcacatacattaacttataataatcctgtgtagcggccaagcgcggtggctcactcctgtaatcccagtaccttgggaggccaaggcaggcagatcacgagatcaggagttcaagacgagcctggccaacatagtgaaatcccgtctctacaaaactacaaaactacaaaaaattagctgggcgttgtggtgggtgcctgtaatctcagctactctggaggctgaggcaggagaatcgcttgaacccgggaggcggaggttgcagtgagctgagatcgcaccattgcactccagcctgggcgacagtgtgagactccatctcaaaaataaaaaaataaaataaacaaaataatcctgtgtagcaaggattatacctattttacaattgaggatatgaagaaccaaagagggtaactgactcgtcaagattgcacagctggttagtagcagagcaagaataagaacctgatttcttggctcctattaaaaagtcaaaaaataacagatgctagtgaggttgcagagaaaaagaaatgcttatatattgttagtatgagtgtaaatcagttcagccattgtggaagacagtgtggcaattcctcaaagacctaaagacagaaataccatttgacccaggcatcccattactaggtatatacccaaaggaatataaatccttctatcataaagatacatgcacacattatgttcattgcagcactattcacaatagcaaagacatggaatcaacctaaatgcccatcaatggtagattggataaagaaaatgtggtacacatacaccatggagtactatgcagccataaaaaacaagatcatatcctttgcagggacatggattgagctggaggtcattatccttagcaaactaacaggaacagaaaactgaatacctcacgttcttacttatatgtgggagctaaatggtgaaaacacatggacacataaaggagaacaacacacactggggcctatcagagggtcgagggtgggaggagggaaaggatcaggagaaacaactaatgggtactaggcttaatacctaagtgataaaataatctgtaaaacaaacccaccatgacatgggtttacctatgtaacaaacctgcacttgtacccttgaacttaaaataaaagttaaaattttttatttaattttaaaaagaacctgattcttcggattcttggccttcttcagactcctggtctgactaatgatgctctgggaacctccacatcactagcagaataagaaccagtgttaagatatcagcaagaacacaatgtttgtctcttggtgtacaggaggattggttccaggaccttccacagatactaaaacccgtggatgtttaagtccctgatatgaaatggtttagtatttgcatataacctatgcacatcctccctcatataccttaaagcctgggtatccagttttttggcttcccagggccacactggaagaattgtcttgggccacaaataaaatacactaacactaatgacagctgatgagctaaagaaaactgtgaaaaaaatctaataacattttaagaaagtttatgaatttgtgttgggccgtattcaaagctgtcctgggccacaggttggacaagcttgctttaaaccatccctggataacttatgataccttacacaatgtaaatactatgtaaatagtttgttttacaatattggtttagggaataatgacaagaataaaaagtctgtacatgttcagtacagatgcaatattttaaaaatatttttgatccacagttggttgactccatggatgcagaacccacaatacagagggctgactgtatagccatgatagtttgcttaccaagtggatcaaaggccaaaagtccccttgaggacaaccatttcattattgtcatccctacatactatcgttcccagagtgttcctacagtagaaagccctactaaaaagaaaagatacaaaaagcctagctgaacattaaaatcaccttaagatcatatgctgatccatgaaaataaaaaataagacaagagtatgtggtttgctgctttctaacttctctatttttacctctgagatagatacactcagaataaattgaagaaaatgaggcagaaaaaaatttcctaatatcctaaaaaaaatgctttacccttggccatgaacttcctttccccttgaggatttcatacctctacctcccaaagtttctaagggagccaagggttagcattttaaacatgggtaaagagtgaatcccattgctttatatgcttgacactcagaaaagcacatcagggttacaacacagtcctctggcatgagccctcccaatactaaaccagcatgctgttcaagtgaaaagataaatggagttttccttataggatttcttacaagatttcttttttaatattagctagagccaggggaatctgaaggcaggctcactcaatgggaacaaaatttctctctcatctcttatgactgatattaccaaggttaaatacatatgtcctgaaacacacttttaattatggccactccaccttactacccttgctaaagtcaccaatgacttctgcattgctaaatccaattatcagctctccgtctcatcttacttgtcctataagcagcctttaacatggccaatcactccccaagtcctcttcttcttcatctatagtcacactcttggtgacctcatatgggctgcaaataacacctataggcagatgactcccaaatttatttagccagcttaggcctttctccaaaatctcatacttgtttatctactttcattacattgattcctgtaaaattcaacacagtacattcaaaactaaatccttggtactctctccaaaacctactcccttacagcctcccatctcagtagatggtaattctatccttctaactactcaggccaaaaaatccacagtcaatccgccaggatatcctgttggctctgccactaaaacatatccacaatctgatcacttgtcattgtgagacaccatcacactatcatctacatctcaccttgattattttgacagcctcctgacaggagtctctttgccttgcctcactacagtctcttttcttttcttttctttcttttttttttttttttttttttttttgagatagagtctcgctctgtcacccaggctagagtacagtggcatgatctcagctcaccacaacctccacctcccacgttcaagccattctcctgcctcagcctcccaagtagctgggattacaggcacctgccaccatgcctggctaattttttttttcttttctttcttttttttttttttggtagagacggggtttcaccatgttggccaggctggtctcgaactcctgacctcgtgatccgcccgcctcggcctcccaaagttctgggattacaggcatgagccaccgcgcccagctacagtctctttttcaacaggaccgacagtgatccctttaaaatggaagtcagatcatgtcactcctccatttaaaaccctctgataactgcatttcctttagcataaaacccaaatccttatagtggtttatatggccctgcataatataatctgcaacttcgttttctatttttctctctcctgctctgttctagctgctctggtctgtcattcctcaaattcaccaagcacacttcctctttaggttctttatactggctattctgcctggaatggtcttgactcaaatatcaaaagagctaaatccctcaccttcttcaatctctttgcttctatcttgccttctcaatgagtatttcacttaccacctttgtaaattttaacctccccctcccaacttggcagtcctgagtcttccttattccgctctaactttttaatttttcttagaaacgtatcactttctacacatattgtatagcttacttatttattatgatgatcatttattttctggttttcctctctagaatgtaagctccatgaaggcagggatctctgttttgtctaagtgcaagaacagtgtctagcacatagaagatattcagtaaatatttgttgactaataatttgtaaggactaataattccttacatttttatagcgttttatgtttctagtgctttcacatggtatcccatttaatcatcttaattactatatgaggtgggtagggtaacacagaatttatctccatttcacatttaggaaaattaaaatccagagtagtaaaatgatctacccaagagctattctacatagctggaatgtggtaaaaccagaaacctagttttgtaccctttttctgtagcctccaatattatactgcaaagcctgtagtccttgaggaaagaccttccagattctttgttaggaaggggacatgccctgcttgtgccactaacccagtgccttgaagcttaatgtgtttcaccagcaaatgcgaagtcaatcaaagacctgagcttatgtggggaatcaccttgtgaatatgagagaaaatgattcccaaatggcactctctccaagaaagaaagaaagcaacatttgaatatcccatctacttagtggaataaattatttgtttcttcctaactagctctgccttcctctggcattacccactaaaccaaacagttctccaaagcaatgtaatagcataaagggagatgtgagagtccaaaaaggcatctgcaacataacatatatcccagtggcctctttcactgtgccaccatctaagccactaactgcccatgttgaaagctttgccccattgccactggcacatgcaaagagtggagactgtccctttaaatgtaccaccaaacaggaagctggtatttacttggcaggggaagaacaagatactttcatgcttggcatactgctaccattggcatctaacccagaagctgctgcattctgcaggggtggcaactattttgtcctcaggataacatagtggaagatgcagctatatttacatacaggctttttaatagagatgcctgtcacccctggtaagctcacaggaggcgacagaaatggcacagtcagaaaaaggcaagccaagtcctcggtaccttctggcaattgaatccacagtaccagagagggaggccttgatctctttctttggcctccagaatgtcattataccaggggtatatccagaaaccctctgaagtattactgaatagaccaggtttgtcttcagtgcccttgtcagaactgtcttttccaagatcacgccaaatcgagtggttgaggcttgaccctactaagtcaactctgctgcaaggctcaacaaatatcccataatgaaacagcatgcaacaattcaataaataaacctcaggctgaaaaaaaagaagtgtcaatgcaagcataatctaccaaacacttaacagattttagataatacatggatgcaaacatcactgaaacatgaagaaacatacaacaaccttggctacatgggtatgtactgaagtatctgacactgaggaagtaggccggatggaagaaaaaacattattttattttattgacagagtttcactcttgtcgcccaggctggagtgcaatggcatgatcttggctcactgcaacctccacctccggggttcaagcaattctcctgcctcagcctcctgagtagctgggattacaggcgcccaccaccatgcccaactattttttatatttttagtagagacagggtgtcaccatgttggccaggcttttctcgaacccctgacctgaggtgatccacccgtcttggcctcccaaagtgctgggattacaggtgtgagccaccatgcctggcagaaaaaaaacattatttttaaggggaatattggctttggaggcagagaaacctaggttcaagtctaaaagttttcttgccttagttcacttaagctcaatatgactcactttcctgatcagaaataaggatgatgacaataagcaagtattaattttgtgatgtagacaatgtttaattatggggagatgccctattgatttagtttgtaaaaaagtgtggcttttgagtttaaacatagatttaaactgcacttctgatactaattgtatggcattgcagaaggtacttattctctctaaacctgagtttattcatttatattttgaggatgatgttgacacctatctcaagtggatgccataataatcaaacaagataatgttatgaatgtgttttataagccatgaactccaagacaaagaaaagttttctttttttaaaaaaaaaaaaaaaccctttgattagagtggccaaccaatctgattttccaggaataaggggttttccaagacccagagttttcaatgctaaatatagaaaatcttaggaaaactaggatgagttgggcactctagtcttgaccaacctttaattaggccaatgtcctcactagaccttaactgggatgactaggtcctaactagatttaggccctggctctgccttaactagactcttactaggacttaactaagcttagtcctttctagacctaactgggttaaataggccttaaacaggcccaggcccttgctacacattaaattagaaatgaataggccttctctagacttaggtcctggcaatgccttatctagactgattagatattaactaggcatagtccctggctaagctaactgggctgtggctaggacttaactaggcataagcctggctccaccttcactgagttgactaggctttaacaaggcttaaggcctgcatttgccttaactagactctgactaagctttaactaggctttggccctggataggccttaactgggctggccagatcttaactaggatgactaggccctaagtaggctcaaactctggctagaacttaactaaagtctgaccacagcttttctaggcttagaccttgactaggccttaactgggtccaggttataccttaactaaactctatgtctcctctagacttatgccctagataggccttaaccatgctttgtctaggacttaagtaggcttatccactggataggctataactggactaattaagccttaactaatattggcccttgctagtctttaactgggctgacgaggccttaattgtgttaactagctcttaactagtctcaggtctttgctctactttaactagactctgactaggccttatctaaacttaggttatgactagaccttacccaggcttagtccttggctaggcttcaactggcttctgactaaaccttaactgggctttggccctggttaggccttaactaggatggctaggtttaaactgggctcaggccattgctacactttaactatattttgatgaggccttaaccaagatggctagcctttaattaggcttgggccctgggtatacctttaaaagactctgtttacgccttaataagctagggcctggcactaccttaactagtttctgattaaatacttaagtagatttaggcctaaactgggctctgactaggcccctaactagctctgactaaatataaactaggcttaggacatgaatagtccttaaaaatactctgataataccttaaccaagtcagttagcttttaattaggcttacactgtggctgtaccttaataaaactctagccaggccttaaataaatgtaagccctggctataccttaactagtttctgcctaatacttaactagacttaagccttacctaggctctgacttcaccttaattaggcttaagccctgactaggccttaactgggctctaacaaagtctaatctagtgttaggtaatggctaggccataactgggctttgactcacacttaactaggctgaagccctgcctataccttgattaggcttcattacatcttaactaggcttaggtcctggccaagtcttaactaagttctgattaggactaaactatatttatgaccttgctaggacttaagtagactaggactacaacataattaggcatagaccctggctagggcttaacctggctctgactagacctaaattaggcttaggccctggctagggctgaactggcttctgactagacctaacctaagtttaggcattggttatgctttaacaatacaccgatgaggtcttaagcaagctagctagcttttaactaggcttagtccttggctatactttatcaaaattcggacaggctcttaactatgtttaggccctggctaggctttaactggcttaactagacctgaattaggcttaggctctagctaggtcttaactgggctaactaggccttaactaggctaaggctttgactcagtcttaactaagttctgactaggactaaactatacttatgatcttgctaggacttaagtagactgggactggaacttaactaggtttagactctggctagggcttaactgggctgactaggcattaactaggcattggccctgaataggtcccagttgggctgactagaacttaactaggctctgactagaccgaaattaggcttaggccttgcctagggctgaattgggttataactggaccaaaactagacttgggcaacaactatgctttaacaatatcctaatgaggtattaaccaagctaactagatttaactgtgcaatctagaccggaagtaggcttaggctgtgactaggtctttttttttttttttttttgagacagagtcttgctctgtttcccaggctggagtgcaatggcatgatcttggctcactgcaacctccgcctcccaggttcaagcgattctcctgcctcagcctcctgagtagctgggattacaggagcatgccatcatgcctggctaatttttttatttttggtagagacggggtttcaccatgctagtcaggctggtcttgaactcctaacctcaggtgactctcctgccttggcctcccaaagtgctgggattacaggcatgagccacagcgcccagccggctctgactaggtcttaactgggccgactaggacttaactagacttagactctgtctccacctaactgatatctgagtaggccttaggtgggcttagcccctggtgagattgtaaccaagctgccttggcattaattgggctgagcaagccttaactaggctttggtcttggccaagttcatggctagagcttaactatgcttaagcctcaggtaagccttatctaagctgaggtgctggctaggccttaaccagaccttggccttggccttgtcttgattaagctgtcatcagaccttggctaaattgcagctactctttcgtaaggatcacctcaataatatactacctctagccctcagctcctccagtttgtatctgccattacctcagttatcctgcagtttcaggccgtactctgggtcataaagaagtcagagacaagacccctaccttaccatactgcaacaggaaacagactgcttgtaggctctttgcagccagaggtacttacagtataaaacaggaagcaacccctgaattgacactcccaagaaaccagggggatactcttttatataacactccacccagaattatatttttatttcagccaatgagaatggtctgtaaaacttcttccaggacactgacattttgtaataagtttgtaacaaacttaaaacataacatagcattcctgagtacagtacagcagcaggtgactttacggcttttgcccataatgtgcaattggcagtttagaagagagatcttcttacctaccttaccacactgcaacaggaaacagactgcttgtaggctctttgcagccagaagtatttataggataaaacgggaagcaacccctgaattgacaccctcaagaaaccagggaacactcttgtatgtaacaccctacccagaagtatatttctatctcggccaatcaaaatggtctgtacaactgcttccaggacaccagcattttgtaacaagtttgtaacaaacttagaacatagcattcctcagtaggggaggagactctactgcttttgcccttaatgagcaattggcagtttacttaccttaaccacactgcgacaggaaacagactgcttatagtccctttgcaaccagatgtatttatagtataaaacagcaagcaaaccctgaattgacacccccaagaaaccaggggatactcatgtatgtaacactccacctgggagtatatttttatttctgccaatcagaatggtctgtgcaacttcttctaggacaccgacatttggtaacaaatttgtaacaaactgaaaacatagcgggccaggcccagtggctcacgcttgtaatcccaacactttgggaggccgaggcaggtggatcatgagatcaagggattgaaaccatccaggccaacatggtgaaaccccatctctactaaaaatacaagaagttagctgggtgtggtggcgcgtgcctgtagtcccagctactcgggaagctgaggcaggagaatcacttgaacccgggaggtggaggttacagtgagcagagattgtgccactacactccagcctggtgacagggtgagattctgtctcaaaaataaaataaaataaaataaaataaaataaaataaaataaaataaacaaaagaaaatcacaaaacaacagcaacaacaaaaaaacatagcattcctaagtacagtacaggaggtgaatctacaggttttgcccacaatgtgcaattggcattttagaagagagatcaccaatgcactagaattgcagtaacgggagtgtaagcttcaccaagctgaactttgagcatttgtagaacctatgaactctccacagttagttatcagttccattgtgaggaagtagccagtctgatatatgctggcttggcctgctataagatactgaaatacttggttaatgacccaacaacaggatgataaatccagaccagagcataggtagtcattcttgtctattagcttcatggattcctagtgatgaaagactggtaattggttccaaccttggctatattatttagtttgggagcatgtatttgtatatacatacacctcctagtaaaatgcatttgattcattgcacattaggagttcactttggcccaactaatcatttttgtcatctgtaccaagttataagttaaacttacataggcctgtacagtcctattaaccttttcaagtacacagtgacttaggtatcagtcctgcatggactaactgaagtttgtaggtactattcagagcaaagcaggtaagcagctctgttcacaggacagtgcccagacagggcctgtggctgtgggatgtaaccagtctttacattaagctatgtatagcagtatgtcaaaagaactgatctgggcaccagaactagaaagttaacacattcattcattcatcccacaaatatttattaatcacctactgtgtgccagatattatcctgagactgggaatatgatggcaagcacatatagacacaacccttaacctaatggagttctcattctacaaacaaaatcaggagaggatctgcacagccatgagttgaagcctagattaaaacaatctgtatgctacagggcaaggacagatgtgataggcaaagcctacaacgacagaatagctgtaggaaaatagccatgtggttaaaaaaaaaaaagcagcaacaaatgaatataatcttcattttaaaaatatgaaaacagagatttttcctaacatcaccaccaccactaccacgtcattctgagaaagtcatttatattttttggtcttcggttcttccttctataaagtggaatcacttacccatttgagaaaaaaaaaaatgaagaggaacttgactagataagtaaatcctaaatcacactagcacaatggataagagccacaggctttagagttgaacagatgggggcttgaatctcagctcttgtcaccttgtagctatatgcccctggcatgatttaacctgaatgagcctcatatttctttctctgtaaaaagaggatagatactaatcatgcctatctcgggctgtcatggggacaacacctgagaaaagatggaaaatgcttactgcaataaattgccatgctctgttaagaaacaggaagaatgagctatgccttgcacaacctcgattctttttatttggatgcatcactctttagtgtcttaagagtatttagcaggtacttgataaagatgtgctgactggtttattggacttcaccatagggcagtaagaagattcaagggcaatagcaaggaccaaagcctggaaaaggtgagagatcagggattttacttattctcactcctagttcagcttaacccacatccattcattccctgtgaccataacaaataaacatcttcctgggaccacaggccccattgggatgatacataaagtctcaggaagacatttcaagttcaacctgaagaacgagagtcaacgtctcctgagttctctgctctgaatgagcactgaaaccttctctaccttttttttacaaccctctctttttctgatgtctccattctctggccagtctctgaggaggctaccagcagagttacaatctcatatttgaaagatgctttgaaaagaataagtattattaactattagttgcactgtatgaacaaattcataaatacttcccttattgttgcagaaacattacacaccgctgctgtaactagacctctttctagcttaactttgatattccggatcataagggaagtatgttggcattgtttcagtacttgctgtttaagtgcaagtatggagccattcactcactccagggagaagcaaagaaaagaatgcctttaagggtctcaaaattgaaaacaaataaccaagaaggttacacatgtctttctgtaggctgtgaactgggtaatagtgtttctcactcaaggaagaatttggattgcccctgctgaaggacaaagggataaacagactaggcccagatcacctaaagcagttgttctcatgactgatttccctctccaccacccctccacccacccatctgcccatcaggagcatttggcaatgtctggagaggcttttggttgtcacgattgaggggaggtgccattgtcaattagtgggtagaggctggggaaatactaaacaccctacagtacacagaacagtctccaagaataaagaattatacagctcccaaagccaatagtgttcaagttaagaaaatctgacctgaagaatctttccatcctaacaaccagcaaatatttctgaaggtctttcttgtgggcactgtggtttactaaataatccatagtctctgccctaaggaagcttagagtctaacagggagatcagccaatcacactgaagcaatcaggaaataatgcagtatatcacttatcacttagttttttttttctttttctttttctacagtgtggtctagcctctgggtattataggagcatttttaaattttattttatttttaattgacataattgtatttatttatgggatacaatgtgatattttgatatatgcttacattatagaagggggagaacagcaggcatatgaagttcaggaaaacttccaagaagagttggatcttgagctgatgtttgaaggaggctactactctttcccttctcctcactgctggcagaaagatgaatctaagcttgctgcccatacttctttacttcccactctctatcagtatcttgtattctgatttcaggactccatagaaaattatttttcttaatcaccagaacctatcatctatcctcaaatattaatctacatcaaccctcatcttttaaaaatttcgctctttattgacttctatgacatcatcattgtgttctggtccacttttgacctctcgtggctcagcctcaggtttctttttacagccaacctacataggtaggtgtgccaccacctccagcctgctgcctttttctctctcaccgtttcctcttaattattttattcattcatttatgtcccttctcattccacaaaggatttgcagtagttacaatctcatgctatgcatttttccttaattattataccaactcctatggttttacccatcatctctatataggcaactccccaagctgtgcctctgactctgactctgatgtccttcctacacaccacactacctgcctgatcacctgctgaacaccatccatacatacctcaaatccaacatatcctaaacttgaggtttacccaggacctagttttagcactgaaagttccgtgtcctcggaattccctcaaccccaagcaaaccagaacactaagtcaccacaactaaaatgaactcaacagtgtctgttccaaacccattcttcctcatgagctcctaattcctctccatcattttgtagcagagatatcctccttctgcataaacttcaactcctctttgccttccacctactcatgcaactgattgctagatattgtcaattttatctccaaaatatcttctttaacgtcacttcctttcaacttccactgctctaattcaggtctttattacctctaacctatacaattacagtagactcaatcagtccacctgcctccagccatgctatcaccctactcccatcccttttgccaattcatcttccaaactgcaaagattgatcattctgaaacacaaatgtgatcatccatagatagtatttttctaatcaatattgaagttttacagaatgaactccgagaacagcattaaactcaggctcccaggcatttgagcatgatgactacacaatatgacacctaagaaatgttgttatgaatgactaaaatacacggagtattaatatgagctctaagtgaaagggaaaatcaaaacaaaacaaaaaccaccaccatacccttgagaagccaggaactgagtttgtcggttccagttttgcatcttttcatttcttcagagaagtatatgataaccacagttaaggaaagtaaatattgccagggaattctgggtggtagagactcattaaagccttgatattcatatgaaacagaatcatctggaagtcatattaaacagaaactaaacttgagagagaattcactggttccctcagggcattaggtcttaactgatctgtggccctactccctaattacctctgctgcaagagccataggctttccatctcagactggcaaggaaaaagagaatttacataaacgatgtttatatcagtgacaggaaatatgtatcccacttgaataaggggtacggcgtgcccaatatagattatgaaaaatgaaaaactgccaggagaagaaggcaagtgctttccctagaggagagagagctcatcctttcctctctcaggaaaacttacctatcctctgtcttctctcatagacttgcaagtggtaaattgtttatgaagcaactcaccttaggagtcaggggttgaccttcacagagatattagaaaaagatggctaccagaaacatcagagctgtaatccaaaggcttacctctctaatggtaggaattttcatcacatggtaggtaacctcctcttccgtctacataattaagagatagctcccacctcttcagaaacctcttccaactatggtcctgcagtttttgtttgccacatttgtcttttctagtttttttttttttctccctagcttaataggacattgaaacattgttgtgtttcatttatctcccaaagaccttgcctctgaaattcattatcctttcattttaggtacttcccagtcagaaacacacatgcacacacacacacaccacaaacaaaaacacatcccttctttgtttaatagcactaacaccctccctctccctcaacctgggagatgtgaacagccatggttgctaccctaaaggagttgaggatctaatcagaggcatcaaccaagcccaactaagaacaaagaagtatatctgacagtcattatttttttctacagttgctgcaggaactaggagaatggggaggtcagcataaactgcaatctttaagaaaacatcacattaatcaaagaatggaatcagagtccattgaagtgcaacacaagggaaggattttgaagacaccaaaaaaaaaaaaaaaaaaaaagaaagaaaaaagaaaaacatcacagaactggggactttcttcctgggccctacacatacacacttcattgtggtcatatatggttctggcttaaagcttttaatggcttatactagagtgaatcccctgctgtcagtccccctccaggccaaaaccaccctgttcactgccctgtcctgctaatcctcatacttctacctctggccctaaacttcagtcttttcttcaacaactcaaggcactagaaatgtcatcaagaataagaaacagacaaatacaggtatttggtatttaagtgaacattcactatgtgccaggcacacagccacattctatctgttctcattactactccaagtaatttaactaccatttttaagagtttactatgtgccaggcaaccagaactgtgctaagaacctttcatgaatagtagctcatttaatcctcatagctaccctatcagcagtattattattctcattttacagaggaggatacagaggcacagagaagtaaaagaacttgtccaaaggcatactattaataaatggcaaagccagagtcggacctcatgtctgtcttactccaatgcctacataccagagactatgtagtattatggttacagcagggcccagaactctttctatagagggcccatagcaaatattttagacactgttgaccttatggtctctgttgtaattactcaactctgcataaaagcaaccacaggtaatacataaacaaatgaatgtggctgtattcctataaaacttcatttacaaaagcaggcaatgggctagatttagcccagaggctatagtttgatcacctcaagttagagcactagtggtgtactcagatagacctgggttcaaaacctggctctcaccacttactagacaaaacatttagtctctctgtgtctcagtttcttcagcggtagaacagcaacaataccaccctcatagagtcatcatgaggattaaggattaaaggcatgtctggcacatagtcaacttctcagacagtcattttattaaaagcccaccacatgctggtccctagaaggaaggagaaaggacatggattagaataattacaactctctttaaaatcaagctaccagggcccctacggtcttgatactccacagaaataattactctctcgggattccagctaatttgattctcccttcagctacatgaactgtgttctcttgtgagtttagtttcctgttgcagtcattagcaagaaagtctcttgacttcattatagcttttgtcaggcactgggaaccctatcatggtagaacaggaatctgattttgttattatctgttaggtgttcccttcaggaatgagattctcaccactgaagtcatgcctgtgtcccaagtacttggcatggggcctggcacagagtaggtgctcagtgaatgttgctggcttaattgagctggctacatttggggtggtcttacctggaaacagatggaaaatgacttcttaaaagccatccgagcattgaggatccttcctttctctaccagagaaagacagaatgtgtggtgagggcaagaaaggtgtaggagtgtggtggatggttgcaggggcagggaagaacaggacacactgttcctggttacattaagcacacaggagccaagatgcattcatgtctttaggccatgttcctgaataatcacctggtaaaagccattttgagcaagttttttttttgcttttttatttcaaattttttttatttatttatttggagacgaaattttgctcttgttgcccaggctgcagcgcaatggtgcgatctcggctcactgcaacctccgcctcctgggttcaagcaattctcctgtctcagcctccctagtagctgggattacaggcactcaccaccacacccagctaatgttttgtatttttagtagagacggggtttcactatgttggccaggctgctctcaaactcctgacctcaggtaatccacccgcgttagcctcccaaagtgctgggattacagacatgagccatcacacccagcttcaaattttattaaagggcacacgtgtaggtttgttacatgggtaaattgctcagtgctgaggctaggggtctcaatgatcccatcacccaggcagtaaacataatacccaacaggtggtccttcagcctaagcccccatttctcccctatctagtgattcccagtgtctattgttcccatctttacattaatgtgtattcgatgtttagctcccactcataagtgagaacatgtggtatttggttttctgttcctgcgttagtttgcttaggaattacctccagctccatccatgttgctgcagaggacatttcattcatctttatggcaaagtattttatggtgtctatgtatcacattttctttatccaatccactgctgatgggcacttgggttgattccatgtctttgctattgtgaacagcactgcaattaatatgcaggtataggtatctttttgatagaatgaattattttcctttgggtatacacccagtagtgggattgcttggtcaaatggtagctctattttatgttctttaagaaatctccaaactgctttccacagtggctgaactaatttgtattcccaccaatagtgtgtgtcttcacttctctccacagcctcaccaacatctgttgctttttgactttttaataatcgccattctgactggtatgagatggtatttcattgtggctttgatttgcatttctctgatgattagtgatgttgagcatttttttttcatatgtttattggccacttgtatgttttcttttgagaagtgtctgttcatgtcctctgaaggtaagctttttgctttgaatcaaaaccatgcttaggcaatcttccatctcagctttgaaaaataccctaagatacctcaacttgtcagtcagccctgaaaaagccatacctcctgcaatcctgacttgccaatctttctcaatgaaaaattctctcttttatctaccaagttgtctccaaccctctaaaatgtgtcttgtataacaattcagtttgttcactctggaatttgttagacttatttgtaggatctgactatacaatgaggaccatactgactgcaattggatgtatttctccaacacgttattcctcccctacctcaccatccctaccgcctactaccaccactatcagtctcctttccagaattctaagccagtaattggcatgacagaacataccctcaaaacattcagaggaacaaataatggaaacagtgctgatgcatgcaaactctgtctaggcatgaactaggtattctagttcattctgtgttgctaataaaaaatagctgagactgggttatttataaagaatagaggtttatttagctcacagttctgcaggctgagaagttcaagggcatggccctggtttctggagagggcatttgtgctgtgtcacaacatggcagagaaggtcaaagtcaaagcagacaggtgtgaggaaaggaaagcctgaggggcatcctggccttatcacaactcactttcaaggaaacaaatccatccctgcgagaactaatacagtcttacaggaatgagaactcactcctgcaagaacagccattcataagggattacaccctcatgacccaaacacctttcactaggccctacctcccaataccaccacactggggatcaaattcaaaattagttttagtggggacaaacaaaccatgcccaaaccatagcacatagagtgtgtcaaatcacatatacagtcacttcaagactacatatccagaagtgacaattctacatctcgtaagtcataatgatgaaaagaactaacatttattgagtgctttcttgtttagttcctatagtaatccatcatgaaaaataataacactggcttcctagttgccaggcatttaattaactctcttaatcctcataatgacctcatgccatgagttactattgtaatcctcattttgccgatgaggaaactgagggctggagaggttaagtaacttgcccaaggtaatccagccagggagtggtggggctggaatgtgaaccccaggtcagtctgtctgactgcagagaccaatctcctaaccctaccacactaccttattagaaacatctttgagcatgcagcccacattatcctgttatgataaaaaaaaaaatgcatgaaaatgcctgcttccatctatttggtgttgagaatgtttcaaagcactttcccatccctgatgcatttgatcttcacaacagtcctgtgaggaagacaggcataggcaacaccaccattacatagataaagaccaaacacaaaagcttgccccaagtcccactccacaaatgagagaccaagccagagtcagagttcaatgtacagtatacattttcaaaatgtgttctttggtatagctagggattaagtctcctccacctccttcattctgatttcatcctgaagatttgaaaggaagtgggcagcccacagcaggtcattaaaccctccagccaagctttcctataaatgtaaaaactacttgagtatacctcactttgtcttccacataccccaacccttcaggatctgcagtacctgaccacatcctgtgtcttgaaagaaaaaaaatgagggaccttgacccttaaaaactggacacactgaaggtatgaacatatctcattgtggatttctcactttaaaaacatttattggacaattacaggtccaaaattccaaaacccacctggcaggtgagcaatactcacctggcaggggagatatcatgatcaccaagcccaccaagttctgaaaaccaaagtttttaaaaataaattccctatcaaacctctcatatggcagcaaaacctgacatgcactgatgggaggcaatttatggtgtttatttatcccattgcatctaagcatgcccaggtttcactgctgaaaatttattgtgtttgattatagtagggttgccagataaaacataggacatagttaaatttaaatttcagataaataatgaataatgtttttgtataagcatgtcccaaaattataaggggcatttagttatactaaaacatttttgctgtttagctgaaattcaaatttaattgggcatcctgtatttttatttgctaaattttggaactctaattatgggtgctgcctgaaacctcactgggagtgttatctaatatatggcatagacagcatattactgttctaaaatctgacaaatttagaattccaaaacaaatctgtccccaagagttttgtaaaagggattgtggaccactggacctatagcatcctcccagcactgggcttggtacttcatggggactcagctcccaaagagcaacaacctctcaaagaattatcccatcacaatgccttgcctcttgagctttcattagatttcccctctgctgtctttcataggtcattagcatgctttctgctttgatatatttattcttcaaggtatttcccctctagtgtcctgatttaaactagtaggactgcaacccacagctgacctaaccacactttctatgatttcttacttggctttagtgagtttccagcctctcctgttcaattgctctgacatgctatgtcactttcttccttcctggtaagaagctttccaacacagactcccctttacttccagaactctcctctgtagtaggcagtgagctcctaccaccctctgctgccatctcatggctaggataagccattgcattagtcttaattctgttgcactagttctttttagagtccatcaccgccaacacagaattataacatctgccaggaaaccccattgggctaattctgactgctgtatgcacttgcaaatggaaaattatactttaaaaaaatatgcgttctaaaacagttttcaacctcctccttcaacctagcctcaccttcctccatttagttctaagtagtgaggcttagccctagtttgaaatgaaagatagggcttccagttgactgattttgtgagtctgcacctgtgttgccattgatattggcagcccagcttgggaactaagtctgctagctaattgcaacaacagagccagcttagaacaaaatgtctcagtaatccttgggtaagaacatatcttctttttaaaaaataaaactagccatggattagtgatctgagtgattaaatattaaactgtgctagacagagagtacatgtaaaaggtaggggctatttccaatcattatctggacctaaacttttgtcaaaacctatttcttgatctcaaatgtctgctgcagtggtttacaaaaaaaaaaaaaaaatgctgcactgcttaatgaaagtatgactcagcaagctcactacaatggtgagggaagaaaggtgcttgaacatttcttcctcttcgggaacttttgcattgccactgatttccccttttgggcgtttttctcctcttcagagcccagcttgattggcaactaaaaacaaaactcattctcttgagggtcattcctgtagaggcgggtttttaaacacatccttaacacacaaccggactatcttctgaagaactgaaatctaacacagtacacattgggcccatttctatgtgcagccattcactgaagggagtaggatgcagttcttaaaagatcagtagactttttcaaacctcccagaaaggcccttacctcagatcttactatagccagtaactgctgtttcttcctgatcctcaccttctcctctggtataggggacgactcattctcacccttcaaattttcttttcctctaaatggactaaaggaagaagtgtttacagctgtaagtctcccagctcaaagtcagctgatttcttttaggaaacatgggaacataactcattgccaattactttagagaaccacagacctatactgctttataaacctctgaatattaaacatgtgtcaaggtgacttttctttcagtctcacctattgcacttttttgtacacacctaaaaacttaaaataatctgaaaataaccagttaggtgacttaactgtgaaactgacttgtttttatcctaatgcttttcttgctgatagctttcccagcagggaacagggtggactgagcagggtaacaaagatatttctcctctgaccattgtccattcctaatggagccactggaagcttactgctgtggcttttctctacctcacagcctggcttatttctcaaaagcccatccccacgaccagatcctctgcttctatgaggggactttcccttttttttcattgcctcctcaaggagtggtgactcaattaattatcagggaggtctatctgtacctcattattcttaaatgagcacttaagtacaatgtttgacatccagtagtcactcaaatgttagatgttgttattattactatttaacctctctgagcctcagttttctcatctgtaaaatggatgtaataatagtacaaacttcctaggtttgttaatacatataaactgcttttaaaagtatccaaaacttagaaggttctgtgtacattttatctatgactattaaaacttctattagagaaataatttaaggacatatagactgcaaggtgaaaagagaaacgtgtgtgtgggtttggggatgctacggcggggaagagttgtgtgtggattatgtgtttgaaatatgttttagcggccgaagagaaatgcccactaggcgttaaacattcaggtgtaaattttagcagggacggaatgaagaattttttcactttaacaaaaacagtaaatgcctgcaaagacctttgggggtaagaaatgacatatatagaagtgttcctccacttcctaagcttaccgtctactaagaaggctgagtcactgattctacatagaagtacatgtaacacaaggtaggctctgagaggtaccacagggaaaaagcaaagtggtatgagctcaaggagagaggtcacacctctggctgaagcaatcagggagggcttccagaaggaagtgattttctgatttcattattcaccgcagccttttcttaggactctagtgcctgctgattttttccatctctgaatgctctaagatcccaaagtgtggtgcctcatgacaaagcagtgagcttttcctaaagctaaatagatccagattgaatgactgtcctttattctgtcctttcttttataaaatggtggtaacaggagatcaaaggggtgtgggcttttctcatgtccttacttggcaaaacaatctcctgatttggagaggagtggccttaatcagtctgtgagagccaaccatctgggaacctgacatgtttaccatctgtaccatttatgtgggcgtctgaacacaaacattattgtcctgttacttgtttcgcatgagttaggctagtatcccttcaaaagagctcctgcaggccagaatcatggctggtctctcttgcgatgaccctctcccacaggccacacggagctgggcacagagcaggtactccaaaatacttgttgaaaggcctaaactgaatcacattaatcttgcacttcccttgcagtaagcaagtcaaattctattctgccttgagttaagcatgtgaatcaggcattaaatcctattgatcctttagacagctgtagaaacaaaagtcacatacagtagactggtgaggggctgggaagataattctcttcactgaatgaaaaaattcagaactctgctgcagtgaaatcaaagctattttgctagttttctggcagaggggtggtctctttccagtagaacctgacatttttcctatcaagaaatattcctaggaggggccaagagccattgggcccctccattgacaacacagctttatgtcaaagaaagccagggcttttccaaaagttgtgtgcagtaaggaaaaaatacaataatgttcagcccttgtctgggagtattgcagaactgaagcactgaagagggaaaacaatcaacaactgcagtgaggatcctagctcatttgtgaagaaaagatttagacagattaaacagggggattccatacagatctggcctggggcgggccccatcacttctgggctttgctagccttcaggccccttaactggctaatatgatatacccactttaagctgttaaggtagttgatagttttgtatattaccacttcctacaaacatgaatatagtttcaatgctttaatccaaagaaataaattatgtgggcatttcaatcactggccgcaaggccaatggggaagatactgggaaatttagctttctgcatgcctctgatcataccatccatggattgtcagagagtgcagtgtttgaaagcttggtctatggaatcaaccaagctagttccccagtcctggctccaccatttaccaagaaatgtgaccttgggctctgtcctatcagctgtaaaatgatataattctatatctgccattagcgttgctgtgagatgatgcatataaaaaatccagcacagttgctggcacattataagagctcaatctttgatatgtaatcttccaatgttaagagtagttcctagttgcaactcccaggagacttgtgttagctactggactcctttcacacactaaggaaggaagaatttggaaagagagtattccaccaagatttatccagcacagagctatttattcaatcactcattcatcaaatatctattcagcattcatcttgtaccaggcattttgcaaaatgttgggaatataataaagaataagacaagctcccagtccttgaccaacactcagtcttatagcttttaagaagctggccgggcacggtggctcactcctgtaatcccagcactttgggaggccaaggtgggcagatcacgagggcaagagatcaagaccatcctggccaacatggtgaaaccctgtctctactaaaaatacaaaaaattagccaggcgtggtggtgtgcgcctgtagtcccagctactcaggaggctgaggcaggagaattgcttgaacctgggaggctgaggttgcagtgaacagatatcacaccactgcactctagcctggcgacagaatgagactccgtcaaaaaaaaaaaaaaagaagctgctagaggccgggcacagtgactcatgccagtaatctcagcactttgggagatctaggtgaatggattgcttgagcccaggagttcaagaccaggctggggggggtaacatggcaaaactccctctctactaaaaacacaaaaattacctgggtgtggtggcacgcacctgtaatcccagctactcgggaagctgaggcatgagaattgcttgagccagggaggcggagattgcagtgagctagggaggtggagattgcagtgagctgagatcatgccagtacactccagacagagcggtactctgtctcaaaaagagaaaaaaaagaagaagctgctatattccttaaactttttaagcccctgaggaagggaattcgttgggcaaggactatcatttgcactaacccacacacaaatagaacaacataacttcccatgaaaagttaaaaagttacaagggaaagcacttccagaatggcagagttctgaaaatctacccttccacaaaagctacaagacgttgaaaatttttttaaattaactttcacaattccggaaattaagcaaaagtttacaacgatcagaggagcatttactcaagtaaaacagccaagttttcgaagaaaagcaagttttgtggtattttaatttgcccaattcccatcttcctttccccagctcaacagcagctttgaaaaccaacagccttggaaccatggtagctgtaaaaagcagcagcctggcacccactgaaggggagcaaactgggtttggagcaccccaaatagacccatccccagagaactgtcattatctgtcagtcaacttcgttaagaagcccaattcccaggactggtcttcatgtgatctgactcagtaccaatagttcttttcctgggggcatttgtttaaaaaaatcagcaacagttgtttaatatgaaggctgcctgaggcagtagataacaattgggtcaaataataggctaaagaaaaagcaatctaaatccagcaacatagaaaacgaattagacactatgggccaggtgtggtggctcacgcctgtaatcccagcactttgggaggtggaggcctgcggatcaggaggtcaggagatcgagaccatcctggctaacatggtgaaaccccatctctactaaaaatacaaaaaaaaatagccgggtgtggtggcaggcacctgtactcccagctactcgggaggctgaggcaggagaatggcgtgaacctgggaggcggagcttgcagtgagctgagatcgcgccactgcactccagcctgggcaacagagcaagactccatctcaaaaaaaataataaaaaagaattaaacactatgactgagtagaatttatcccaggaatatgagggtgattcaacataacaaaaatcagttaatgtaatacattacattaatgaaaggaaagacaaaaccatgcatgatcatttcatttgacacagaagaagcatttttcaaaattcaacaaacttacatgataaaaacacatggaaaactgtgaattgaagagaatttcttcagcctgataaaggccatctattaaaaacccatagctgacatcacacttaataggaaacttgaaagcttttcttctaacatcaggaaaaagacagggatgtccactgacagcacttctattcatcatcatactgaagattctagccaggtcaattaggtaagaaaaagaaataataggcttccagtttggaaaggaagaattaaaattgtctctattcactgatgacatggaccttgtacagagaaaatcctaaggtatcaacaacaaaaattattagggctgataaatgagttgggcaaggttgcaagataacatacaaaatcaatcatgttttgttcaacaaaaattatggaaggccattgttttggactgagctcccatactaggccccaacagaccagaccaaaccaaaatggaatcacctgctaaatgccatataatcaaactaaaactttaagaaagcaggtacatccccaaacagaccagtttttcctgaaaataggagattctactccacctgagtccatgtaatatggaagatgcctctgttttaacccttgccaaaaaaagtaacctgatgttaaccgattttttttcccctatgttctctttcctttttcccaccttacaaaacccactgttctgctattgcctagtagaatggaatgtctcattctattttgtagaatggaggcttccctgattcatacatcatgaaaaaagccaattagatctataactaaatttgttgagattttgtcttttgacagtttctatacactagcaatgaacaatccaaaaatgaaattaagaaaacaattccatttacagtagcattaaaaacaattaaatacttaggaataaattgaacaaaagaagtgtaagacttgtacactgaaaaaaaccagaaaacactgttcaaagaaactaaagaagatctacgtaagtggaaagatattccatgttcgtggactagagacttcatattgttaaaatggtaacattctccaaatttttcttacctttatggttaattgactttcaacaagggtgtcaaaacaatataatggggaaatagtagtgttttcaaaaaatagtgccgggacaaatggatatccacatgcaaacgaatgcaattgggcctctacctcacaaaatatgcaaacggattaaatacctaaatataaaagctaaagctatcaaactctgagaagaaaacaatggtgtgagtctttgtgaccttggattgggcaatgatttcttagatatgacaacagtaagtctgtcagattagtatctatgtagcttcagtcaaatctaaccatggattccagttattatactatataaccctataaaatacatagaagtattattactttgcctttataacaaaacccaagagtctgtttcaatttataatttcagcatttaagcgaagagattttagttcccaaagttggggaaaataaaaaaacaataagggaagaaagaatcaggccttggtgccatatatttttctcttgaggttgtaaggcagagtatccttctttccagaacactttattatatttcacttacagacctaattttctgtgtcaaagtataattcccatgccgaagctctaacctaaaaatgcaaaaaaagttgtcttcattgtacaaacatatccatcactttaacgagataataagggaacaaaatttaggattcaagctaagtaagaatactgtttcaatgaacatgtccctaaaataaaccagcattagcagttaatttatgcatctagaaaatctcagttcccaccagtaaaaatatcctcagtggctagtgcaccttgaaaaaaaatctggcgtactaaataaataatgttcatgtgggagccaggagctgggtaagccttgcctttagactactctgtgactataaaaataaagccagcacttttggaactaataaggcttcacttgtcagtatcataaagagtattgctcaactaaactttgctcccaccggttcagtagttacttatttctacctaagtactcatcttccgattttacccaggtatttaaaatcgaaagaaaaaagcattatatttcagcgctactttgcccaaattacaaaataagtcattatttttagtgtcaagtcacaaaaaaaaattaacaggttttacattaaagttaaaagttgctaaaagttaccattataacgtgtaattaaaactgctaaacatgaatttgcatgcaaggtgtataaaaacactaaaaattgtttttcttaaaaattataagaaggcataaaaatgtacattttgcttaaaaataaaaaattgtcttaaaattaaataaaataaagtggatggtttaagcaaattataaagacactataaaaactaatcctgcaaataaaactctgtgtaaacacattaactaaactcaaaagaatattatatgtcttttctgtaaattaaacactaaaataaaagcaccacaaagttttcttaaaatgctaatctactcttaagcaaaacttgtcaagggttataacaggtatgtaaaaatcttacttcatggtcaaactggttaaaattaaacagaattatctataaggtttcattaaaattaaggttaacattaatagcaaactaacacaagggtaaaatttaactttctctcttaaacacaattttcatgtaattgaaaaggctaataaatggtttttggttttccagattgttatctcattttggcaaaacaaaacaaaacaaacaaacagaaaaacaacttatgataatctaaagttctatttcataatatcaagggttttaaattttaaacatatttaacagccttctcaaaatcaaactttactttcaaggttgtttttcctaaccactggcttttgggtgctgcacaggacccctgaaccatccaaaaaagaggtaaacaggattatttggcaacataaaattgcgaaaataatgtctaatacattatattttagggaatattattaacatatgttccaaaactgtatggaatgtctaaggttcttatgtctgaatatgtgctattaatcacaattaaagttgttatgttgggttattgtaagccacaaaaataaccaaatttctttgtcaattgtgtttctaactgtatccaaactggacattttgttatttacagacaattgttattttgttttaattctcttcaaaacattgtttatattcaagctttggaactttaacaaatgctctcaaatgtaggttactcataacaacaacaaaacgtacagaactcataaaaagctaaaatgtttataaacataaagcaaaacaaaggttaataaaatagaataaactaataaaaaaaccaatttttaccttttacttagaacactgctaatctttatctcatttttcagagtcaagaaaacttgtcttaagctagctacagctttaacaactaagtaaagtatactcctgtgaatagaatttaaagcgtgtttgtttctctctgcctagttcctctagaatttaaaaactggctataagtaggccaggcgtagtggctcacgcctgtaatcccagcactttgggaggccgaggtgggcggatcacgaggtcaggagattcagaccatcctggctaacacggtgaaaccccgtctctactaaaatacaaaaaaattagccggtcgtggtggcgggcgcctgtagccccagctactcgggaggccgaggcaggagaatggcgtaaacccaggaggcggagcttgcagtgagctgagatctcgcccctgcactccagcctgggcgacagagcgagactccgtctcaaaaaacaaacaaacaaacaaaaaaactagttgtaggtattcttaaattacaacgatatagttgtttgcatcaatgcaataagaatctattttcttttctaacagaacacaattaaaaaaaaaaactggttactttaccaaggcttttactgcaatggtgtgctctcctttaaggaatcaaacttgacttacggaacgaataaaacccttggaaactggcctcatattttgtgtacatagtccctgtacaggatttctgatctgtagtaagtaaagaatgtcactttctgacaggccaggaaccccaagttatcttaaaaccttaataagaaatgaattcacccaactcataggtatttaatggtacaaatacatggctgggcttggctttaacaagtcttatctcaaattccttctatataacagagttccatcaaagccgatttaaaaggcctgtgtggcaaataattattcttggtgcattgtatacaaataattaagccaaatataataaagcagaccactgctaccataatttgtcttttaataaaaataggaaactgaaaagtaaaaattatgtttcaaaaactatagcacacctgttgttaaattctagtcttgcctaatgtttttcaacttgtattatcttctacagtttaaattatatccattaccaaaatcgacccctggatacatcacactcaagtcaaagcctaaagagctgagaaagcaacctctaacatcccttctggggctaacaatgaaaacgtcctaacaatgaaaaaaaaaatttaagctggaaatcataaaagccaacagaatcatggccatttcgcagacaactatccaaaaacatctacaaacggtgttgctcctgcagtcaatccaagaccaaaaaactttctgctccccccatcagcaggaagtagccagaaagaacacgtcgccccttgtccttttataactgtagggtctggaatgacagagcaggaccaccatcatctcagacaaacaccgccactttaagttccagctgcctttccagcttcatgcatttcaaggaaatcacttcttttctaactacaagcagccaaaaaagagcagacagtaaaacacagataagaaggctggggcacagaggaaggcaggggaaagtctcttgggtaactgccaaacttcaccctcatacaatgggctccagtaaaacagtggcccttaataagcacattcctttcccttcaggtacactaagatagggaagccaaaagcagactcgagggatattcctgcagctgcacaaagatgtaggggaacagacacacaactctccctcccagataagcacaacaaagagacacagaagcagtccaagcctctgataactctcccaccctgaatccttaaaaactcttagtctgtaagagattgctacttctgacctaactcaatcagacgtccctcccaggttggaagtaaacctgttgactgtcgagccgaccttcttgtttctcctctttccttaattcttacaacaacaacaaaaactacaaattggacttcattaaaataaaaacctactgctccaggctctggacagttcgggtttttgtgcaatgaggcatctagtgggtacgcactctgcagtttttcctgtaattcttctttctgaggcgttcttagaatcgactagagattgattaaataatctgtcaaatgtgaacttcactatgcaagcagaatcaggattgtgctttcaaagctcacaaatgtgtttagattagatactacatggtggcttaataaaaatttcctttatcatattctaattgcagtttgttctgccagaatccacaccaccctacactacttctgtcagatataaaaatagaagataaaaacctgtccaactttaaaattgcccagcttgagccaaattgaaaatcagagcagaggcattgaagataaaggttggatgttatatccaccattaaaagaagcttcacttctgcatttgtgccttagcagaaagtgatttctggggttggagtttctgggaatacataaggggaagtcacatgaggtcatcaagaccattgctgaagagctccaaatgtctgtttggttcaggctgatgcagtagcataggacagagtttggcaaactacaatttgctgcctgtttgtgtgaataaagttttattggcacacagctaagcccattcatgtacatattgtctatggctgagtttgcactgcaacagctgagttgggtagctacaacagtgacagtgtggcctgcaaagccacactatgtggccctttacagaaaaatctgctaatccctgccacataacatcagtatttgatgtcaatccggatatctccatttagatgtctcacagacaaatctaatttgacagtcttaaaaaggcatgcacttccataaacctatttcatcttcagtgttccctctgtcagttaatggcactatcatcaccaattcacctgaatgagaagcctccctcccctttacctcccacaccccatccattactccattccccatccatcagcacatcctgccaattctacctcctcactgcatttcaaatctgaccgcatctctccatttccactgccatttccttagtctaagtcaccatcattttgttcaagattgacaacagttttctaactaatctttctgcctctagttttgactgccctctgcttctaatccatcctccacccagtaaccagaaggatcttttcaacatctaaatctaattttcttacatgcataataatatatgtagctaagatttaatgagcccttactatgtgccaggcatagttctaagcacttcgtatgtagtaactgatcttaatcctcacaccaaccctacaaggtggatattattatctccattctttagaggaagacattaaaaaacagagtagaacttgttcagttgcacagttagtaaacaacagagccagttgcaactgctttattatactactttacatacgcacacacacacacacttcttatggcttctcattgctcttaaaatggttcatcctatggtttttttttttttttttggagatggagtctcgctctgctgcccagcctggagtgcagtagtgatgcaatctcggctcactgcaacctccaccttctgccctcaagtgattctcctgccccaccctcctgagtagctgagattacaggcgcacaccaccatgcccagctaatttttgtattcttagtagaaacgggatttcatcatgttggccaggctgacctcaaactcctgacctcaagtgatctgcccgcctcggcctctattattattattattattattattattattattatttgagacagggctcactctgttacccaggctggagtgcagtggcactatctctgctcactgcagcctctgcctcctgggttcaagcgattctcttgcttcagccacccaagtagctgggattaaggtacacgccaacacgccccacaatttttgtatttttagtagagacgggtttcaccatgttggcaagattggtcttgaattcctggcgtcaagcaatctccccgccttggcctctcaaagctccaggactacaggcatgagccaccgtgcccagctgagtccatactatttttaatggccaaagaccatcgtcttgatcttctctaacccctgtttacctctccagcctggtctcttgccattcacagacttgcaatttaagctgcagccaccctgactgctgtagccctccacatacaaggcaggctctttttcacctctatgccttagccatgcgatcctctctgctctggcggtttactctcttttcttttcctctcccacacctagccaactgttgcacatcttttaatgctccagtcaggtatcacctactccaggaagccttcgctaagcaatccagatttgtccctcccttgtgttcccattatgccatgttcatatcgttttcggtgtccttactatacaattgtataactctccttttgtgcttctgtttccctcagtagactgagctcccagcagttcttctactgcaaaggtcttgctttactctgacttttctgtattttcttggacttcatcatcccagcctttggcataggctactgtggcaaaaaaaagagtagaaagggactataggatattgtctttttgtgtatgaatgcgtggaagggaagtgtgaggacataatggagatcatgaacatgtttggaggaaatgacatcacaggatgaaaacattttagagcttatttttggtagtttcataccagtaatcttctttaggacaggctagactccaaaatatataatggctcaaacacaacagaaatttctccgtgacgtaacagtccaaaacaggtattcttattcagcaggctagttctgctaacatggttattgagggacaggggctgacagaagcccctagatcacaccaggttatcacatcccagtcagtcagaaaaggaaaagaacatggaggagcacacataggaaacttctataggccagacctggtagtgccacacagcatttcccacagtgagaagttagtcatgtggccacacctcactgtaagggagcctgggtaatgtagtccagctgtgtgctcaaggagaagaagaatggttgtgctgggaaactagtgaccttcacagataaactaacagtaaagttaggcaagtttacctttggtgttgggtaaatgatgaaagaggtttatttcctttgtactagtaagctaaatggtgcagctctgtttaacctgtcccatgggaagctggggtagtcaaatgtaggcagtatttaaaatcatagttgacagttgagctccctgttgagtcacttaccaggaagtagcagctggataatgatttgcaatgctgatgattccttaattattaatcactgacactttgtagattgcctttgagtaaaatcccagctgggttagtatacaatatcgtaatgccagccccaaaatattttttccttttgcatgtctagactagagacggagttaaatagatggcacagtagcaacctgattcattacaagctaaccaagaggtgctcaaaacaaaatcaagaaaaataaaaacaaaatataacagagaactcattttcatttcaaaccctagctacaggcatgggcttattccctgccagtttgtgtttgcccaaacagagtgcacattgatgatgacctcacgtagactaagggaatgagcggatgtgaatcaatttgaaatgaaatatctccatgattctctgctaaaaggcatgtaagttcccaggagagtttgtaaaacagctacccaggctctactctctcctccatccacaccccagagtctcatttagtcagtctgtggaaggacctggggatttagattttttaatgttccctggatgattctgatgtaaaaccaggtttgaggaagcacaactctgacaaggtgggagggacaataggaaggtatgccaaagcatgaaccagacagagtgattttgttttaatatattaaaaaataatgaacactaaggaaaatctagtttcatagtttgacatgaagagccgtctccggggttagatgcattcacaggcacctagaaaacaggcctcttctggggattggccatgtaactccttgccagagctgactgtaaactaggaaaggtattatgacagtagactttctcctggacattccagatgcctaacttgttttcttcttttcccagtttgttgctcagcccaactgccaacagttgcttgccaccctgtggtatgatggcttccctggatggcggcggaaacactgggtagtcaagcttctaacctgcatgaccattgggttcctgtttcccatgctgtctatagcctacctgatctcacccaggagcaaccttgggctgttcatcaagaaaccctttatcaagtttatctgccacacagcatcctatttgaccttcctctttatgcttctcctggcttctcagcacattgtcaggacagaccttcatgtacaggggcctcccccaactgtcgtggaatggatgatattgccttgggttctaggtaagtcaaagggaccaggacctatggccagactgcctgatggtcctgtttaaataaactactagaacaggcagtcagactagctctgaactagggcacccccaccccacccccatgcagtgtggtagtcctttgttgagagtctcagaaatgtagttccttctgtcccgggcactggtccatggtgagattggcagtacacctagggcttgcttttgctaacttaatatcttcaaggacagagaagctgtctgtcagttagtctagagacaaagccaagtatcagtcaggacaggcctcaagtaaggtaagcagagcaagtgctgatcagtctattcaaagcaccttttcccataaccaaggggcacatgaatctgctcatttctcatggctactccacacgacccagttcttgttcagggtctacatcctatttggacactgacttcacaaccaagggggaaacctgggaaattcacacatcatggtaaaagcagccctaccagtagtctccaggcataattagattgcactggactcttcaacacatggccatcttctaagtccttgctactcaaactgtggtccccaaaccagcaatatcagtaccacctgggagattatttgacacaaagaacctcaggtgccacccgggatctgaattttaacatgatcctcaggtaattcacatgtactttaaagtctgagaaagtgcagccctagaccacagccacagcttttactattttctttattccaaggcagaagaaacatctatgtcatcaggtaaaattttacaaaacttctacatgatgagagaaaaaaggaaaaaaaaatgagttataaattattttgggccccattgcctagctttagccccaacatctggtaatttgatccatgatcagcttgctcacctcaaaacacattgagaagttctctttcctgaacccagtggaaactaaggactatgggataatactgatctaattaatttattgatgaaattattcccattccaaaatggaaaggaagtagaatcaggcacccaaaattgcaacagcattccagtaactatagtaaaaatgctaagagtagtacccagaaaagtataacatatgggcattttcaggaaaagcctaccaggtttggcaagttcaaaactgggaggtggagtaggaaagcaagtgattattgtctctcaaggcttcactccactgagaccccaattcattccttaatttcatccttattcacctggaggggggaatccttctatgatgagcagggctgaccctatgtagaaataaactgttttcctccattcttcaggtttcatttggggtgagattaaggaaatgtgggatggtggatttactgaatacatccatgactggtggaacctgatggattttgcaatgaactccctctacctggcaactatttccctgaagattgtggcctatgtcaaggtaaattggaatgtctgccatatttcctacacagcgattttggctacattaagcttttgcactgagagcataaagagttttgagaaaaagtgatgatgatgatggctcaatccatgtgggaaattaccatataaacagacattctttcagtggtttgtaagcagtgtccacctaagcaaagaaagtggaaaatggaacaatttgcaaatgaatcattagcttctgagactttcagggtaaaagagtcttcagctttcggtgtttaaatgctctctacgatatccgtgccaacacaatggcccagtgatgcttgcatggggccagggcagaaaattcactgaattcactatctccaaaagcttctcttaatccttgtcacttcattaaaaaggactactttatatacgtctaatattattctctctgtgacacaatcattagtaattcttcctccctgtggagtcatacagaacaagactgtttcttcctaacagtgcttctgatatgatgccatctctccctaaccctctgagttgtctcttctcaaagctaaacattcccatttatctcaactgttcttcatataatgacaagtagcagaatcccagaaacttgactacaggtggcacagacttttaatagccccttcctttctcatcacttccaccaccagaataatcactcgagcagttataaatccagcatttttagtatcacccaacctgtgcttctctaccaattcagataatgtacacacacacacacacacacacacacacacacacaccaccttaatacttttcccacacaacattcagctcgaattatcctgaaaatagcttcatgtttgacatcttactttgggtaatcagaggctctgagttcaggtctggtgcttattaaataatgggattgctgtcctccttgtagcctgagttaaacttctccatgagaaaaggctgacaattcagtctccaagattgtatagtcagtcatgctttttggcactaaattccacattaaggacttttagaatggaaatatggctgtcccccaaatctccaacaacttagtttatttttgtatccctaatatgcatattgcataaattttaagaccttgggagttatgtagagcatgcatattgaatgcagtcatgaaacatttttgaaaagagcccaagagtaggccctatacatgtggtgatcatttaacacatacttacaacttccttaagagaaaaagctggtgaggaaaatgtttgaatccctggttaatgtgcctgggtgaaatccatgtcattctggcactctgctgactaagtaacactgtaaagtaaagggaaaagttcttcctttggaaatggtatttatacactggagggaccttacattatcaatctagaaattggtgggttttgtttaaacaggaaagcttagaataaatgatgaagaaaaggattaacatttggggatgtgaaaaacgtatctgtagattctcaacattagctaatcacataacctgtccaactttactggagaggcttccaaagagttagatacttctccatcacaaagtataaggataaatctgctctattaagctgggtaaatgccccttaactggcaaacactttattcaaaggagacctttgccaagaagttggagtccttcccaaaaaagaatttataaagcaagacaggccacatgcaaaatttggatttgtaatgagaatttataaatggggataatcaggtctacccatccacagaagtccaggctggatgaccttccccaagcaggctgagccaacttctatgacacaaagccataagaactgcgacataggctccttgaaatgttttcaatcaccattgtactgaagcagtacagaagcaccaaggaatgagctgtttttaaagatcctttattttattagagtgcaaaattagtcaacaatatctattccacttcacatgatctaaagcaagtaccaaaaggtacacaccaaagtactcaaaaggaacaaatatatataagattgaccctcattgcccccagatgattctacaaatggagtataaccattctttgcttttctaggatagtaccacctagatctattccaccactgcttcgcttccatgtgtgccaagtaaatctggactatgctacccactgagttatggcctttccttcagtcagtgcttagctaaagacataataacacccccctcaaattcttattactattgagtccccacattaggctgttcctcttcatattttgctttagggtttataaaatgcaatttacatcctttgaaaggcaaggaggccaattttctaactgcattccatttcaaaggatgtaagaaaaatcatttgcctccaacaacaactaactcaagagtcaggagatctgaatttaattcccaatctgatactcatgagcagggttaccatgggcaatccctctacctttctgagctgtagattctgcctctgataaataagcagtaggttaaactagatcagtggtgctcaaccttttaaaaaattttttcccatggtaccacatctttaagcaaaaactcacacagtaatccaatatataaaaagcccaaaggactgagtttggcttgaagaatgagtcttctaagtctccactttggctcccacagtagctatgagatgcctccattgaacccccaggctctaaggaacacagtttaaaacgactgtgttagatcaggggtcagcaaactatggtctgtgggccaaacctggccttctgccatgtccttgtggttgtatattgtctagggctccattaggattacaaaggaagcattgggtagttgtgatgggaaccatagagcccacaaagccaaaaatatgtactatctgattcttgacagaaagtttgccaacctctatgctagatgagctccatgtttattccctgcacatacatactatatctttctccaaaggtgcaaagtatctatgttcaaagtatagatttgccatgagaatcatgttttacacttctgagtgttccacaaattcagattcaccatcccatgggcaacagacatccctgaggttacagttctggatgaggagagagaaaatcccaaattatgagctatacatgttccagttgttgatttctagttttaaaacataggtctgttttgttatcagcaaagagactatctttcacatatacctcaaacctttaaaggctgatctatcatctgtgctgtgatatcaactatcatataagtaacatttaatagaaatagtgctagactgagtgtctggagacccgtggataacttcttgctggctctgccaccgacttgctgtgtgatctttagcaagtcactctgcctatctggacttcctccatttgtaaaacaggcataaccattcctacccctcacagtaatgcagtgcatgtttgttgggggaggaaaaatgtagaaatataagatttggccaagagtacgtaaaactgattggccgcctaaaagtctatccgaagcagaagcacaaatgtggcacagtttctccaagctcctctgacagagaagaatattggatacacacaagtgattttaaacgcaccagtttcctcagttgttggaactgaagcacattttagaaatgctaacaatataatttggcccccaatgcaacattttctcaggaaagttgtttacatttagtcctgagaaattgtgatatttaaatgtgagctcaaggcaatatgcttcaaattaaattccaggcaaaatctacttctgtcctgggaaggtaataagtaattccttgtatttccataacatctccacttatggagtacacagacttttgcatatggatacagaatcacaaacatgtgcagtgggtaggaggcattatcctcattttgtggtgaaattaaaagatacaggcagttttaagtgacaatgcccaaattggagctcagatctcacaatgaagtcatctttctacaaggctactcctaatatgccgggggctggaaacctgggatgggtaaccaacccaataaatattggttcttcccctccttcaagcccctggttcttcatgtgtgctaaaggaacattctaacttacagagttgtcaaatgaactgtaaaatacaaccatacaccactgtatggggcagtactaaattcattacctgaaaggttgacatgccatttgcagtaatgtagaatacattacagcctgctaaaaattcagcagaaagctccagtgaatggctccctaaggatcctccatcagccccaaactgcagtcagcaagggagtgagaatgaacactgcataccgagaaggctgcgtctactccttgtctttcagtaacagcacgttgtccatggtgctcagagcccagtgagggattgaggaagtacatttggcttgaaatctttaggaagcagggtgatttttccccactatcttgggcatactagtgcctctgtttcagtgacactccccaacaatctgttaaacccacagttagaaaatgtctgttgataagccacaggtggttgctgcagatgattgatctaaaatttattcttctatgtgtacatcccaggtatagacgtggatgggagtgggaggaagagagttgttagcagcacatgttaattgggtggggcaagaaagacaaatagtgtcatgcatggggcctgttgcataatgaatgcttgatgcatattttggtggctttgtttgggtatggaagcaaggaaaaaagggaaagttttataaatgttcactgtacccctcatcttgtgcacttgttgtttctttcagtataatggttctcgtccaagggaggaatgggaaatgtggcacccgactctgattgcggaagcactcttcgcaatatccaacattttaagttcgttgcgtctcatatccctgttcacagccaactcccacttaggacctctgcagatctctttgggacgcatgctgcttgatatcctcaaattcctctttatctactgcctggtactactagcttttgccaatggactgaaccagctttacttctattatgaaaccagagctatcgatgagcctaacaactgcaaggggatccgatgtgagaaacagaacaatgccttctccacgtaagacgatcccctttcctttatttatttatttttttttttgccattttttccgccttctccatttttgtcctgttttcagcctacagcttcatcactgccacttgactgtgaaggcagtgctcactgtggatccacccgaagggtcagaggtggaggaatgttcttctcttgctacagggtactaggggatgaagtgaagttaggtgaggtaggaaagaaacaagcacacacatgagatcccaggaagtcatctaaagagttggttctgaactatgttggtagcattacatatttttaaaagaattaattggggtgaggtagataattcctcactcgaaatgtggcaccaaggtaatgaaacagcaaagctattcctctgaacgagtggctaccaaagctaactttactattgtgaatcaaggaaggatgcaaacatatcttaatgcacccccattcataggtgtaatctcgagaggggacaggctgaaggtaggactagaatccactctcctgttacattaatttaaggtttcaggtgggccaagtgtcacccagcactaattggaaatgtctcaggacacaagagataactcatgattctgtccacgagtccactgcctctgaacacatggaactcctgtgcctttgcttagtactgtcaagacctactttttgggggaccttcaagccttcagaacggcttttattttctgataaatcaatgccaggggaaatagacaagagaaaacaaataagtacatgtcaggctgttaggagctgtcctgggctgaccctgaactcagtgttctacatcttgtccatctccacccctacttcgggagagtgcaactcatcactggatattcatagcaatgaccccaagatcatacaagattcttagtcattaaactaagatacaattttttccttataacgccataaaccaacacagttcagtggacttggacattctagaaatgtgctccataacaaaggccagagaaaaaaaggactgttgcagtgatagagaaaaaaacaaaacaaaacaaaacaaaacagtgctatctagctgattcttgttatttgtctctagcagcatttcctaaaatggattctcacaaaccacagctcagtggcatgttaatagacaggagaatggaatctatgattaaacctcctgcactaggccatgctccttgtctctcttcctgaaactcagggctaaatcttgggtgtggaaaccagattaatgtgcaaggagaaggggtccaaaatgggttgacaaagagatagtgctattttggttaagccaaccaggagtgtataacagcagcttatcagctcgctagtgcctgttgactaggaatggcttcctctcctgcattactctagagacagaactcacagcaacctgttttcaacataaagagcaattgtgtagtggcctgagcaccaggagactgcatttgttcccatcaaagtgttcaacagaattagatacatgaatgagaggtgcctttcaggaggtcaggtccttgccaattatgctttcatgtgtactctgctgaggaaatttatgaaatgcctccttgcaagtttgtaatgattattaacacccctgttgccaactgacattttgctcctatcacttgcctagcagggacaattgaaaagaatgggcacctgtcatacataaaattatatcttggggtgtgaagaagcattgtcatggtggggccaaatcagcagtaatgttacctcaactttccctctatcagttgatgttttttcctccgtagaaggttgactcatatttatgttttcttttaaaggcctcaactcagggattcagtcattcattcattcatttattgagatggagtcttgctctgtcacccagactggagtacagtggcgtgatcccagctcactgcaacctctctctcccaggttcaagcgattcttgtgcctcagcctcctgagtagctgggattataggtgcccaccaccatgcctggctagtttttatatttttagtagagatggggttttgccatgttgcccaggctggtctcgaactcctgacctcaggtgatccacccgtctcagcctcccaaagtgctgggattacaggtctgagccactgcacccggcctcaggcatttatcatacctgttaaaatacacgttactcagccagggagatagaaagattctgcttttagagaaggggatagtttgtttatgtatctggtggaaagtttggtacctgcttattgttatccttttccttctgattctccagagatgccattgcttttcttccacataaaaaaagaaaaaaacaggccagtcgcggtgacccacacctataatcccagcactttgggaggccaaggtgggcagatcacctgaggtcaggagttcaagaccagcctggccaacatggagaaaccctgtttctactaaaaatacacaattagccgggtgtggtggcacatgcctgtaatcccagctacttgggaggctgaggcaggagaatcgcttgaacccaggaggcagaggttgcagtgagccgagatcacgccattgcactccactccagcctgggcaacaagagcaaaactccgtctccaaaaaaaaaaaaaaaagaaagaaagaaagaaaaaagagaaaaacaatcttctcctcaggcatacaatttaagggaaactcattgtccttgctgacaaccacatgacagtacagctgggggtttgagtttggtattgcatactgggaatacgtggccttcacctgctgtcaagagaagcaattagaaagacattatcattctgaagacaaaggacttgtgagagaaaaagaagctaatttgatccagccctcatctcctgatgcctcctgaatatacctggctgtttcacaggcccctcaaatacaggatgtccacaactaaattccttattccttttctccgtatcttcacttccaacctatatcccctttaattcctcatctcattaaatgacactaaccagattcctaggagtcatatgggactcttacaccttccctcatgaaacacatcatcaagtgtgtcactcagccctatcagttctacttccgaagtatcccttgaatacctctctctctttctctctctgtctctctctcattctctctctctcacatacacacacacacacacacacacacacacacacacacacacacacactcatcccactgtcttggttcaggcctaaatcatttctcccaaggactgtggcaacagactcttgactggtctctctgcctccaatctggtcttctctccaaacactctcctacttgctgtgcggaagtttctttctaaatacctgttgcatcctggctcccactggcttcatgcctgccagaatatctgaatcttctccataaaatcctgcccctttaccataacacacagggccttggtaatctgactcttgcctctccagtcttttactgctctcctcctttgtcaacattttgctgttctccaactacaggaaagtgtctcagcccttcagacctttgtacatcgcatgccattacctctgaatggaatacccatcctcacctagccagcctggcaaactcatacccatctttccaactgctgccaaagggctacctgctctaaagcctttcttatccactctaaccccactctcagctgcaggcttcttctagaatgcatgtttcccatggcattctaaacacatctccattatgttacataaactgttgtatttcagacatctgtgcctctctctcccaccagactgagactcccatcttagtaagctttgcatctgccatagaggggcctaagatataaaggtgctcaacatggctactgaacaattgagtgaaaagacaaagatgacgtccaaaagcaatcctatctttttaagctttttatttggagataattgtagttacattgtaatcggaagaaataatagagaaagaaatctgtaaatccttcacccatttttcccaggcataacatcttgcatagctgtagtacattatcacaaccaggaaatcaacactgataaaatccagtggcctcattcagatttcaccagttttatgtgcaagccatttgcagcaacatacatgggcctaagagtaatcttgtctttaattatagataatctacttctgcttctgcccaccctgcccccccaggatgactggagtatctggccaactctgtcactctactgatccactttgagcttgctttcagcaaaaacccttggcctttctcctacctctctcatcctgtacttgggcacttggcccaagagcaaagctctacattgatccctatatatttcatcttattagttccagccccttgctccaaggtgttgaagtctttctgagtctttatcctgtcatccagtttattagctttccctctagtcttgtgtcatctgaagatctaagaagcatgccatcgatttccatccaaagcgttgaaaaaactgtcaggcaggcttggtatttgctgggtggaatattgggcagctattaaaatgatacacatgaagactctgtatatacataaaaaagtttctaaacccaaaatgtgtaaatttttaaaaattacagaaagtgggctgggcgctgtggctcatgcctgtaatcccagcactttgggaggctaaaccgggcagatcacttgaggtcaggagttcgaggccagcctggccaacatgaggaaaccccgtctctactaaaaatacaaaaatcagccaggtgtggtggtgggcacctgtaatcccagctacttgggaggctggggcaggagaatcgcttgaacccgggagccagagactgcagtgagccaagatggctccatttcactccagcctgggcaacagagcgagactccatctaaaatatacatatatatatatatacatatatatataaaatatatatatatacacacatacatatatacacacacacatagatagatagatagatagatagatagatagatagatagagctatagatagatcaatagatcaatcccaggctgggcgtggtgtctcatgcctgtaatctcaacaccttgggaggccgaggcaggtggatcacctaaggtaaggagtttgagaccagcctggccaacatggcgaaatcccgtctctattaaaaatacaaaaattagccaggcatggtggcatgaacctgtaatcccagctactcaggaggctggggcaggagaatcacttgaacccgggaagtggagattgcagtgagctgagattgtgccattgcactccagcctgggcatcgcatggagactctgtctcaagaacaaacaaacaaacaccagagattgtataaactatgattgcaactatgtacaattagacattcaaatgaataataatctataaagacaaaggaatgtaaaataacaaggtggaacgtttaataataataatgaaaataatcaatatttactgcgtgctaggaacaggcactattacaaatcagcttttcgtgaattaactcatgtaatcctcactgccatgctatcaggtagacagtgttgttattatccattttacagatagggaaactagagtacaacgcagttaatcaggctgtcccgagttgcatagatggtaagtagcaaagacaggatttcaatctaggcatacaagctccagtctgtacttttacctagggatacaggtgtaagactggttttgtaaaggtacgtaagatttgttgtatacagctgcaataatcatgaacacacgaaaagcgaaaaaggacagagccatgacctagcaggccactgtgacctccttcaaggctattaccattcatttgcagctacttctacttaatcagtggtgatttctccacccatcattcagccaatattttcctatcttgttaacatggatacacacgtagttcccatcaaacactcttctttttgttctggtcaggtcataaaggttcttattggttatctctggcttttcctcctaattccagtccatatccttcctgatgctattatcacaggatgctgctactcgtttgtacttttcttggttatgtgtttctcctgtcatcttttatagactccttcaataaacatttcttcaacaattcctatgtaccaggcaatgaggataccaaggaagatggaatccttatctttaagaagttcatagtctaatggggaacgcaaatgaacaattagaatagctgctattattaatgcttaccatatgcaaagtactttaaagtgctgagcactttacatgcagtatcttaggtgatacagttataaggctatgtgtgtgggcttcagagtcaaaagagctgggtacaaactctacctctgatactgcctgcctgtgtgaccactctgtgcctcagtatctcatctgaaaaatagaagaacaatagtctctactttatagacgtatagccaaatataatatagtcaacccttcatatctatgtcttttgcatccatggattcaatcatccgtggatcaaaaatattttttaaaaaatgaatggttgcatctgtactgaatatgtacagactttttttcctgtcattattctctaaataatacaatatagcatttacatgctataaatataaatatagccatttacatggcattctcattgtattagctatcataagtaatctagagatgatataaagtatatggaatgggccaggcatggtggttcatgcctgtaattccaacactttgggaggctgaagcaggaggatcacttgaggctaggagttcaagacaagcatgggcaatatagcaagacacctgtctctccaaaaattgttcttttgtttttgtttttgtttttgtttgagacggagtctcgctctgtcacccaggctgcagtgcagtggcacgatctcggctcactgcaagctccacctcccgggttcacaccattctcctgcctcaacctcccgagtagctgggactacaggcgcccgccaccatgcccggctaattttttgtatttttagtagagatggggtttcaccgtgttagccaggatggtctcgatctcctgacctcgtgatccacccaacttggcctcccaaagtgctgggattgtaggtgtgagccaccgcattttgaaaaaaattagctgggtgtggtgatgcatgcctatagtcctacctactcaggagactgaggcaggagggtcacttgagcccaggagttcaaaactgcagcgagcaataattgtgccaccacactccagcctggacaacagagtgagatattttctctaaaaataaataaataaataaatataaaaataaaaatgaaaaagtatatgggaggatatgtgcttacgttatacataaacactatgccattttatataaggaacttgagcacccatggatttgggtatctgtaggaggtcctggaaccaaccctttgcagatatcgagggacaactgtatatgcaaagcacttagcacaatgcttggcatatagtaagagcacaataaatgttagcaattagtatttatcttaccaagaatcatttttgagatgaggaaaacttgaagttgaaagaggctatgtaactttcccaatgtcatttaataaatggcggggtctaaagttctcgcttaggcactctcctctattgcctctacagtgtgatttgtgcatttatggaacaaggcttgggtgctatgggagcaaaaaagaggagcatctaacccagccttgtaggaaaggagttggggcaggcttctagaggaggtggggcttcaactgagcctcaaaggtcaaacaagaattagacagaaaaggagaaaggaaagaagtagaagctagaggttggggcaaggtgagggtatcctatccagagacaggagcttgtcaaaggcatagtggaatgagaaatagcaggtccagggaactgtggaatgggtaagggtgataccaaagggtcacctgtgttgggattacagcttttgctccatttaggctatcaacatacaacttgggaaatataggatgatgtccctgctttctcccaacaagcctttaacttcgagttcaccctctagttcttctttgttggtctgaattaggtccagagaagtaaatcctctccatactctttctactttttgaaagggtaattcctcatctcaaagatgagactttcggcaaatattcagaggactgagttcccatctctgttctactttacccctcttagctttgtgatctatttgtggatggctcccaacatgtgcaagttctcccttaaccacctgttatggatttgtcttctgtgcatttaatatcaagttttcttgaatctttgtatcttcagtctatgcctcttcttgagctagcaagttccatatgtttgtttactctctgctaaataaaaatggactagttgcttttttctaaaataatccctctttaaaattgaaaagatagtcctttgttattaagattccatggtttgtcaacaagtctttccatccctgtgatgactttattatagacccagcaccaagtagtacacccccaccaccaccagtggtggccctttccctgtgtattaaaccgagtctagaagccacagaacctccagcagatgtctcaccagaatattcttttccacctcacatgacagtccctcattttacctgggcatgcttttcagcaggccagcttctcctgatgaccggaccacactgtaatattttgaggaacatgttgaggacattctcactaccaaccaccaaaacggaggaatgatctttcctatccctccccattttcccctgttgtacaattttatccataacgtttccctgactagaatatcagcagagttgaaggcagatttatttatttatttatgcatgcattctttgtttgtttattatttatttatttactcatatgtagagagagacagggtctagccctgtcacccaggctggagtgcagtggcatgatcatagctcaccgcagcctcaaattcctgggctcaagcaatcctcccacctcagcctcccacgtagctgagactacaggcacatgccaccatacctggctttttttttttttttttttgataacggggctttgttatgttgctcaggctggtctcaaactcgtgggttcaagtaatccttccaatattgcctcccaaagctctgggattataggcatgagccaccatgcctggctgagcgaagattttaaatgctcagacttttacttttagggaacgtttgtatctgtcagtggaacaactagcaataaactctatcctcaagcataagccattgcaattttaattgttgtaggggtagaggtgaaggtaacatctattcaggagaagcaaccaattaactaagactctaccaacatattgattacatatttgccctagtttgtggccttattgtctgtcaggaaatcaacaaacacttactgaatgcattctgtgttcaaggtcattcagcttccagggactctggttcctcagaatgacattcctactcactgcagctgctctttaaaattctgaactacaatctgccctggcttctgttacctagcagctgtgctagctgcttgtgctatttactgctggcctcctgcctgcctgatttctggtatctaataggcatcatcaggtgttgactgtgccctcctagcaggggccagattacttagccccatgtcttcctcatttttcaaccctctgcctggttctgcgatgcattgtattgcctggccctggctggtagagtctcctgaaaatttagatcctgtgataggtctgacttgccatattgtctggttcttgtgccctggcccctgaactccagactctcatcttacttttgattctcaactgcttcaccagctggcatttactttcaccaaacaaaaagcaaatttattccttttaggctagctctctagcagcgtgatgctgaaaagatcatggaatttatctatgataatcagagaagagccacttagcaagttgagaagggccatgtgcacattgcccaggcagccctgaaaagggcccttgagagtcaggccagtggagagcacagccttaaacaaaataaactagccctttttgtgcagcctactgactgcaaaattgtcaatgggattggaatcttctccactttaatctaatgataacagtaatagtaatagttttcatatattcattcatttcttcaataaatgtcatttagtccctattatgtgccagctacctagcagctatgtctctgcctccatagagcttacattatagtagagagggacggaaaataaccatttaaaccaaaaattacctaatataattttatgaagcttcaagtgctacaaagaaaattaaacaagacaataggatagagaaaaactgatggagctacattaggtagagcaaccaagaaaagcctctctgaagaagtgacatttgagctgagaccttgatgataagaaggcagctgtgtaaagatcagggggcagagcactttcagacagagggactccttaaagtacctctcacccacctctaaaatgaaccgaagaacaaatccctaagactctcaaaatacattgtgctcattaagaacgacacattttgagcacactgaaaaatgcatccattcttaaagtagcatttcttatgttctgcatggtttccataggcttgggcaatggctaatctctgccacccacgaactggctgcattttattgctgtattcagatttctgaatataaagcaaaagaaaccctagacaccaaaaggatatcattgcagttacatgtttggatgtgaagtctaagagaggaaataataatttgagaagccatcaatatagtggttttggaagggcagacagacctagatttgagatctggctcaaaacatactagtaaggtgtccttgggcaagtcattcagtctctgaatctctgtttcgtcatcagtaacaataaaattttacaaggatcataatgataatgtatgtatgtaaaagtacctaacatgcttataagttctcaataatagttgagttctcaaaagcctcaataacagttggttaatatatcattaacaattatctgtataaagtgttaatttgagaatcctcaagctcctccatgcagtttagagttatctgggtcctgtgagagccacaaaagaagtatcagaaatggtaatttgttctcatgttcactcagccagcaaatgccagaactgagatcctaacccagtgcaatctaacccaagcaccattctcctgcctcagcctcccgagtagctgggactacaggcgcccgccaccatgcccggctaattttttgtatttttagtagagacggggtttcaccgtattagccaggatggtctcgatctcctgaccttgtgatccacccgcctcggcctcccaaagtgctgggattacaagcgtgagccaccactcctggcctcaagcaccatattcttaaccactgcatgtattgcctctgcataattagaatggtaaaaaaataacatggtctgaagacaaaagacaaagtttggtagaggaaatagctcttgaaataagccttgaaaaattttaggctatgcatacactgagaagagggaatggtatttcaggtagaaaagcaaagcataagacatagaagtggaaacaaacaaacaaatggacatggatggtcagtctgtgttagggaagagcccaaaatatgtgagatcaccagtttatctgtcacagatctggcagccccttcgttaagcagatcaccttacattttctctctcttttcttgctcttcttaaagaattaactaacctgctctttgatctcttttaggctctttgagactcttcagtcactcttctggtctgtatttggccttttaaatctatatgtcaccaatgtgaaagccagacacgaattcaccgagtttgtaggagctaccatgtttggaacatacaatgtcatctccctggtagtgctgctgaacatgctgattgctatgatgaacaactcctatcagcttattgccgtgagtagctttgctttacaagcgtgcttactttggtttcaggttggggcaacatcggcatagagttcattagaagctcaatgaaagagttcgtctgcctcaattaatttacattagctttcctagttgttagactgaattatttctttccaatgcaattcaggttggactcttagtctatagactcttcatcatctaagttattcgagtgaataagattttctagctacttattgaaaatatttctaaatttcagaatcaattttcttgcctcagtggaaaactcagggtttgagcacaatttggctacaacgtgtcacctcactcatctccagggttaattcagctgatctggttctctaggcaagagagccctatctccctattcactacaaacatctccctctgaaaactaagaatcccattgacaaggatggtcttctgagagagagacagagaggggagggggctacgttttttcctattttaaaaaatagagatgggctcctgatatgttgcccaggctggtctgaaactcctggcctcaagtgatcctcccacctcagcctccctaagtgctgggattacaggcatcagccactgcacccagccagtggctattttttaatcaagtatatataagtaactgcactccattgcaaggcactcctaagtacagtccattgctgaatttttttgcaccatcatgttaccatttagatcagcagtgtttattaccctagactagaaatagtgaaagtgtaggatacaggatcaatttagtccctgccctggttttttatgtcaaagtagatatctaaccttagcttattttattttaatctgcatataattcctagaaattgagttttggcaaaggagtcctcattacctgaggtctgatttagttgggcattagtaaatttggatgtgtagttcttactataatgctagattaccccctctggatcagtctgttgctcaaagtttttgctgtagcagagaaagtacaaaataaataaacccacgtcttgttttcctttctagatgctatttctcagatttggtttgccactgaggagttatttagcctatagaaaagaagctcaaattacttgttacatatacatagatatatatatgtatgtatatgtgtatgtgcatatatatatatgcacacacacacacacatacccatacatgcacattgtccatgtcttaaatgttattgttaatagtgaacgtctgtgatccatttccactaaggacagaaccaaaaaggaatggagtaggaggcttttgagttacctatttgggagaaattcctaactataaatggcaatgaaataaatatattctcacaggtgggtctatagaatttctgttattggagagtttaaaaaattaggatataaaattgtctgctaggatagtttagatattaggtatctaggtggtagagaagggagaggagtgtagtggaaaaaaagatttgaagttaataaaccagggactctaatcatggttctgtggtttataactgcatgtctttagtaacttacttttccctcttgagcctcaatgtcatcatccaaaagtgagggtattgaaatcaatggtttttaatatccttgctagctctgacatcctatgtgtccgggtgcctacagattaacaagataggctcacaaggtcctttctagctctgaaattctgtttttctgttgcatttgaaattcaatatagttcagttccattcactcattccccctcattcaaacaactaggccaagaactctaaaatgatttatgttcactcctagtctatctctataagggggcaggggcaggcatggaatctcaggaattgacttttccatcccctctgcttggcattctatccttcacccctgccaaagatggcaatattcatgcaaaggcatttgtaattttctcactgggtgtctgatagctgatttttccttgtgacagtagaaaagggagagattttcttgtcacctaatgcagggctgtggtccttctcactgagctcagtgacattttctaggaagggcgaaaataatcaactccagctcccatcaccacctgctggtagtaagttttgttttaatgccacctactgctgcacccaaagaaaacacattggcttgggagggagccaacggtagatggcctaaatggagtctataccatctcataaatctgaagtcatggccaaccattctgaataatatctttactgcttttggatcccacgggagtgtgtttttaccatttggaaatggatccagtgggatcatgatattggacaacctgattccaaaaatacctggatctgcttaagtggtaagggccagaaagtagatttaatttcatttgcaacatctctgcttcagtactgaatgtaatttttacaaggtccttgatatagggagaaaggttacagaaagggaaaccactgaagacaaatttctcctattttaaaaggtatcacaggctgattcagtctaggtagggactgagttgtcaacatgcctcactgtgaatctgttttgtgtacattctaggacagtcctcaagaacatcaggtaataccaatcccttgaagggttaagctctttatcaatgttccatgcaggattcagagatgctggtgatgtgaatatatggctctgtagcaatttgtatttccatgtcataggaggctccacctcagtagtgtatagagttattcttaagatacagtgaagcaggaatcactccaggcctgtgctctgtggtcccagcatcagcaggtgaagctggccatattgtatattattgttattgacaattagcagtgatttacttctccttttattcttatatctccctcaatctccttattactctcaatgacactttttaaaatacatctaccttgtcactgctgtccctgatgtataggcacaagctccatcaaccaaagctgccctcagtgccattttaatcagattcatccgttaaaaaatattaggtggaagagataagatcaatcccacaaagttcattaccttaggccctattcctaccccctacccacccacaatggccatctctgttgcctgagattagtcctcccaaaacatagtgctcataatggtctgtgataaagcctcattcagcaagttagtaagaacccttggtttctttggctgctatggagtatttgctttagtgctgaaaataagtaaacagcacttgcttcactgagccacagctgctggatggcttggggagagtccaaatatacataattggttgtctcccttagggtggcagcatttggaggcccagatgatgaatggactcttccactgcagaacacattcatgcaaatgacgacattcttccaaacaaacctggcaacacaagatagcaggcaagactagagagggctgttgcataccatctaagtgccaagaagggcaggtggtctccccacccacccccagtcatctaggaccaacctcagattctcaaagcagagactttcaaagcagagactctcaaagcagcacttcacacacaataccatgattttaactctctatcagcaggactgataaccaactgctatgcactgatatggctactcaactgttaaaatattgaaacacttccataccagttggtaaataggtgccactccagctgttccttctatgacatacccagacctcccgacaatccagcaagtaaagggtaacatttggaacagctgctagaatctaggaccctgctccagcaccaaaactggcctacatttggattgattggttttttaaacagtctgaatatcactatagtaggcaaaaccctaaaatgctccccctagattccccactctaatactcaagactattaatatgaagagataccacacttgtgattgtgttgtattatgtggcaaaagggattctgcagatgtaatgaaggttagtattcagagagattatccaggtaggcctaatctaatcacatgagtcttagaagcactgttttctccaaccggtagcagaagagaatgtcagtgtattagtctgttctcagtctgctatgaagaaatacctgagactcagtcatttataaagaaaagagttttaattgactcacagttccacatggctggggatgcttcattaatcttacaatcatggcagaaggaaaagcacgcaggtcttacatggtggcaggtgagagagagtgagagggaagggggaagagccccttataaaactgtcagatctcatgagaactcactatcatgaaagcagcataggggaactgcccccatgatctaatcaccccccaggaggtccctcccctaatatatgaggattgtaatttggattgtaactcaagatgagattttgggtggggacacagtcaaaccatatcattccatccctggcccctcccaaatctcatgaccttacatttttaaaacacaatcatgcctttccaacagtccctcaaagtcttaactaattccagtattaacccaaaagtctaagtccaaagtttcatctgagacaaggcaagtcccttctgcctaagagcttgtaaaataaaaaacaagttagttactgcctagatacaatgggggtacaggcattgggtaaatacacccattccaaattggagaaattggccaaaacaaaggggctacaggctccatgcaagtcccaaatccactagggcggtcattaaaccttgaagtttcaaaatgatctcctttgactccatgtctcacatccaggttacaatgatgcaagtggtgggctcccattgccttgggcagctccacttctgtggctttgcagggtacagccccccatcctggctgctttcacaggctggtgtcgagtgtctgtggcttcaccaggtacatggtgcaagctgtcagtggatttaccattctggggtctggaggacagtggcctattctcatggctctactaggcagtgccccagtggggactgtgtggggactcccaccccacatttcccttctgcactgccctagcagaggatctccatgagggctctgcccctgcagcacacctctgcctggacattcaggcatttccatgcatcatctgaaatctaggtggaggttcccaaacctcagttcttgtcttctgcccacccacaggaccaacaccacatggaagctgccaagggttggggcttgtaccctctaaagccacagcccaagctgtacctgggcaccttttagccatggctagatcggctggaaaacagggcaccaagtccctaggctgcatacagcaaggtggtccctgggcctagcccaggaaaccatttttccctcctaggcctctgggcccgtgatgggaggggcttctgtgaaggtctctgacatgccctggagacattttccccattatcttagtgattaacattcacctcctcattacttatgcaaatttatccagctggcttgaatttctccccagaaaataggtttttcttttctatcacattttcaggctgcaaattttcccaactttttttttttttttttttttttttgagacagagtctcatactgtcgcccgggccggagtgcagtggtgtgatctcagctcactgcaacctcttcctcctgggttcaaccaattctcctacctcagcctcctgagtagctgggattacaggcacctgccaccacacctggctaatttttgtatttttagtagagatggggtttcactatgttggccaggctggtctcgaatgcctgacctcgtgatccacccaccttggcctcccaaagtgctgggattacaggcatgagccaccatgcccagctcaaacttttatgctctgcttcctactgaatgctttgctgctttgaaatttcttctgctggataccctaaatcatctctctcaagttcaaagttccacagatctctagggcaggggcaaaatgccaccaagtgtctttgctaaagcaaaccaagagtcatttttattccagttcccagtaagttcctcacctcagcctggacttcattgtccatatcactatcagcattttggtcaaagccattcaacacgtctctaggacgttccaaactctcccatattctcctctcttctgagccctccaagtctttaggaagttccaaattttcccacattttccttcttcttctgagccctccaaactgttccaacctctgcccattgcccagttccaaagctgcttccccattctcaggtatctttacagcagtgccccactctcggtatgaatttactatattagtctgttctcacgctgctatgaagaaatacccaagactgggtaatttataaggaaaagaggtttaattgactcacagttctgcatggctgggaggcctcaggaaacttacaatcatggtggaagccacctcttcacagggcagcaggagagagaatgagtgccaacaggggaaataccagatgcttataaaaccatcagatctcatgagaactcattcactataatgagaacagcatggggaaaacaacccccatgattcaattacctcccgctggatccctccctgacacatggggattatggggattataattcaatatgagatttgggtggggacacagccaaaccatatcagtaagtgatctgaagcacaaggaagatttgatgtgcattgctggcttgaagatggagcgagacaagtagtaagaaattcaggcagtgtgcaggagaagaaagggagcccaagctctcactatagaaatgaattctataaacaacataaatgaacttggaagcagattcttctccagagcctccagataagagctcagccacattgacaccttaacttcagccttgtgaaggccagtatgactggagtggagtaaccaagggaggagagggaagtaggagatggagtcagagaggtaatgggagtgagtgacagatcacttagggcctcatggaccgttggaaggatttgggcttctattctaagcatgatagggagccatgggagggttttgagcagaagaggtacatgatctaacttgtattttagtaagagtgctgtgtctgattgggaatagactagagtgggataggggcaaatacagagagaccaattatgagaccattgcactaacccagacaaaagctgatggtggttttggccaggttggtcatgatggcagtgatgagaagtggtcagattctgtatatattttgaactagatcagatgtgaagtgtgagcaaaagacagtagtgaagaatgtcatccaggttttttggtctgagtaactggcagggtggagttgtccattactgagatggggaagagtaggaaaggagcaggcctggtcggggagggaggtgaaacagagatccagagttgacttttagacatgtggaattggagatgcctattagacatccaggtagaggcattgggtggtctacaggtctagaggagaggtccaggctggcaatagagatttgagagttaccagcatacgcatagtatctaaagctatggaactagatgagatcactaaggagtgagtgtggagagaaaagaaaagagatctgaaaatgaagtctggggcactccaatatttagaggctggaaatgtgaggatggattatccaaagagactgagaaagaacagccagagggatgggagaaaaatcaagacaatgtgctatattataatactatattattcccaatatgctaataagtcatatgctagtaagtggtactgtctggatttaaattgaggtagtctaaccccaagacccacacacagaacctctacactatcatgttgacacttaccttgaaggcaagaagcacctgatatgcactttcactacaagggccctaacagaccttctttcctttccttatcttatcacaactctgaactgttcagtctccttgtcctatcagttccagtgataaaagggctcattataatcctgaggggacgaagagcccaatatctgccctaatttcttccaggataagaatcactgatgcttcatcaacatacccattgtctgtgtctcagctcccaagagccatctcttaagaaaacagaacaaaacataaaccctgccacctttcacttccactaaacagtccaaaccatggaagctatagtaagtctaaggaatagtataatctctattcaggtgaaggagttgcttaattcaagctgtaggcatatcatgacattggagcaaagccatttcaaattttaataactgtctcttccctttgggatgccctcaggcaatctacgtatttttctcatctcagcttgtgattttccctgttgccaaaccattgtctggaatctgatcaagggttgctacgtttcactgaggagaaagaaaacattcagaactatggaggacattttaatagtgccctcctcccttgggtaatgtggaatctatgaacacctgctgataatctcatttcagacaacaatttacattttctggtagattctgtaagagatacaagagctaggtgctgtaagttgtataaagggaaagacacaggtgataccattaggaagcttgtagtctagtttagagggaaaagtctgacatgagtaaaacaatagcactattatcacaagaatagtagcagtgattacagacagcattggctcaagagtagtcagactacctggatttgaaacctggatagccatttactgtggttttcggcaacttgacctctttctgcctcatttgacttctctgtaaaatagggaagataactaggcttttcatttgctgcttactctcaggtctattccctgcctgtttcttgtatcaagaaaactacattcctcacaatcctttgccctttggtgtctgagcagattcaaccaatcagatggtaggaggaagggagaagctagactatttcttccccatcccatcctcacttattttggtgcccccagcagcagctgtagctcctctggggctcaactccaaattccgccagccatctcctccctacttggccccagcttttgcagcgactccccgtcttggctcaagctccagccagagtgcactagtcttggatctaagaacactacctcttcctgttgaccctcgaactccaaggataaaaggggcttcctgttgttgctaatctctaagttgtctcactattccctttttaacttgtcagatcttacatcatctgtgtaaccaatccccgcattaaatctagatttgaaagtcctagagtgggccgggtgcagtggctcatgcctgtaatctcagcactttgtgaggctgaggtaggtggatcacttgagaccaggaattcaagtttgagatgagcctggccaacatggtgaaaccccgtctctacaaaaaatacaaaaatgagctgggtatggtggtgcgtacctgtagtcccagctactcgggagactgaggcacaagaatcgctggaacccaggaggtggaggttgcagtgagctgagatcatgccactgcattccagcctgagtgacagagcaagactgtcgaagaaagaaagaaagaaagagagagagagagagagagagagagaaagaaagaagaaagaaagaaagaaagaaagaaagaaagaaagaaagaaagaaagaaagaaagaaagaaagaaagaaagaaaggaaggaaggaaggaaggaaaagaaagaaaagaaagaaagagaaaatgaaagaaagtcctagagtgatttctgttttcctggctgtaccccaaccaacacgtatctgattgaatcattgtgaggtacgtttaggaagtacaaattgaactgagccttgaagaattggtcaaatttggaaagacagaaaattgaggacgtggtatcagatttcatttttggcaaggaaatagcttgcacaccagcggggattggcctagtgtttattaaaggcggtaacactgtaaggattggcttcagtcttctctgcctaccatactttattccccaggaaactatcttttcaacaggcagtgaagtcccccctgccccaacaatgaggagaagcaaaaacagtagtcgcatctttaggaactgcatgacaaagtgcagagcctacctttagaaaaatcatacaaggagatgaggtgtgtttgtgtgtattcccacatcccaactctgggtcctcacattgctgtctacctggctcagcacagaaccctagaccgcctgacctggaaaagccccaggcccctcctctaggcccaaactgagctctttctcattcactaaggcttaaagaagtcagtaaatatgaatgtaagaaataataatatctagcatatagacaagcctttattaaatgccagcactaagtgctttctattactattataactactattaataactaccatttattaagcatttatgtcccaaacactatacacaacactttgtacctattatctcattaaattctcacatcagctttataaggtaggtactgttattgactacattctatgggtaaggaaactgaggcacagagataaaagtgactcgcccaagggtacacatttttttttttttttttttttgagacagggtcttgctctgttacccaggctggaatgcagtggcacaatctcagctctctgaaacctccacttcccatctcatgtaatcctccagcctcagctttccgagtagctgggaccacaggtgcaagccaccatgcccagctcatttttgtattttttgtagagatggcgtttcatcatgttgtgcaggctgatctcgaactcctgagctcaagcgatccgacctccccatcctcccaaagtgctaggattacaggcatgagccaccactccctgccaagggcatactcttaataaggtctgtccgacctgaagtaacaaagatatctcacttcctcttttcctgccagcatctcaagcccccaggccctgatacacaaaccacaccggacccctgcccaacctcagacttccctggcttcatgcttccccctggttgactaacttgctgactgttccctaggtcctaaccagaaggatcctttaaggagcctttcccttggttctggacacaaagcgacttatttcctaagctgagatcccctatctctacccccaacacacgccaactagctctctttttcttctttagtgtgtccagcagacttcacacaaccagtttcttctcaactctgcccctaatacttccagcctccccaaatgagcaagcagacaaccacagccacagggagtaaacgggtcagcactaccaagttcgtttgtatgacaagaattcctcattgaatgaacacatcctgccttgagacatctcagccttgttctttgccagacagctctttgcatgcctaaagcctctcttgacattatactcacaccagtaaatggactatataatatccatcttcagggaaggagggaggagcattgtctctgcaaacgctgcagggggtaccaaaggctgacttttcagacagacctcccccattctgcctgggcctggcctggccctccccctggtggtttgagacagcaacagatttcttggtcattctgcatcaatgcctgctcctggttttgtcagcaagctgtctgagaggctgagagctctttgccacaaaattctcagggtgtactttggcaggtctgtgccaagcagcagtctctgcttccaacagcagcaacattctttgatacttgcttctacctgctaatgattttggtgactgacaaagatgcaagtggaaatgggatgaggacaaatgaaaggatgtagattttcttttcctgtcctaaacggcaaccaaacagggcagatgtgtgagctactcctccggatcccagactcagctgggatgttcatcgggaacatcagtaattgtcatgaagactatcttgggtaactcagagacaagaccaacaatgccagtgacagaaaggttccagtgcccaaaaaaaatacctctccccatctaccggctgatgtcctttactctttcattcattcacttaacaataaattaacaattgaataaatatctattgtatggataaatgaataaacttaataacttaataaacatgtattgaggcactactatgtgccacactacattcttggcagtggagatacagtagggtgataggtgaacaagacagactgggtccttgttctcatggagtctacatggactgtccaatcatggaactacagtttcaaatttcactatttgcattttgtttctttaccttaaggctgcacttaaccttttatgggtcacagattcctttgacaatctgatgaacatgaacaagaaaaaagcatatattagcaaacatacataaagtttagcatctcaaagggtttacaggcatcctctcattatcatccagaaattccttaccttaagatttgtcctcagttataatgcaaatatgctttgagctatgaataggtcgcttaggactcagtgtaaatgagtatgtccaatcccttattaagatcaggttttcccatgtgaccaagcaagtgagagataccataagggaaatgcgcctgaggaatactgaggaggggacaacaacaagaaaaagagattggagacactgaaggaaatgtcaccatcatcacagttttgcaaagaatcaggtcggtgtaatagtccccaagtcaaaggtgcctttggcctctacataaaataacaattacccatggacattcctgagataaaaatgactgtgtttttatttccaaaagtatcagagttgaggttcagaaagtattgctttttgtggtgtttctggaccactgtccacaacactctgaagggttgtgccaaccaaagggtaccccggaacctaaagcaaaagttaaaaaaaaaagaattgatccttgtggaatacttagccttcctacttaaattggtctctgaatgttctctccataggatacaaacatttgtagacaagtcaaatgtccatggcccaaaggtcattgtctgagggtgtggttcttcttggcttctgccttattcccataatccttgttctgggcaccaggaatcatttgactagaaagctaagagatagaaactttatttatttctgagaaacctgaggtttaaaaactaaatgtgagttctgagttattaatattaataaggccctctctcttcctgtggttactggagccttgtgccatagcctggctcaatgtgagaggcagaagggcaaggaggtgtcctttagctgtaacacagaggtcagaatacccagtggagcatcaaagattacaacccactgcattactctcccttttacttgagatctgacagcagaattacgttatctcagctgtcaaggtaaatccgcttttctttaaaagaggaaatagaaaaaaatctaagagtgaaaatgtgggaggggaaagtcattgtatttctctcttttctcacaggattttgctttttcctctgttttgttctgtatcccaatttccccctgggtatttgaacttacagaactcctgggcccataaaattgtgagctaatcacaaagacttgtcaaggaatgtatttatctcaaagcccttcctaataaatgtagtgtatcaggagtttcccagaacataaggaaagaaagtaccgtaggcctcctcattcattaggaaatcaacaccaattattaaagaaggtttggactagtgtgattagaaccaactcaactgacttcatcagagctcccactgccctgaccctaaagattcttgggggtatagagaagtttccattgcccaatggatattctaggaggttataccacagggtttttctcttaataccttatttcatatgtttcatacaggaacattaatcaactcagagatattttatgctgaaatctctccatccttaaccaggatacactttctggcacatagtaggctttcttttaatatttattgaataaatggacaaattaattaattgctaatgtataagacttcccggaatattttaaaatgaggagagagcaactgacaaagctgactaaacctaagtttattgtcttcttgttcaggggttagcaaatgttgtctgtaaagggccagatggtgagtgtcttaggttttgtggactctgtctcaactacccattgtaacacaaaatcggtcataggcagtacataaatgaacgggcatggctatgtgccaataaaaatttacttattgacactgaaatttgaaatttgtataatttcaagtgtcaaaaatattatttttattttttcaatcacttaataatgtaaaaaatcattcttagctcatgggcaatacaaaaccaggtgacagtccaaatttggcctgcaagccatagtttaccccctcctactgtagttgcttcaaaatgtgtctattttcaaactttgaggactaaagctctgtgaagacaagggctctgctttaggttttctctatattcctctggtgcctggtaaaatatggcacatatagaagatactcaataaataccttttcactgattgatagggaaaaggttggggatatctctgatctatagtttgtcgactatgttaaaaaatacatgatgtcaatttatatccattgcaagtgtttagagatcaataaatttctatggcagtgggtaggggtattatctaatggaaagaaaatctacctagatgatggattttataattatagtcaatacagtgctttatactttccaaagcacaatagcatatcatattgtcttattcgatcctcacaagagctctatgaaagtaggcactattatctgaatgttacagatgaggaaacaggcttcccgagtttgagacttgcctggggtttcatgccaggtgtgtttgttcattcattcattctttccataagaacttgtgagtctgctatgtgcaaggaagtaggtgagagggaactcaggtctagtgacccctgaggtgatttttagaagctatctataagatggaagtatggcttgggaagttaaaagttagttcctgataagtgaggtaggaagttagaaaacacacattatgactatctgagtacatgataccagtaagaattccaggtgaggacggacctgcagcttttcccatgtcccaagtgataaggtatacctctatcttcatccaggctcacaaatagaagttctgattggcttagttccagttatttctgaaaactgcaggttaagctcagcaaaaaccaccattcttacattatggttccctcactccccagtggaaagacacaggccaaaagaatgatctgtgcctccttgactcaaggatttacatctctggagttgcccagtaaaggtgacaagcagttcagtgggattcaggagtaccacatctgctagaatggtgctcccaaaattgtgcagtatatgacctgcacagctgaatgcagaatctctaaagggtcacttctgaagcagaaaaagctgcttttttctgcaggaaacataagcaaaagagaaacctgggcagtcaaaggcctggctgagtatatacagggatctgttcttcaaaatccaaggccctgatcaggctctgtttctgtttccacacattttgcaggaaccttcctgatgccggtgcacttcccaaaaagacagtatagctcagtggttaagaacttggcatctagcgtctgccccatccagatttgagttgtagtccaccagtttctagctgtacatctttagacaaattttttcactttggtgagcctgtttcccaatctataaaatggaaacagtaatggaacccatttcatcaagcaattattaagatttactgatatgcttgaaaagtagccgggcacggtggctcacgcctgtaatcccagcactttagtaggctgaggcgggtggatcacctgaggtcaggagttcgagaccagcctgaccaatatggagaaaccccgcctctactaaaaatacaaaaattagctgggcgtggtggtgtgcacctgtaatcccagctacttgggaggctgagggaggagaatcgctagaacctgggaggcggaggttgcagtgagccaagatcgtgctgctgtactccagcctggtgacagagcgagactctgtctaaaaaaaaaaaaaaaaaaagagaaaaagaaaagaaaagtggtaggtaatattgctgatgctaccctcagtttcatatctgcctttgggtcttcaattaatttattctacaaatttgattgtacacctactttgtgccaggctctaggactgatctctaggaatacaatagtgaacaagacaaagtctctaacctcagtgggctttgattctactggggtagcctaagaataggcaaatagagaggaatccattaataattatttatttgcaatgattggtatgagaaaaaatagaataatagagaagtacactttaagttggttgctcagggaaggtctctttgagaaggtaatacttgagctacgaactgatggatgaaaatgagccagctctatgttcctgtttaggaaaaaaataattgaaatatatgaggcaaaattttccccccagttgctgtccttttatccaggcctttaggcttctggccattttaaggaggttcttgcggagtcgagccttgagttgcaattttactggggaaatgatagagggcagaaggagcatttgttcagtgggtattgatgtgcccataccaaagctcagaaaggttggcaggagagtgaagatcagacacaggtgtttgggagcgaggatgaaagaagttcaagctagctggcacttctgatgtgaagtggggtgtggcaggatgctaaagagaggctaatctctccagttattatcccactgaattctatgaggatactcctgtccaggcagtaaccccatagacaggaaatgaagtaagtggtagatgtgcatgaaagcaggagtcagaagacttcgattctggatctgctttatcattgactagatctgtgaccctagagaagtaatttctctctccagaacctcagttgccacatctgtgcaaggtaacaacttcacagggtttcctgccaacttcacagttcacagagtgggtgtaaaaatcagaaaagaggccgggcacggtggctcatgcttgtaataccagcactttgggaggccgaggcgggcagatcacgaggtcaggagttcgagaccagcctggccaacacagtgaaaccccgtctctactaaaaatacaaaaattatctgggtgtggtgatgggcgcctggaatcccagctactgggaggccgaagcaggagaattgcttgaaccttggaggcggaggttgcagtgagccaagacggcaccactgcactccagcctgggtgatagagctagactccatctcaaaaaaaaaaaaaaaaaaaaatcagataagagaaagtatgtgaatgtgctaggaaaaacataaagccaggaagctaggaaagacaaatatgaggtactggctgtctagtgtccctttcccactgataggctgacaggtgaaacacttggcatttaattttctggtccatctgtttgagattggccagaaagcccttatgtagagaagacagtagccccagaaagtccaaaaagagtcccatcccatggtggcaagcaccacttctaaggatgtaaggaggattcttccactatgtgagctcagagggccctgcgaggccattatttcctttgagtaccacctgagatatcacaagaattgtttctgcagtaataaactggagactttaaggaagtaacatgtttatttccaagtctcaactataatatacatattttatattacccagaggcctctatgttgctgttctttctgaccgtacataaggcaccctgctcccatcttctccctccatcctactccattaaggccccaccttccttccataacaatggagaggggtggcatctaccaggaaagagctacattttgacagttccagcttccaactaccttgaactttttttttcccttctcccttcaccattaccccactttgtggtaggaaagggaggacaggaacaggagaaaaattgaaactgacaagatgactacagagaaggtatggggaactgaagaagccctgcaactctattggttgatttcatgagaaatcgtgaattttaaaactgcccaaatttcattctgactctcagaaagtaaatgactttgttgaaggcaacagagtgggtcagaggttagatcacagatgaaggaaccctggggatcctgtgctctcaccaatttgcttgcaacttttcctgccacatcccttggaatcagagagggaaagataattaaggcccattgtttatggcctgtgttgcttttatgagtacacatgtgttctatatactaaatgctcgtggttggtgacagtctctctaaataaaatccagtgatgactgtgaagaccttgcaggaccattttagaagatgaaaaggagattcctgtgcagtctcagggacccaatacactggatcaattgcaattgtcttttgttctgccacttttattgttacccatgcaaggcagcctgctggttttccattagaaagaccagagagtgccaagcctaaataaccactgaatatcatttctatctctgctccctccctctctcattcattagttagaaggccatatatttgggttgtattgtgcacacattaggaaaggctgggaagactactggttgtttattctgtctttgttcctccttctcctatcttctttccatagtagcctgataaactaacttggttcattttgctacatggcctaataacattatcaccagggatgcacaaattatacctactctccaccgtcctgtgtcttgtcaacagagagacggaaggtgacatggacaggcgaaaagagggacagatggaaaggaggaagagttgctggttagctgctttggcctgctgaatatatatatatatatatgtgtgtgtgattctcactctgtctctctctgtctcccaggctggagtgcagtggtgcgatcttggctcactgcaacctctgcctcctgagttaaagcaattcgcctgcctcaacctcccgagtagctgcgattacaggcgcgtgccaccatgcctggctaatttttgtatttttagtagagacggggtttcaccatgttggtcaggtgaaactctgactcaagtgatccacctacctcggcttcccaaagtgctgtgattacaggtatgggcgaccgtgctgggcctgagtatatctagattagcaggtagaaactctgaattcatgtttctgaaaatggtcagcgaccacctgcatcaaaatcatcgaaagaagcttgttaaacaatgaagattcttgggcctcccacccccagagcataatttttttgtgtatctgcagtgggacccaggaatctgcattttgacaagcaccctaggtcagtctgatatccactgaggtttgagaaccactgatgtaaacaaattctaatacattcacccggtttcaaaggcatgctcaacctctatattcttcttgagttttcatatggtagcctctttctgaggagtttcttccctccatctctgcccagagatatcctgctaatgtctcaaggcccagctcaaatataacctatttcgtaatgtcttctctgctttctgtttctcacctgcaaatagctgggatctctcttgaagcaatgagacagaatattggcttgatgtcagtagtggagtgtgaggggaattgggaacatgaggatgggagagctggaatggagctggagcttgagttctgaggtttgccctgaagtgtagcacctgagtttgcacactggagctgaggtggttaaaaaggctggaagctgagtactagtaaaaaaaagtaacacacgccaagtcctcaaatggtcagagcagtgaccccaaccacctagaaaccataatttgggagggggattagcagccctttcatgcctgaggatggggatgggagacaaacagaatggctgcccactagactactgcacatgctcagtagggaaaaggacctgtttgcaacactcaccaagggggctcttggagtttgggaaaggttaaaggggctattgggaagcatcggtactagggtgcaagggagtcttgggggcagtggatgggcagtgaataataactggagggacagctctctttttggccctgacactttgcagctgagtttgtacacttaaattgaagttgctgtgagggctctagactagctaaaccaatctcaaagtgattcccagcaggccccagaatgattagaacagtaaattctaaccacctagaaaccttagagagtaaatgaggattgtggactgttttgtgggagggaattggctccccatagaccacactgcatggatgcaataagttagaggggagggcattgagggatatgggaatacttgctgaggaatgtttctggcttcagggtctccacaaggttgagggaggctttgactacctccatattttgaagactcctgtatattttttaaacaagttgaaaaaataaagttaaaaattataatctcttcaaaatgctaacatatttttaaaattacatttttagccccaaagcaaaactacaatacaatgtataatttctagtgaggtccagaaatctgcatttttagcaaatgccccatatgattttgatacacaccaacatttgagaagcatgccctgaattctaccaagagaagaaagcaatccaagtgaggtagacttcccttgtcagggaaaatgaaccctctcgcttctctttggcatgtatatgtcacagcaatttgtgttgctttcccatcaaagtgaagtagagctggtcttatactcaagtgaagtaggtaactaccagttaaagtgaagcctcccaatatgtccccctgcccaaaatatctctccaaccggcctgcccatggggcctaagattcctaggagcagcctttctccttaagagttatcattagctctgcttttgctgtgtttgtgcctgccactctccctttgtattaggttataaagttttccaatttgctaaacaagatagttgcttgcaggaaatctgaaagaatatgtaagactttgtcaaaaactggtaagaaattggccttgcagtttgattgcaaggaaaataactgtgagcttggatttgttgagaaatgtaaaattgaacaggcatgttcatttaacctctagctatggccatgtgctcagaatctggacaaatcaacaacatttgagggtgtgctctacaatcagagtatatatactcacactgtgaaaggagctaaaacaaatagaagccttggcctgctctacaggagctgacaatctgaaaggcaatgcagggcacacacatgaattagaacacatctgtaaggctatgtgtcgttaggtgcacattatagccgcacaaaagtcctaaacactgtggaaagtggagaaaaggcaggaccactgtctatggtggtgtagtttgtctcttacacaaaaccacccagccaggagctgatctgggaaaatgttccaaagtcatagttgggtagagagggtaggacagatagtagaaaagggcatcactaccaaacactgaaagtaaacaagggaacagccaatgtccaatttgtctatcagataaggtgaaaggctagtcccacgaaaataaatgaaaatttattggggatgatatctcttggaaagttttagataagtatgattacaaaagcacatccataatgttataattcagtttaaatcaagggttataaataaaacagatttctatataccaagtgattttgtcatccatattattcactgctataatcccaccacctagcatctggcagacaatcaacacatatttttgaatgaattaatgtatgaatgcttaccttactcaacaattagcagcttactgtgtttatccaatccttccaggtgggctatagttgctgatctttaggattcaggtaataccgctgtactccaattgtattctgtgtggcattcccatcaccgccactggacaatcatctctttatacccagaactatacagaacacttgcaatgtgggagttgctcaacacaggaatcaaaaaaataaatggatagttagataatgaattgatacatgataaatgaatggaaaaagactgtttagaagagtatttataataatttctctgctaaattattgcataataattcccaacgtgaggtcacgtgagcaccagaggaatgggagcaattggggtcctcaagctcttttcaaaatgcttagctaaaatcatatcctcatatcagtggagtgggtgcaatgaggggcaccagaaagcattctatgcacacacacaaaaagttgcctatggtttataacttggcctactgtatctttccattctctgtcaaaaatcaagtattcttccctcaaaacctttagaaaatttttaaaggacataactgcttattgtttaaaatacctacaaacaaaaagctaaactcacgtagggattaaaaaaaaaaaaccaccggcatttccagataccaagacatctagccaagtttattaaaaaaatggctgaatacccacaggagttgaatcatcattctccctttttgaacatgtccacagatggaaatctgtgcttgaaaatgtgactcagttcattttaagaaatactgattgaatatctacttcatttcaagagctgtggtagcaaaacataagtgtatttccaaggatgagagattgctgttctgggccatcaaagggtaaaatgagaactcaaggtttgttcctggtattatatgttcagaagtacaggggaaggaatcaacaattatatagctcttactacataccagggagtagcctaggaattttatattgacttctacaaccattctgcttggtaggtatttccccccatttttactgttgagaaaactgtgactcaaagacttgaatttactggtctgagatcacatagctagtaagtagaacaggagtattccaaaccgttctgtgttgtttgactcccccccaaaacctctgcccttttgacagtggcatgctgcttctcaatatttcatactgctcttacctcctatcctcctctgcatcctaatttgcctacagaaacactgtatcccatggcaaatttcaggacagtgagagtttattatagccataactctgtgtgtgtttgtgtgtgtgtgtgcacgcgcaagcgtgtgcacgtacataaaatttatatattgaaattgttttagttcagggtctcatcaagagcattctaacattttgctggcataccctctaatgaatttggaaaaacaaaatctatatatctccttacatatttttggattgatgtccaaatatttcatcataagtttcaacagttgcaaaggatgtaatttctggaatacggtagacattgacatttaaaataaaactatgtaattactcatttaaatgcatccaatggaatctgaatactatagcaacttcttactcatacccatatgttaagaaaataaatggcttaaatcttcttcaggggaagaaagtttacatcattcctttgtctccttgaattctcatttccgttccacatccccacaaaattttattgtaatgttatataatttttgcatttaagtattttattttttattgctttgtcatatttcttcataagaaagcataaattgaaatttaatttttttattccctattgccataaggtaataatgttaaaaccattcttctgaatttagttgtcctttaattattagtagtaccaaactacttgaaagaacacaaatataaatataaattttgataaacaattattagagataaaattacacttttattaaaaatgcctttcttcttaaaaatgtgattggagcttttctcccaactaggtattatattcacagatgaatactgaataacattcaggaacaagattcagcatcaattatattttgtttccatttttataaaagtaaatgttatgaaatctttttcatatcaataattatatgtgaattgatagagtttaattatgctactgtcactcaattttttaactcagagttgtgtgccagaaagtcatataattatttttcataaaataatatttttaacaatttattatctgaatacttgattaagttctccttaaatgttattgaagtcaataaattagaaaccacctgagacagaagacaatttgttacctaagattagagtcattcagtttctcaatttctgggaagtactactctggtaggcagcttctgagatggacccctgtgatttccactttctggcatttgagtccttatgcagtcctctccccatgagtgtgggctagacccaagaactcacttttaacaaatagaatatggcaaaagaggcaggcacggtggctcatgcctgtaatccccacactttgggaggtcgaggcgggcggatcacgaggtcaggagttcgagtccagcttggccaatatggtgactccccatctctactaaaaatacaaaaattagcctggcatggtggcgggtgcctgtaatcccagctactcgggatgctgaggcaggagaattgcttgaacccaggaggcagaggttgcagtgagccaaaatcacgccagtgctctccagcctgggcgacagggcaagactccatctcaaaaacaaaacaaaacaaaacaaaaacaacaacaacaacaaaaaaaaaaacaaaatgaagactacggcatggtgaccatagttaataataataatgtattgtatacttgaagttgctgagagagtagatcttaaatgttctcaccacacacacataaacaaaatggtaactgaggaggcagagcaagatgactgaatagaagcctccaacaaccgtcctctgtgcaggaacaccaaattaaacaactacacacaccgtaaagcaccttcataaaaaacaaataacaaaaaatcaggtgagggatcatagtacctgtttttaacctcgtattgctgaaagagacactgaagagggtagaaaagacagtcacgcattcccgacaccatccttcctgcacctctggcagtggctgcatggcatggagacagaatctgtacacttggaagagggagagcatagtggctgagacattgcattgaattcagtgctgccctgtcacagcagaagcaacactgggcagaacccagcccagtgagctgggctaacccctggagtgagcatttagaccagccctagccagaggggaactgttcatcccaaccatcagaacctgagttccagtaagcctcaccacctcaggccaaagtgctctggggttctaaatgcacttgaaaggtaatctgggccacaaggactgcaattccttggcaagtcctggtgctgtgctgcacatgatgcaagcagacttggggtacatgtgacctagtgagacaccagcaggggcggccaagggagtgcttgtaccacccctctcacaatccaggcagtgcaactcatagctccaggtaagaccccttccttctgcttgaggagcagagagggaagaaacaagaagactttctcttgcaacttggataccggctcagccacagtaggatagggcactgggcagagtcctgaggcccccattccaggccctggctcttgaatgacaattctagacacatcctgggccagaagagaacctgctgctttgaagggaaggactcagttctggaaggattcatcacacactgactaaagagcccttggaccctgaataatcaggagtgttagtcctgtagtactcactgtgagccttgggtgagactgagaaatatattggcttcaggtgtggcccagcattattctcagctatggtggctacagggagagaccccttctgcttgagaaaaggagagggaagagtaaaggggactttgtcttgcagcttaggtgtcagctcagccacagtggagtagagcaccaagcagtctcttttggtccttgatcccaggccttggctcttggacagcatttctggaccttccctgcaccaaagggggtaccactgccctgaagggatagtcccaggactggcagcattcattgcaagctgactgaagggtcattggcccttgagtgaacatcagcagtaggcaggcaatacttgctatgtgcctggtgtggtggtggccatggggaaagactcctcagcttatgaaaaggggaggaaagagtggggaggaaagattgggaagggttttgtcttgtggcttgggtgccagctcagccccagtaaaatagagcaccaggtagattcctaaggtttctgactgtaggccctggctcctgtatggtatctctggacccacctggggactgggggaacttaccacccagaagggaaagacacaagcttggctggctttgccacctgccgattgtagagccctagggccttgagcaaacatagatggtagccaggcagtggtcaccgcaggccttgggtgagagccagtgctgtgctggtttcaggtctgacccagggaagtcctagtggtggtggccacagtggtgcttgtgttacctccccccaactccatgcagctcagcgcgtgcacacacacacacacacacacacacacacacacacagagagagagagagagagactccatttgtttgggagaaaataacggaagacaacaagagcctctgtcttataatccagagaattcttccagatcttatcaaagaccatgaaggcagtacctctacaagtctgcaagagccacagtattactgggcttggggtgtcccctaatgcagatacagctgcagtgacaaaaaccttagatcacaacacctaaatcccttcaaatatctggaaagccttcccaagaagacatgcacaaacaaccccagactgtgaagactacaataaatatctaactcttcaatgcccagacacagataaatatggaccagcatcaagagcatccacgaaaacaagacttcaccaaatgaactaaataaggcaccagggaccaatcccagggatacagagatatgtggcccttcagacagagaattcaaaatagctgttttgagggaactcaacaaaattcaagataacacagaaaaggaattcagaatcctatcagatacatttttttaaaaagatagaaataatttaaaagaatcgggaagaaattctgtagtggaaaagtgcaattggcatactgaagaatgcatgagtctctcaatagcagagttgatcaaatagaagaaagaattagtaagcttgaagacaggctatttgaaaatacacaggcagaggaaacaaaagaaaaaagaatgaagcatccctacaagatctagaaaatagcctcaaaagggcaaagctaaaagttttggccttaaaggggatgtagagaaagagatgggggttgaaagtttagtcaaagaaataataacagataacttcccaaacctatagaaatatattaatattcaagtacaagaaggtaatagaacaccaagcagatttaaccaaaagactacctcaagacatttaataatcaaattcttcccaaaggtcaagggtaaagaaaggatcctgaaagcagcaagaaaaaagaagcaaataacatgtaatgaagttctaatacacctggcagcagacttgtcagtggaaactttacaggccaggagagagtagcatgaattatttaaaatgctgaaggaaaaaacttttatcctagaatagtatacccagtgaaaaaatatcctttaaacataaaggataagtaaagattgtcccagataaacaaacgaaaaaaaaatggtaactgtttgaggtgatggatatgttaattagcttgatttaatcattttacaattatatataaatcaaaacatcatgttgtacaccatgaaaaatatacaatttttgtcaagtttacatttaaaatgccaggagaagaaaaagaatatggcaaaagtgatgtcatttccaagattacgttacaaaaagaccatggcttttctctctctcttactctgagaaaagcctgctaccatgctgtgagttgccctgcagagaggcccacatggcaaggaactgagggaggcctctgtccaatagctaacaaggctctaagaccttcagccgcatagcccatgaagaactaaacctgccaacaaccatgtaagtgaatttggaagaaaatccttccttggttgagtcttcagatgagacgttagctctagccaacaccttgtccatacccttgtaagagatcttgagccagaggcacataactttgccacacccagattcctgacccacagaaactgggataataaatgtttgtggttttaagctttaagtttttagataaaaccaaaaaggctttactaagacttatcaaatacttattaaatatacaaattactcttttacttagaggtaccttgtttaacccaacatattaagtaaaattcatgatatagaaaatagatattttaataattttaatatacctttaccaataaaacattttttaaatgcttttgtattatcacatgctttgaatataattttaccaaaactacagagctgcagatttagcaatttatagaaaatattggccaagtgctgtaatcccagcactttgggaggctgaggtgggcagatcgcttgagctcaggagttcaagttcagcctgggcaacacagcaaaaccctgtctctacaaaaaatacaaaaatgagccaggtgtggtggtatgcgcctgtagtcccagctactcaggaggttgaggtgggaatatcacttgagcctgggaggtgaggttgcagtaagctgagatagcaccactgcactccagcctgggtgacagagtgataccctatctcaaaaatatatctatatctatagatagatagatagatagatagatatctgtaatttagcctaactggcataataattttcatttccaaaacaattggctaaatcacacttacttattttctgtctcaaaaaatacagcttgatttttcagctcaataaatatgtcagtactcttcatgccctttgcccactttggaaaccaaaaaaagtcaaggtccagatggattcacagccgaattctaccagaggtacaaagaggaactggtaccattccttctgaaactagtccaatcaatagaaaaagatggaatcctccctaactcattttatgaggccaacatcatattgataccaaagcctggcaaagacacaacaaaaaaagagaattttagaccaatatccctgatgaacattgatgcaaaaatcctcaataaaatactggcaaaccaaatccagcagcacatcaaaaagcttatccaccacgatcaagttggcttcacccctgggatgaaaagctggttcaacatatgcaaatcaataaatgtaatccatcacgtaatcagaaccaacgacaaaaaatcgcatgattacctcaatagatgcagaaaaggccttcaagaaaattcaacagcccttcatgctaaaaactctcaataaactaggtattgatggaacatatctcaaaataataagagctatttatgacaaacccacagccaatatcattctgaaagtgcaaaaactggaagcattccttttgaaaactggcacaagacaaggatgccctctttcaccactcgtattcaacatagtgttggaagttctggccagggaaatcaggcaagagaaagaaataaaggatattcaattgggaaatgaggaagtcaaattgtgtgtctttgcagatgacatgattgtatatttagaaaaccccatctcagcccaaaatctccttaagctgataagcaacttcagcaaagtctcagaatacaaaatcaatgtgcaaaaatcacaagcattcctatacaccaataacagacaaacagagagccaaatcatgagtgaactcccattcacaattgctacaaaaagaataaaatacctaggaatcctacgtacaagggacgtgaaggacctcttcaaggagaactacaaaccactgctcaacaaaataaaagaggacacaaacaaatggaagaatattccatgctcatagataggaagaatcaatatcatgaaaatggccatactgcccaaagtaatttatagattcaatgccatccccatcaagctaccaatgacttccttcacagaattggaaaaaaactactttaaagttcatatggaaccaaaaaagagccagcattgccaagtcaatcctaagccaaaagaacaaagctggaggcatcactctacctgacttcaaactatactacaaggctactgaaaccaaaacagcatagcactggtaccaaaacagagatatagaccaatggaacagaacagagccctcagaaataacaccacacatctacaaccatctgatctttgacaaacctgacaaaaacaagtaatggggaaaggattccctatttaataaatggtgctgggaaaactggctagccatatgtagaaagctgaaactggatcccttacttacaccttatacaaacattaattcaagatggattaaagacttaaatgttatacctaaaaccataaaaactctagaagaaaacctaggcattaccattcaggacataggcatgggcaaggacttcatgactaaaacaccaaaagcaatggcaacaaaagccaaaatagacaaatgggatctaattaaactaaagagcttctgcacagcaaaagaaactatcatcacattgaacaggcaacctacagaatgggagaaattttttgcaatctatccatctgacaaagggctaatatccagaatctacaaagaacacaagcaaatttacaagaaaaaaacaaaaaaccccatcaaaaagttcgcaaaggatatgaacagatacttctcaaaagaagacatctatgcagccaaaagacacatgaaaaaatgctcaccatcactggtcatcagataaatgcaaatcaaaaccacaatgagataccatctcacaccagttagaatcattaaagagtcagaaaaccacagatgctggagaggatgtggagaaataggaatgcttttacactgttgattggagtgtaaattagttcaaccagtgtggaagacagtgtgacaattcctcaaggatctagaatgagaaatacaatttgatccagcaatcccattactgggtatatacccaaaggattatgaatcatgctaccataaaggcacatgcacaagtatgtttattatgtttattatggcactattcacaatagcaaatgtccatcaataatagactggataaagaaaatgtggcacatatacaccatggaatactatgcagccatggagaaggatgagttcatgtcctttgcagggacatggatgaagctggaaaccatcattctcagcaaactatcacaaagacagaaaaccaaacaccgcatgttctcactcataggtgggaattgaacaatgagatcacttggacacagggtgtggaacatcacacactggggcttgtcgaggggtggagggctgggggagggatagcattaggagaaacacctgatgtaaatgatgagttgatgggtgcagcacaccaacatggcgcatgtatacctatgtattgaacctgcaggttgtgcacatgtaccctagaacttaaagtataataataaaaaaatacataaataaatgaataaataaataaagatatagatataacatgcaggcttgctatgagtttgtcaccattatgaaatgaggtgatatagatagttcttctaatgttgtctttttcgctttgcctttacagaattctccctcaggaatgatatattccttgagcaatagttgagaaatgtagaggaggtcgttaaaagaagattatcatcactcttgtaataccactacaaattatcccagtatcccccaaaccagctcaaacactgtgtatctaagcttcacccttaataaaaatatgtataaggtgtagagtgatttttaaaaagccaatgatggatacatggtacagtaattgaaggtgtcatcttaatattttaatggcatggaattttttttactgctttgtgaagcctttggattccttatctagaattatacttttaaatatataaaaatataatttgcttttgcataaattgacaagctgctcctaaaattcatatacaaatataagagaccccaaagaaccaatataatcttgaaaaatcaatgaagtttgaggatttatacttccaagtttcaaaacttactacaaagctatagtaatcaaaacagtgtggtagtggcataagaattgacataaagaccaacagaatagaattaaaggtccagaagaaataaattttttatgagtttctgtcaagggtaccaagacaattcaatggagaaagactagtcttttctaacaaacggtgctgagacaactggatttccacatgcaaaagagtaaagtaaggctcctttttcataccatacacaaaaactaactctatattgagcacagacctaaatgtaagtgataaaactcttagaagaaaacctaggagtaaatctttgtgaccatgggttagacaatgatttcacagatatgacactggaagcacaagtgataaaagagatgattcatagttgagtttcattaaagttaaaaactttttgcctcaacatatactatcaagaaatcagaagacagcccacagaatagaagagaatatttgcaaatcatagatctaataagtgactggtatccagaacacacaatgtttacgtctcaataatacaaagacaacctgattttttaagtgggcaaaggatatgaaatgacatttctccaaataagatgtacaaatggtcaatgagcacattgtaacatcctcaacatcattcggcattaagaaaatgcaaattaaaaccagaatgagataccaccagttcacactaggatggctataataaaaaacatggacagtaacaaatgttggtaaggatgtggagaaattggaaccctcgtatattgctgatgggaaagtaaaactgtatagccactttgggaaacaatagggatatccctcagatagttaaagttatcatatgacccagcaatttcattcataggtatatactcaagagaattaagaacatatacttccataaaaactcgtacacaaatactcataggagaattattcaaaatattcacaatagcaaagagtggaaacaacccgaatgaccatcaattgattaatggataaacaagaagtctatacaaggaaatattattcagccacggaaaggaatgaagtaccgacacgttacaaaattggtgaaccttgaaatcattatgctaggtgtaagaatacacacacaagggaccaatattttatgattccatttatatgaaatgttcaaaacagataaatcagtagagatgaaagtagaatgattagtggttgacagagacaagaaagggcagcaagaagggagtgctggaaagtaactgccaataagtttatttttggagtgatgagaatgttttaaatctaggtagtggtgatggatgctgaactctgtgaatatatagctgacccttgaacaatgcacaggttaggggtgctgatccttcatgtagtcaataatctgcttataacttttggtttccccaaaacttaactactaatacactaatagcctactcttgatgggaagccttactaataacaattaacacatattttgtatgttatacatattatatactgtattttttttttttgagatggagtctcactctgtcacccaggctagagtgcagtggcatgatctcggctcactgcaacctccacctcccgtgtacaagcgagtctcctgcctcagcctccctagtagctgggattacaggcatgcaccaccacaaaagcaaatttagtagagagggggtttcaccatgttggccaggctggtctcgaactcctgacctcaagtgatccccccgccttggcctcccaaagtgctgggattacaggcatgagccaccatgcctggccaatttttggatttttagtagagacagagcgtcactatattggctaggctaccctcaaactcctgacctcgtgatccaccctcctcggccttccaaagtgctgggattacaagcgggacatatactgtattcttatgatgaagtaaggtagacaaaagaaaatgttattaagaaaatcataaggaagaaaaatatatttattattcattaagtggaagtgaatcatcatgaaggtcttcatccttattatcttcacgttgagtaggctgaagaggaagggaaagaggagtggctgatcttgctgtcttaggggtagcagagacagaagaggtggaagaggtgaaatgggaggcagaagaggcaggtacactcagtgtgagattttgctttttcatttctgtaaaaatttttctatatggtaccaatccttccaccatttgcttcagttttcatgcccatatcatagaagggtccctgtcataaagaagtcaaaagtagtcttgaataatcagaactcttctgccagattgtctaatgttaatttgttttctggcactgcttcttcacattcttcctcattgtctgtcactggttcagaagcactcatctccgtcaagtgatcttcagttaattcctctgctgtggtatctgttagcccttgaatatctccaagacccatatcttgaaacccttcatttgttacccttttttttttatccacatccacaatttcattcatgatttccctgattggctctgtcataaatcctgtgaattcatgcacaatatctaggcacagttttctctagcaggaatttactgttttgggctttgaaggtttctacggctttttctataacaaaggtggcatcctcaatggtgtaatccttccagactttcagtgttctttttatcgaggttttcttccatagcattgacagcactttccatagagtaccatgtgaaaagagccttaaaagtccttatggccccctgatctagaagctggattcaaggtgttgtattttgggtcaagtagaccactttgatgtctttggtgttgaactcacagcattctgagtggccagggcattttccaatatcaaaagatctttaaaaggcaatcccttactagcaaggtacttcctgacttcagggacaaagcattgagggaagctatccagaaaaagggttctcattgtccaggccttctagtacaaacaaaagactagcaactgggctttatttttttccttcagggctgaggggttaaaaggttcatagataagggcagtcttgatcataagcccagcacaaaagaatagagttagcccatctcttcttgcctttaatcctggggcccacttctcttccttactaataactgtcctttgtggcatttcccccccaagaacagaacactttcatctgcattaaaaaacctattcaggcagatatcctttctcttcaagaagagtctgcaaactcgtcagctgccacttcatcggcagaagctgcttctcctgttatcttgacatttttaaagccaaacctctttctaaaattatcaaaccatcttttgctggcattaaatactacagctttagatccttcaccttccttttgctttaagttgtcatataatgaattcactttttcttgaatcatattagaatctataggtatgccttccttatagcaatcctgcacccatacaaaaggtgcattttcaagacgagataataaaggtattttgcaaaaagtgcaaagtttttgcacatgctggaatagctgcagtgacagcttcacaaatttccttttttttttatttttacaatggtccttatgctgaattcatttatcttgaaatagtgggcaaccacagctgcagacctcaatctacgatacatatcaagaaatttgacattttcttgtaatgtcatgacatttctgtttcttgggagtacttccagcattgctagtggcacttcatatggccccccggtgttatccaatgtttgcagtattgcactaaatacaataaaaatatgcaagaaccacaagagatcactttttactgcaatatgcaatttattggagtaattgtttatatggagataagtggcacacagcattttaaatggacactcacaacacctgagctcaccacaatggcaacaggaggtggctacaaaattattatagtagtatagtatgtattacagttaatttcatgcagttgtgatttaatacttcatctttatgcttgtttacatttctctcaactgcaaatggtgccatgtatgctctatgtgtgcatacattttgataaattttaactttttataatagttgtgtatagtttatggtagtaaataatataatagactagcatcaacacatattttatgcattcaggatatatccatttttttcttaatttttcaatatttctaggctctgcggttcatctatgagttatttcaaattgttgaaaatatccaaataattttccaataaatttattttttagaaatccacatgaatgggctcacacacagttcacatattgttcaagggtcacctgtattaaaaactcttgaaatgtaaattttaaagaattaattttatgatgtatataatatatctcaataaagctgttgctaaaaaataaactcataaaagaaaacacagtagtaaatcttcatgacctaatgttaggcaacagtttcttagattaatacagcaaaaacatacgcaatgaaagagaaaatagataaattgagccacatcaaaataaaatatatagaattacaaaagaaagaaatgttgaaataaacagttatccaaatatttttaaacacaaatttgtgatatggtaatatatgtgcttctttattaattcattaaataacaaaatctagcagtgggtctaataagtacctaattttatctaaaggcttcatttttattttgaacttactgcacacttgacccaaaaccatttagtccctcctagaaaagatagaggtatatccactttatccattaatagctgattaggatctcttattcagaaatacacattgaggatctcagaaatcaacagaatcctctaattcagtagttcttagtcatttggggatgtgcagtttcctttgaaaatataatgaaaatccagaaaaatgcaaaactttcaatatttcacatacaggtttagtagatccattgactccattaactttattcatagaatcaagtttaacaatccctgtttcattaaatgacattattggactcaatctgctaatcctttaatatgacagctaagcactactaccttggagagcaaaatgaaagccttcatggaatacctgaaaggataaagagaaaattctaggatttactgacagactgaatgttcactcaaaaaccactgtaagccaacattgtaagggatagctctctttttaaaaatctcatgtgcaagtaaagaaagagatttttatttttttgaagtggcaattttttaacagcacagcagcctaaggcaacaaggccagttagggctaaaaagaggctgataaaaaaatgtaaaggaaaacattggtaacaagatgcccatagggggctttgaaaacctccaacagagttctagggatctagaaggccatggacatgtacagggctgtatgcatgcccagaaacattggagaaggccctaatctctcccttctggctaatcttgagctctacacaagtagtaaggaaaggccaaggcagagttttaaactgagggagtgttgaagctgtgtcacaatacatgagcaccttagcaaagaatgggagaactattgattcaaggcatttgataaaatcactgtgcaatcattaactgagcactagactgaaaatagacttcaatggctttataagacaaagaatacaggcttataataattagtcaaagaaagtcactaaacaaacaccaacaaaaaacctggtgggaggggctcaaatttccagagtagccacattatgtttttaaaatgtctagttttataaaatacaaaacacgcaaaaaagcaagaaagtatggcccatatacaggaaagaaatataccaatagaaactgtacttgaggaagccaagaagttggatttactggacaaagactaaaccagctattttaaatgtgttttaaatatgacatatcctatgtcaaagaactataggaaaccatgtctaaagaatgaaaggaaactatgagaatttttcaacaaatagagaatattaataaagtgatagaggtgataaaaaaagaatcaaattgaaattctggatttgaaaagcacaataacagaatgaaaaagtcactacagaggctcaatagcagatttgaactgacacaaagaatcaacaaactggaagatggatcaattaagacttctagtctggggaacagaaagaaaaaagggtgaagaaaattgaacagaacctcaaagacttgtgggacatcagatgtaccaacatatacataatggatcaattaagacttctagtctggggaacagaaagaaaaaagggtgaagaaaattgaacagaacctcaaagacttgtgggacatcagatgtaccaacatatacataatggatgtcccaggaggaaaggataaatgggaagaaagaatatttgaagaaataatggacaaaatcttaccaaatttgatgaaaaaaattaatctatacatctaagagttcaaataacccctagcaggataaatacaaagatatttacatcatagtcaaactgacaaaatgaaagacaaacaaagaaccttgaaagcagcaagagaaaaagtattatgtcatgtacaggggatcttcaatatgacaacaactaatttttttttaatcagaaaccatgggcactagaagtcattgtgatgacatatacaaaatatttaaagcaaaaactaccaaacaaataaaactatttataaataaccaaatgggatttatctgtggaatgcaaagtaaccaatcatattaacagttaaaacaagaaaaagcccatgatcatatcaattgatgtagaaaaagcatctgcaaacttcaacatacattgatgatttttttttaaaaaaaaggtctcaacaaactaggaatagaatgtaacttccacaacctgatataaagaatccacaaaaacctacagctaacattaaacttagcggtgaaagattgaaggttttttgtctaaaatcagtaataaagatagtatatctactctcactacttctagtctatgttatgctgacaattctagacagtgaaataagaaaaaaaatcattaaggatatacagattggaaaggaagaaggaaaactctctttatttagaaacaatatgatcttatatgaagagacccctatggaatctacaaaaaaacttcctagaactaaaaattagtttaacaaggccacagaatgcaaggtcaacacacaaatctcaatatatactagcaataaatcattggtaactgaaattttaaaatatagttctggctattatctgaatgttttgtgtccccctcccccaagttcatatgttgaaaacctaatcaccaatgtgatggtattagatggggcctttgggagatggtaagattataagggcacagtcttcttgaatggaattgtgctcttataaaagaggccccagaggacattgcctttcccccttttgcttcaccatatgaggttacagcaagaaggccctcaccagatgacagcaaatctgctggcaccttgatcttgaacttcccaggctccagaattgtgagaaataaatttctgttgtttacaagccactcagttaatggtattttgttatagcagcccaaataaactaagtctcattgacaatcactgcaaagaaaatgaaatacttagttataagcttaacaaaacatgcagaagagctgtacactgaaaactataaaacacaatggaaaaaatgatatactgtatttgtggactagaagacttaacagaataaatatattaacaatcttgacaaagaaaattaaagtggaaggaatggaattgcgctacctaatttcaacagttactatatagctacagccatcaagacagtgtggtatgatgcagagatggacatatagattaatgtaacagaacagagaattcagacatagactcacacaaatatccccaactgattttttcttttgcatttaaaaaaataagtcttactaagatataattcacatacaataaaatttacccttttaagttatataattcagtggtttttagtatatttgaatatatgtgcagcctttactactgtctaatgccagagcatttctcatttaaaaatgaagccccataccccctattcccttctcctgctagcccctaacagccactaatctactttctgtttctatggatttgtctattctgaccatttcatagaaattgaatcatagaatacagcctcttgtgactgactggctactttcacttagaataacattttcaaggttcatccatgttgtagcatgtatcagtgcttcattcctctttaatgccagattatatttcattgtatgaatgtgccacattttgttcatccatttattggttgatagacatttgggttattttcattcttcagtcattataaaaatgctgctgtgaacatttgtatacaagtttttgagtggagatacgttttcatttctcttgggtatatacctaggagtggatttgctgggtcatgtggtagctctatgtttaacaatttgagtagcaaccatactgctttccaaagtggctataccattttacacacacacgagcagtgtatgaggggaccaatttatgtatatcctcacaaacagttgttattatctgtcttttcttataatagtcatcctattgggtatgaggtggtatctcattgtggttttgatttgaattttcctaatgattaatgatgttgagaatattttcaggagcttgttgtccatttatgtatcttcttcgaagaaatgtctattcaaacgattttcccatttttacattggtttgtcttttcattgctgagctgtaattattttttttataaattacccagtctcagatatttattcatagcaatgcgagaacagcctaatacagcaagtgtcactcagatctactttctgtacaagagttctgggagaggctccttcgggacgctgatgggactctcttcctggggatgacttgtaaaaggagggttggtaggatgaactacagcccccctgcagctgcagctggtcttgcggctatagctgatattcattcccctgctcctctgctgtgcattctagattctgcttaccattgatgactccctgtgaaggtttaggtgagtttcctagtggtgtgactcagtctctccaaacggaggcattctagttcctgtttgccataccttctcaggctgtagctgctgaacttgtccatttgccattgaaattgtgcaaggtggtactaacaggtgtccaagttgatgatctgggtatcaaacatatgcctcctgcctccattgtgtaacaatagctggactgcctcttgatgataagagtcaatcatgccaaccaggatcctttccttgcctgctggtccttggcatgaagggcccaaagtgcctggatgatgacgtagcttaaagttcagtgaagactcttgctgtattccctggtggaaatgtttcccctttgggaaccaagacctttgaccctgtgggctacatttgtgaggatgaaaacacaaattctttaagtgggtcactgggaatgatagcaagtggggacactgctgctcccacaccatggattcctctcccaggtattctcttggggatacagcattatataatggtgattgacttcaggcattactgcatcctggagggtagtgcttttttttaattttttaaaattttaagttctggtatacatgcacagaatgtgcaggtttgttacataggtaaacatgtgccatggtggtttgctgcacccatcaacccgtcatctaggtttgaagccccacatgcattaggtatttgtcctaatgctctccctccccttgcccccgaccccaacaggccctggtatgtgatgttcccctctctgtgtccatgtgttctcattgttcaactcccacttatgagtgagaacatgtgatatttggttttctgttcctgtgttagtttgctgagaatgatggcttccagtttcatccatgtccccgcaaaggacatgatctcattcttttatatggctgcatagtattccatggtgtatatgtgccacattttctttatccagtccatcattgatgggcatttgtgttggttccaagtctttgctattgtaaatactgcttcagtaaacatacatgtgcatgtgtctttagagtagaatgatttataatcctttgggtatgtacccagtaatgggattgctgggtcaaatggtatttctggttctagatccttgagaaatcaccacactgtcttccacagggttgaactaatttacactcccaccaacagtgtaaaagcattccaaggacagtgctttatcctcacagggtatcacttccaagctggcactttagccaagctttcaataggctgttccattgcttatgagaccagtagcttgggtggtgtgccatatgatgggttcagtggattccatggtcatgtgaccactgctgtgtgtcctttgctgtaaagtaggtcccttagtctgctgcagtgatatgtggaatgccacattgatggattaaatatagcataagcccttggatggtcatgttggatgagactctgcaggcaggaaaggcaaacccatacacagaatacctgcctattcctgtggaaattaatggctgcccctttcattatggaaagagttcaatacggtcaacttgccaccaagtggctggttggtatcttcaagggatattgttgtactgagtttcagcaatggtttctgttggtgtcagggtgattatctggctgtgacagcagcttgggcccatggatagcctccttctttgcttccatgtctcctctgcttatgaatccattgtgccaggactagggtggctgatgaaaaagctggctgacatcaacgggctgagtcattccatttagttattaaatacctcttcaatggtagatgctcttgggacctgtggaggaaaaggatggaagcaaaattggcagaaagagaaagtgggctgcagtgtagtcacaaccagtcctcagccaaccctgtggggagttctaaaggtgggatgatgcttcagagatgttccctgaggaggtgagagggtcaggtcttttttttttttttttttttttttttttttttttgagatggagtcttgctctgtggcccaggttggagtgcagtggtgcaatcttggctcactgcaacctctgcctcctgcgttcaagcaattctgcgcctcagcctcccaagcagctgggattacaggtgcgagccaccatacccagctaagttttcatatttttagtagagatggggtttcaccatgttggcaaagctggtcttgaactcttggcctcaactgatccccagctttggcctcccaaagtgctgggattccaggcatgagccaccatggatcaggtcttaacagtcccacattgactagtcatttgttgcaggctgtccctagaaggtggcaggaccttgaataaggcaggtttctttagcaagacagtcactgaagaaggctgtcagcataaaagcttcccaaaagctagcggaataaatcctttagtcagttttttcccctatttatttatttatgatacttatagttctagggtacatgtgcacaacgtacaggtgtgatacataggtatacatgtgtcatgttggtttgctgcactcatcaactcatcatttacattaggtatttctcctaatgctatccctcccccagtcccccaccctccgacaggccctgatgtgtgatgttccctgccctgtgtccaagtgatctcattgttcaattcccacctatgagtgagaacatgcagtgtgtggttttctgtccttgtgatagtttgctgagaatgatggtttccagcttcatccatgtccctgcaaaggacatgaactcatccttttttatggctgcatagtattccatggtgtatatgtgccacattttctttatccagtctatcattgatggacatttgggttggttccaagtctttgctattgtgaatagtgccacaataaacatacctgtgcatgtgtctttatagcagcatgatttataatcctttgggtatatacccagtagtgggattgctgaatcaaattgtattcctcattctagatccttgaggaattgccacactgtcttccacaattgttgaaccaatttacactcccaccaacagtgtaaaagtgttcctatttctccacatcctctccagcatctactgtttcctgactttttaatgattgccattctaactggcatgagatggtatcttattgtggttttgatttgcatttctctgatgaccagtgatggtgagcattttctcatgtgtctgttggctgcatagatgtcttgttttaagaagtctgtttatatcttttgcccatttttgatggggttgcttttttcttgtaaatttgcttgagttctttgtagattctggatattagccctttgtcagatgggcagattgcacaaattttctcccattctgtaggatgcctgttctctctgatggtagtttcctttgctgtgcagaagctctttagtttaattagatcccatttgtctattttgacttttgttggcattgcttttggtgttttagtcatgaagtccttgcccatgcctatgtcctgaatggtattgcctaggttttcttctaggatttttgtggctttaggtataacgtttaagtctttaatccatcttgaattaatgtttgtataaggtgtaagtaagggatccagtttcagctttctacatatggctagccagttttcccagtaccatttattaaatagggaatcctttccccattgcttgtttttgtcaggtttgtcaaagatcagatggttgtagatgtgtggtgttatttctgaggcctctgttctgttccattggtctatatatctgttttggtaccagtaccatgctgttttggttacagtggccttgtagtatagtttgaagtcaggtagtgtgatgcctccagctttgttctttttgcttaggattgttttggcaatgtgggctcttttttagttccatgtgaactttaaagtagttttttccaattctgtgaagaaagtcattggtagcttgacggggatggcattgaatctataaattactttgggcagtatggccattttcacgataatgattcttcctatctatgagcatggaatattcttccatttgtttgtaccctattttatttcattgagcaatggtttgtagttctccttgaagaggtccttcacatcccttgtaagttgaattcctaggtattttattctctttgcagcaattgtgaatgggagttcactcatgatttggctctctgtttgtctgttattggtgtataagaatgcttgtgatttttgcacattgattttgtatcctgagactttgttgaagttgcgtatcagcttaaggagattttgggctgaggtgacggggttttctaaatatacagtcatgtcatctgcaaacagggacaatttgacttcctcatttcctaattgaatatcctttatttctttctcttgcctgatttccccggccagaacttccaacactatgttgaatacgagtggtgagagagggcatccttgacttgtgcaggttttcaaagggaatgcttccagtttttgcccattcagtatgatattggctgtgggtttgtcataaatagctcttattattttgagatacattccatcaatacctagtttattgagagtttttagcatgaaagggtgttgaattttgttgaaggccttttctgcatctattgagataatcatgtggtttttgttgttggttctgtttatgtgatgcattgtgtttattgatttgtgtatgttgaaccagccttgcatcccagggataaagccaacttgatcatggtggataagctttttgatgtgctgctggattcggtttgccagtatttcattgaggattttcgcattgatgttcatcagggatattggtctgaaattctctttttttgttgtatctctgcccggctttggtatcaatatgatgttggcctcataaaatgagttagggaggattccgtctttatctattgattggattaatttcagaaggaatggtaccagctcctctttgtacctctggtagaattcggctgtaaatccatctggtactggactttttttgattggtaggctattaattatggcctcaaattcagagcctgttattgacctattcagagattcaacttcttcctggtttagtcttgggagggtgtatgtgtcgaggaatttatccatttcttccagattttctaggttatttgtgtagaggtgtttatagtattccctgatggtagtttgaatttctgtgggaccagtggtgatatcccctttatcgttttttattgcatcgatttgattcttctctcttttcttctttattagtcttgctagtggtctatcaattttgttgatcttttcaaaaaaccagcttctggattcattgggtttttgaagggttttttttttttttgtctctatcactttcagttgtgctctgatcttagttatttcttgccttctgctagcttttgaatttgtttgctcttgcttctctagttcttttaattgtgatgttagggtgtccattttagatctttcctgctttctcttgtgggcatttagcgctataaatttccctctacacactgctttaaatgtgtcccagagattctggtacattgtgtctttgttctcattgatttcaaagaacatctttatttctgccttcattttgttatttacccagtagtcattcaggagcaagttgttcagtttccatgtagttgtgcagttttgagtgattttcttaaccctgagttctaatttgattgcactgtggtctgagagacagtttgttgtgatttctgttcttttacatttgctgaggagtgctttacttccaattatgtggtcaattttagaataagtgtgatgtggtgctgagaagaatgcatattctgttgatttggggtggaaagttctgtagatgtctattaggtctccttgtttcagagctgagttcaggtcccggacctggaactttctgtctcgttgatctaatattgacagtggggtgtaaagtctcccattattattgtgtgggagtctaagcctctttgtaggtctctaaggacttgctttatgaatctgggtgctcctgtattgggcgcatatatatttaggatagctagctcttcttgttgaattgatccctttaacattatgtaatggccttctttgtctctttagatctttgttgggttaaagtctcttttatcagagactaggattgcaacccctgctttttttttgctttccatttgcttggtagatgttcctccatccctttattttgagcctatgtgcatctctgcatgtgagatgggtctcctgaatacagcacactcatgggtcttgactctttatccaatttgccagtctgtgtcttctaattggggcatttagcccatttacatttaaggttaatattttatgtgtgaatttgatcctgtcattatgatgttcactggttattttgcccgttaattgatgcagtttcttcatagcatcgatggtctttacaatttggcatatttttgcagtggctagtaccggttgtttctatccatgtttagtgcttcattcagtagctcttgtaaggcaggcctggtggtgacaaaatctctcagcatttgcttgtctgtaaaggattttatttctgcttcacttatgaagcttagtttgggtggatatgaaattctgggttgaaaattcttttctttcagaatgttgaatattggcccccactttcttctggctcgtagggtttctgccgagaggtccgttgttagtctgatgggcttccctttgtgggtaactcgaccttcctctgtggctgcccttaacactttttccttcattttgactttggtgaatctgaaaattatgtgtcttggggttgctcttctcaaggagtatctttgtgatgttctctgtatttcctgaatttgaatgttggcctgccttgctaagttggggaagttctcctggataatatcctgaagagtgttttccaacttggttccattctccccatcactttcaggtacaccaatcaaacatagatttggtcttttcccatagtcccatatttcttggaggctttgttcatttctttttactcttttttctctaaccttgtcttctcactttatttccttactttgatcttcaatcactgataccctttcttccacttgatcaaattggctattgaagcttgtgcatgtgtcacgaagttcttgtgtcatggttttcagctccatcaggtcatttaaggtcttctctacactgtttattctagttagccattcgtctaatcttttttcaaggtttttagcttccttatgatgggttcgaacatcctcctttagctcagagtagtttgttattaccgaccttctgaagcctacttctgtgaactcgtgaaagtgattctccgtccagctttcttccattgttggtgaggagatgtgattctttggaggagaagaggcgctctgatttttagaatcttcagcttttctgctctggtttctccccatctttgtggttttatctacctttggtctttgaagttggtgacctacagatggggttttggtatagatgacctttttgttgatgttgatgctattcccatctgtttgttagttttccttctaacagtcaggtccctcagctacaggtctgttggagtttgctgtagttccactccagaccctgtttacctgcgtgtccccagtggaggctgcaaaacagcaaatactgcagaacagcaaatattactgcctaatccttcctctggaagcttcatcccagagggacagctgcctatatgaggtgtctctcaggctacacgagggtcagggtcccacttgaggaggcagtctgtccgttctgagagctcaaacgccatgctgggagaaccactgctctcttcagagctgtcagacagggacgtttaagtctgcagagttgtctgctgccttttgttcggttatgccctgcccacagaggtggagtctagaggcagtgggcctcattgagctacagtgggctccccccagttcgagcttcctggctgctttgtttagctactcaagcctcaatggtggacccccctcccccagccaggctgccgccttgcagatcaatctcagactgctgcactagcagcaagcaaggttccgtgggcgtgggacctgccaagccaggcacgggagagaaccttcttctctgccagttgctaagaccttgggaaaagtgcagtatttgggtgggagtgtcctgtttttccaaatagtctttcatggcttcccttggctaggaaagggaaatcccccaaccccttgtgcttcctgggtgaggtgacaccctgctctgcttcagctcgccctctgtgggctgcacccactgtccaaccagtcccaatgagatgaaccagttacctcagttggaaatgctgaaatcatctgtcttctgtgtcgatcacgctgggagctgcagaccagagctattcctagttggccatcttgtaatgcccccactcccccataattattctttatatattgtgatacaagtcccttatcagatatatgatattaaattattttctcacgttctatgagttatcttttcattttctttatgctgtcctttgatgtaaaaatgtttttaattttgattaagtcaaatttacctattttcttttgtcacttggtttctggtgtcatatctaagaaatcgttgttttatccaaggtcacaaagatttactcctatgctttcctattagagttttatagtttttatctgttaagtataggtctatgatccattttgagttttgtacgtggtataaagtaggtgtttaactctactcttttgaatgtggatgtctagtagtccagcatgccccactgatgttcggcaaaggggaaaagcagttcaatggagaaatgagagttgtccaacaaattgggtcagagcaattgttcactcatattttcaaaaagaacctcaacataaacctcttcccttatagaaaaattaactcaaaatggatcatagaactaaaggcatatcttacaactataaaagttgtggaggaaaacataggagaacatcttcatgaccttgggctagctgaagagttcctggacatgacagaaaaagcacaatctatgaaaaaatggatagttttataaacatgataattttgactttctcaaaagtaaaagtttgctccagtaaagacatcattaagagaatgaaaagacaagatacagactggaagaaaatatttgcaagccatatatctaacaaagggattgtatctagaatatatatgtatattctatattatattacatatatataataaaaatgggcaaaggatctgaaaaacacttcatcacagaagatatatagatggtaaataagcatgtgaaaagatgctcaacatcattagccatttgggaaacgcaaattataaccataatgagatcccactacatacctgttagaatgactaaactttaaaaacctgacaagcactaaagaagatatagagcaattagtgaaaatggaaaacagtatagccactctggaaacagtttggcattttattataaacacacccttaacacacaatccagcaataccactcttagatatgtaagttagaaaaattaaacgtatatttagacaaaaacctgtacatgaatggtcatagcagctttactcataattgctaaaaactggaaataacccaaatgttcttcagtgggtaaacaaagaaaccatcgtgcatccatataatagaaaactactcagcaatgtgattgaatgggctattgatacatacgaaaacacagatgaatctcaaaggtgttatgctgagtaaaatgagccaatcttaaaaggttacctactgtatgattccatttatatgacattttggaaaaggtaaactatagggacagaaaacagaggagcagttgtcagaggttagaggttgggagagtttgactacaaagaggtaacaatagggaactttggagggtgatagaactgttgtgtatcctgattgtagtaacagttacatcagtcaatgcagctcttaaaactcctagaaatgtacactgatgtgtgtgtgtgtgtgtgtgtgtgtgtgtgtgtgttgattataatgattgttacatgggtatatatacctgtcaaaactcatcaaacactttaaatggttgaattttattctgtgtaaattgtgcctcaataaagttgaattttttaaaataaaaaagccttccaccacaatccgacaccttaaaaataactactattgacagtttagtgtgtacttgtctagaacatgtaagcatgtaatataaaagattttccagttgtataaatgggatcactgtacataatatatgttgtgctctatattgctttattcacttagagggcttggacagatgcatatatatacatatctataatgtttatggatctaccatatattagtagttatattttataccattttgtagatgtaacaccatttatttaaccagttctactgttgaatatttaggttgctgccagtcgttttgctactattatctgtgctacagtgaacagccatgtacatacatgtttttgtaagtatattgataagatatatttctaagagtagggttactgggtgacagggtatgtataatttgaatttatatagctcttgacatattgccctctatagaagcaactagaaagtttagaataagaagtgagtacatcgtgcagtttcccatcccaaatccttgaacttcattatctttcataggatcatgctgatatcgagtggaagtttgcaaggacgaagctctggatgagttactttgatgaaggtggcaccttgccacctcctttcaacatcatccccagccccaagtcatttctataccttggtaactggttcaacaacaccttctgccccaaaagagaccctgacggtagacggagaaggcgcaacttgagaagtttcacagtaagacttttaattttgaaaacttaatttttaaaaattgagatggagtctcactctgtcacccaggctggagtgcagtggcacggtctcgggtcactgccaacctctgctgcctgggttcaagcaattctcatgcctcagcctccccagtagctgggattacaggcgtctgccaccacacctggctaattttttgtatttattactttttgagatggcgtctcgctctgtcatccaggctggagtgcagtggcaccatgtcagctcactgccacctctgcctcccaggttcaagtgattctcctgcctcagcctcccaagtagctgggattacagacgagcaccaccatgctgggcacatttttgtatttttagtagagacagggtttcactatgttggccaggctggtcttgaactcctgacctcgtgatcctcctgccttggcctcccaaagtgctgggattgcaggcatgagccaccgcacctggccaatattatgaatctttttaaacaaaactgtttcctcccgtccctcctttgtgaccaactcactgttttaaacatcataaaatcattccaacatacatttgctttggggatttgtcaggcaggagctcctgtagcattctctagtcctaatatatagaaataattatattcagatgtttgggtgggtagggtgctgggagactgctgatgtaacatctctgtctattttcaattataggaacgcaatgctgacagcctgatacaaaatcaacattatcaggtaaagcttcctcacagggatgaagcacaatagttgttggctggttctgtggaggagaagcaaacttcactctggctgtgtctggacacgatcccatttgactgggataggaggcttggaaaggctgtaatttatcaagggctgaagtaccttctccaagtggaatcacctgctttataatcctgttcatggcccttatgcactgcctcggcttgatcagcaacaactatgacttagaaagctgtcttccttgaagttacataaaatagaatatatggttggtcagtcagtcaaatatgagagtacctactgtacataaaatactacactagatactagaaaaatcactatgaacaaaaaagatgcaatctttctgcccttatgaaatatattatctagcagggataaaataacacgtcattaaaattacagttgactcttgaacaacagaggattgaactgtgtagatcgacttataggcagattttttcaaccaaacgcaaatagaaaatatagtattcatggaatgtaaaaccacatatacaagagggctgactttttgtatctgcaggttctgcagggtgactgcaggacttgagtatgcatggattttggtacatggggcggggggtcctgggaccaatccccagagtataccaagggatgattgtattaaaattaagtgattacaaggataaaaactgccatgaagaaaaaatacacagggtaatggtaatatatataacaggaggaaactaacctcaatgaagtaaaagcttatctgaatgtcaggaatttagatcttgataaattacaacatgactttaatcaaagaaatagagaagcacttctgtattttgttaaaaaaaaaaaagtaataaacctaataaacattaggacactcttcccaccagctagaaaacagccaagcatacaaatatcaccaacacctcttgagaataatccttgcaaatcacaaataagagacaaccatctctcaccatcctgatcaaaagaaaaccaaagtagaaaaatgttctacagcgtttgaaggaaatgcatccttattctataggtcacttctcctaactttgttccccttagaccataactaacaaagagaagcagaaaatatggtattttgtatgtaaacctcctctccctactcccgccttcaaatgttattacttttataataataaatcttaaataagattcattgtcttcattttctgcttcatagccctcaacaataacaaaaaaaaatgattcctgcatgtctcagtgagttcctcaagtacacatagtagcagaagcaataccattggccttgaaatcagactgaagtagaatcaaagtctaatgctgacacttactagttgtgtaacattggatgagtcagcctcattgagccttgacttcctcatctgtaacatgggaagagtaataaaacttaacttacagagttgtgaaaattgagtgataagtatgtatcatatgtattatgtgcatgtgttgcctgacacattgcagtaagtggtagctatcatcatcaccatcactaatacaaactgtagtgaccatgtgtagaccattcccctgggggcttagtgaaaagaggacattcctataaaggagaagtgtaggttgactatgagaaaaatatcttcactatgtaattagtagacattaaaatcagcagacttagtgactctgaagaaaactctcaattttataaaaggagaataaaactctcgttttactatgagtgttaacgtgtaatccatcctaaaggaaaaggatattaactatatgaccatgcaagaattattccactggaaatacatgtttaccttatgcttgggtaaaaaattttcctttagggttaatttgattctgccactaaattcagagacacaatagttgtttagccaatggacttaactcatttttacaataaaaggctggatcctatgaggattttctactgcaaagaaggtctaagcatgttttatttcctatgtaagtttcttactgtactgagagcctgagaaggagactgaatgcttcttcatgttttgtaattccaggaagttatcaggaatttagtcaaaagatatgtggctgctatgataagaaattccaaaacacatgagggacttacagaagaaaattttaaggtaatttaatcatgaagtggtttttcattttacatatcataagcatcatttaatcttcacagtgtgtgaggtttctggtgatggaatttcatctgcttacaatatagcaaagccagttataatgcttattctcttagaattgtctctcatccagtagacggagagattttaccaatgtatgtcacaccacaatcagtgtcaggaatgaaggaaatctgctgtatgcattcttttaatattctgagtgtttctcagtgtggaaattgaatgctttaaatgatgtggcaaggatgcatggtggtgagggacaagataacaaagggaagatgcctgcagacttaattatcttctttacttaaaagatataagatcaaaaaatctgttattaaatctaaggtcttaagaaactctaccattaaacattaaaattatactagtggcattagcctaaaacaaccgttttcaaccaggggcaattttgtccccaagaccacatttggcaatgtctggagatatttttggttgtcacactggtatctagacagtaaagacaaggttgctactaagcatcctacaatgaatagtacagtctcccacaacaagaattatccagtccaacatgtcaatagtgccaagattgagaaatcctatcctagaacacatctatatatatattttttaatttttttattatactttaagttctgggatacatgtgcagaacatgcaagtttgttacataggtatacatgtgccgtggtggtttgctgcacccatcaacccatcatctacattaggtatttctcctaatgctatccctcccctaacccccaccacctgacaggcccctgtgtgtgatgttcccctcccagtgtccatgaacacatctatattttctaaggcacacagaaagtccattatcctaattcatagacataattcatctactgagggtctgctatgttccaagcactctgctaagtgctctggtacagtggtgagcaagatctaaccagctcctactctcaaggagtgacaaacaataataaagggtgatgaacaattttatattctgacaggttaaacacaggacactgtggaaacacagagaggagggacgctcatctgggacttggggagtcaagacagactttccaatggaagtgatgcttaagctgaggcttgaaagcaaagccagccagataagggcgagttggggagaagaatgttctagacagagagaacagcataggcaaaggcccagaggcaagggagaatatgtccatacaggtggacagcagagagcctaggaaaagagtagaaagatgaaactggagaaagcaacatgtactaggccttgaaaaaccttgtagtccatggtatggcatttctactttttcctaaagtcagtgacaagttagtaacaagttttgagaaggggaagtacatgaacagatttcagcttggcttttaaaggaacaatctagtatgtaagcagccagttggagatagaagacatttcatagaggtttgaacagggccccctgtctcaaaacagcagtctcatcacctgacattcaacttttctagtttcactcgttagagtcttaaaagctttttcctcttcagtagtccttttatatgcagacacctgagagccagtgtcctaatctaataacttgttagttaatacttagcaggagttagtccttatgaaagcacctcaacagactaatccctgctaaagtgttagctaatcctgaatcaactttacccattgtacaattttgccaatggccagcccagccctgcccatggaattattaatatgtttttcttgtgtttgaataatggcagatttttctggtgttttgtgatttgctactaggcaaaaacctggaacataccaaaggtatctaatgtgcctactttgaaataaagaccaagcttcttgacataatatgtctcctctcttttcccaggaattaaagcaagacatctccagctttcggtatgaagtgcttgacctcttgggaaatagaaaacatccaaggagcttttccactagcagcactgaactgtctcagagagacgataataatgatggcagtggtggggctcgggccaaatccaagagtgtctcttttaatttaggctgcaagaaaaagacttgccatgggccacctctcatcagaaccatgccaaggtccagtggtgcccaaggaaagtcaaaagctgagtcatcaagcaaacgctccttcatgggtccttctctcaagaaactgggtctcctattctccaaatttaatggtcatatgtctgaacccagttcagagccaatgtacacaatttctgatggaattgttcagcagcactgtatgtggcaggacatcagatattctcagatggagaaagggaaagcagaggcctgttctcaaagtgaaattaacctcagtgaggtagaattaggtgaagtccagggcgctgctcagagcagtgaatgccctctagcctgttccagctctcttcactgtgcatccagcatctgctcctcaaattctaaacttttagactcctcagaggatgtatttgaaacttggggagaggcttgtgacttgctcatgcacaaatggggtgatggacaggaagaacaagttacaactcgcctctaagtcaagccctaatcatctgttctggaactcaacagaaatctgtaatttccttgctctcagaggtgacacagaatatgattccctcactgcccctgccccccagaaaggagagtgaaactcttatttgcaccatcttttatagccacattctccatttttgttcttgttttattattactttcattattatttgcctttttaatacctatacacactaagtccatcttacaaccgactgaaggggtgttgcacctaatcatcagaggtgcagttgggtgcttaacctttttgctttgcttttctcacccatgcttccttgaagccccaggtgccactttgctggtcttgttgccgcacagattcctgaccatcctcagaatctcatgccattttcccgcagagctgagggatgtggtcagcagtccccaccagctatcagataaggcaaactaccctgcccatctttgttgccattcagtgctacgcgctgcccatgctgggtcaatgaacagcatcaaagggaggctgaagagatttcaaagaattgtcagcttgtggtttctgggtataagtggcttgtttcgttcttaaatactacaacttcttattgtgggggctattgagttttcttgtttcttaaagatgtgttagtttcctaatgtgtgccaatgaaatatttaccccatagtatatgtcatatctaataagttaggcgaattatttttctgtttgtgtgtttcagttaacttactacatttgaaaatttgatagtatcaaaattagtatttagaatttgtgctattttttaaaaacatctactacactctaaccaatagtcactacatctcatacattggcaagataaatagttgtcatatttgttgggtcctattctactgttgatagttttaattatcattgctatcaaataatttctaagataaaagcctgaatttgaaatatttttatcagaaaaatggcatattgctgaagtgtcaaaatatgagaaaagagcatcttcattttaattaactgctttataaaaatggcaactttaggtatagataacctaattcaggttgcagttttaatattcattgggggcagtggaattgcatgtgtaaattatgttagatatatatcataacaaccctagtggattcatggaattataaacgtgatccaaattctactgtcttccaagaaagctacatttatacatccaaacaaattcttttccacagcttaagagtacctcatcagaatacagtggttcaagttaaaaaataaagtccataatgcatatggtcatcattctagacctgataaccactgagaacctgctgagcaaggacggcttttaccaacattagcacaaaggtttcctcagtttagactctaacatatgacctgaaacaactctaggtctgagtcctagagattacataaatagtgtgtagcccagaaaagtaaaataggtgtcacgctgttttttttaatgtcaacaccaataggaatccatttagattaatgtatgtaatttctgataaaagtaagagaaatgaggaactttcgaactgcaaatatgcctccaaactagcttttgataagtgtggtttctgttatttgaatggattcccatctttgtctctagcctggagaagagcaaaatggagggggaggggccagaaataggaggaggttttgaagaataaagcctcatatccaggaaaaagtgatcaagtgaaaaagctgcatcaagacccatttggcaagaggttgtccgaaaataattccttgatcatatctgaagtggttatttactcaaatcaatttctcccctgcttcgctaagactgtcataaaatggccttgacatttaatcacaggttactttccagaaaggtttctaaagttacagattcagcttttcaaattgtcaaattcactttgaataataatagaacctgggctacattcctaactcatattaacagc

SEQ ID NO: 4927 - DNA, 308461 bp, human; identical to SEQ ID NO: 4926

SEQ ID NO: 4928 - DNA, 49406 bp, human
tgcctgtatgtctgaggctgggtttgaagcctccagcgtgtttggagttaatccccattaggttggactccgcccctttctcccaaaggtaaagcaaggttttcaggcatcactgcaaagggcagctagtattcccatccttgtctaacaagctgtaaggagaagttgtttctgagatctgagcctgaagagagggaacaagtcagtcagccttcgtggtcagaaggtaaatatgcaacttgggccaaatgcaattcaaacagctggataagaaactgctttgctctccccttgctcagcccccccttctccccttcctttctcaggtttcctgtcctttcatctcaaagctcagagaagccgttttctacccgagggcagcctggtgcttttttatttcttcatagtccgttgtttgcacagaggctaagatgaatcagggctggattcctatttcatattgacaagatttgaggacctaagggttaagtgctagttggtttccccaggggagttggtaacctgaggagatgaagtgcctgtttctgggagtggagagagtgattttgttatgacctgtctatacaagtaaaaatggatccggtttgctaatgtggtaggttgatctcctggatttgcctaaatctaaggggttatgcgacggaaatggggtaatgaagttaaactgaaatgcaaatattgaggcctctcaggctggaaataaaagaatgcatccatttggtaaatatttatgagttcctactatgtgccaaggcatgacaatttccagaagaacctgaaatacttaaactataaatccattcttgcaaagaacacttggccaagtggtttcattttgtggtggggaactgaaaatagaatgaagcctaggggtgaggaaaaatcacccatggagtggttgtggggagagaaaggggaaaggagagatgttctaaatcttaggtggtttcaagtcttttccattacttatgagagaatagggtcttttctggtagaaagggagagaattgatacctactctggtgttaggtatagtgcagatgtttcacttgaattttatgcttaatcatttccattttataaatgaaaccaaaactcagaggttttaagtgatctttttatgtgcatatagcctgtaaggggcagacctcaggactctgtctctgatctgattccaaaattgtgacttttccactaaaacagtattcctcaatcattagttcccattagaataaattgaggatttttaacaatatgaattcccataaattcgaattcagtgaatcaaggagggggtgacatagtctgcattttgaacaagcattgaaagtgattctgaacaagcattgaaagtgattctgttgagacaaacattcttgatataccatgctgcctctcaacttctctgaagtgattggaaaagcaatcagcccatcttcttcccatatgggccagattcactcaatagaagtggtcagctgtggtgacattttattcccagcttatacaatggagtggagagactaatgggcaacaataacagggctggggtttagggcttaacaatgtcttgccagggatcttgataggggtagtttctaaccagctgagagtgtgagatagaactcgtagccaaccagcttatcactgaagatgatggcacctgtctagccagaataagaactgagatgaagatctctcattggtacctcacttttaaaatcataggatagatggggagctcaaggagcagcatcttggggagagggaaggagagagaagctcatatgaaatttggggaggttattccagttcctacctttccagtctcaaactctggagaaaggaaatagcccagggcctgatgtggaggttctttttatgagctctctttgtctctgcatggtcaaatatatttatttagagttgatcatttcaaagttatcaattgctcagttagtcctttctctccacttagtctctggcttcctgccttttaatgccttacctgcttgtgagcattcccacctctggatggagagatgcaaataaacacataaactcacccaacacagttttgctggtctttctaccccaaactaaaaaaggagggaaggaagaagaaggcccagaaagaagttcagcaaacatgaaatctgaggaatttgaaataaaagacacaagtcaaaagagagatcttcttagagtcaccaagatgagtgagtacatcatgagatgatttcaggcacaggagaactcagagcacttctcataatggagatagccagaggagaagaaacccctgagggagacaggtagcagaacatgaggagagaaatgtttggggagtagcagtatttttttttttttttgaagctttgtctgaaacagaaagatctagcatggtcaggctgcttatatacccaacttgatataaggagtcacatcggtccaacacgtttctctggagcaggactctatttacccactggaaacatatgcctgcatatctcattcatttcctagggaagtctcaactctgagtaagatgtatttgtaacaggattggcaggaagacaatgcacactgtctgggggcgtgaggagaaaggcctgttcacgttcctttgccaacaccagtgccaagaaagctgctcttcacagaccagtcctaaaccagcagtcttgcaggcatgtttccctcagcagctgttaagtcactgactccctttcttaccacttcatgttctagtctttaatttgcttactgttttgcctgtaccctcttaccctgggaaaggcagtgctttccttaactcagaagttgcacaacaagctcaagtggaaacaaaaggatttgtgtctttttctgtgggtactggggaggaggtgatacaggaaggaatagctttgtttttctccaccaagagaaatataaaagcaacgtttcactttcattgatacttcattgtaagtgcccatacattagtaggtatacaagaaagtgaaaaaagtgagaacaaatgattaaaggcttggcaattggacaccacagggagagggagaatgctcattatggggaaaaaggctaaaggtctcctgctagcaatctgagttgatgaagggctctcatttggaagatggtggctagctgttctccattacctctgaggacccaacaaaaggatctggccttaggttgcaacaagaaaagtttataaaggcatataacaaattatttattgacggtgagagttgttaagctactaagagatattatagatttccctttcctagagttctttaaaagtaatggagataaccatttgccatgtatggtttaggtgggtttcctgcatcatataggttgaggtgacttctacccacgaggctgtgctagaatggctagcattatctctaaagatgagcaaacattaggctttagtaaggatagcaaattcagaacagaactcatatttttatcctatttattacaactttctggcaacatccactgcatctcatacaaccaatctcggaaacaggcttgcggcccatctagcagatttaaaaacctgaggaatgagggataatgtgacacctaaagagagaggttcaactgcaatcctatcaatgcctggtaacttgaccactctacaagagcatcagggtgagttcttggttcctgaaatccagtgtggctgtttggctggatattccaggacagggaaacaaagctgttacatacatgaagtatacaacaggaattaagatagaataaaatatagcattgtttgtgatttctagttatgtaaatataaagcgacttaaccggtttctgggaatgaacttggattgctttggagggttgtcatgaaggagattactccattgcaggtggcataactaaaagcattttctagaatacacttcactgtccaccacatgtgaacataaagcagtgtgtgaacagactccatgtgccctgcagcctctctatccagccacaagggaagttgggctgagactcatattgtgttcagaagctattaagtaattggatctctgagatctctttcttgattgcgttcaagtcaagtcgatgatttagaaaggtttgcatttaaagtgtataagcttcatatcttcaatgtttaattccatagtcacttttaactttatattgtttgagtcctgaaaagagaatattagagaattatctgtggcagtgattcttaacctgctgtccacggattgtgctagcccacaacatctctagtcctaaatagggtgaccatttcatccaaggttttttgggactttcctggttttatcactaaaaattccacatcccaggaaacccctgagtcccaggaaaactgacatagttggtcaccctagtcataaatgaaataaggactatgcgtttttcctaaagttgaaagtacttcatctaaattctgaaggacaatgagtttttctaaagctaaacacatttaatttaaattgaattttgagaatttgtcttcctatgtcttggcttcaaaacgtcgcttttaaactgaaatcatggtgacagtagttgatagtattgtagtttaatttaacagcttcatttgtcacaggtgaggacaaccatatattacaacccctcccctcatttctactgtagtcacggcactacacagagatagtccgttcctctgccttaagttctctgcccctcctactggttgttatattgggactttttaaaaaattttatttttccataagttattgggggtacaggtgatatttggttacatgagtaagttctttagtggtgatttgtgagattttggcgcacccatcacccgagtagtatacactgcaccgtatttgtaatcttttatccctcgccttccccccaagtccccaaagtccccaaagtctattgtgtcattcttatgcctttgcatcctcatagcttagctcccacatatccgtgagaaatatgatgttcagttttccattcctgagttacatcacttagaataatagtctccaatctcatccaggtcgctgcaataatgacttctttttctctaggcagatacccagtagtgggattgctggatcaaatggtagttctacttttagttctttagggaatctccacactgttttctatagtggctgtgctagtgtacattcccaccaccagtgtagaagtgttccctgttcactgcatccatgccaacatttactgttttttgattttttgattatggccattcttgcaggagaaaggtggcattgcattgtggttttgatttgcatttccctgatcattagtgatgttgagcattttttcatatatctgttggccatttgtatatcttttttaataattgtctattcatgtctttagcctactttctgatgggattttttttttcttactgatttgtttgagttcgttgtagattctggatattagtactttgtcagatgtatagattgtgaagattttctctctctgtgggttgtctgcttactctgctgactgttccttttgctgtgcaaaagctctttagttcaattaggtccccgctatttatctttgtttttattgcatttgcttttgggttcttggtcatgaaatccttgcctaagccaatgtctagaagggttttttcaatgttatcttctagaatctttatggtttcatgtcttgggtttaagtccttattccatcctcagttgatttttgtataaggtgagagataaggatccagtttcattctcctacatgtggctagccaattatcccagcactagttgttgaaaaggatgtcctttccccactttatgtttttgtttgctttgttgaagatcagttggctgtatttgggtttttctgggttctctattctgttccattggtctatgcgcctatttttataccagtgccacgctgttttggtgactatggccttatagtatagtttgaaatcaggtagtatgatgcttccagatttgttctttttgcttcatactgggacttttcatctccaggtgatgatgtccatgagggacattcggagttagttttgactacaagtgctgagattgaaagaaattatatacttgccctgatggtgtttgcactatgtctggagaaattgggtttccttctgtcttcaatattttttgaaaatctctatgggaaatcatggaggcttttaattgtaatacttttggggtaatactgtaggggaaggcttcaggtaaaagaaaagtgagaaattatggctttgccgttgaatcactgtgtacccttgggtaggtcgcttgtctttctgaagcccaatttgctcatttgtaaatttaggataatatctttcttactaacctaagaagaccgttgggcagagcacatataataatggatttggaagggattgtgatgacacagctaataactgtttgtcagcttgtttcctctcctcctctggcctgggctgcttcatcaggaaatgagtctgtaatggagggctgcttgcactttttgtaatcttacaaactctaatacaacaagcagaggcattacctcattgcggccaaccatacctgctgtctaacagcaattactcaaaactagttccacttctccccctgttgcctttcaatccctcatcacatctttctctcatttctcccattctcagccacaaagcctaattcccaggggcccagctcagggcactttcttcccaagccctaacattccagagtaagcacctgcaatttacgatctctgctcccttcctgcacaaaacacgtagcacaaaatacatatgtatcaataggggaattgtggttgagtaaaaaaagagcattatattaagaatcaaataactgggctctgatctggccagtgtacctcactagcccttcacccttgagtaaatcacttcctctccatattcccacctgtaaagtcatggagagggggtagtttaacattgtgtggtagaaaagtactggcctaggcatctgcagatcaggtttcaggttctgatgttgctgcttgctaacttactctgtgacttgaagaaaatcacttcctcctttactgggcaaaattctcccatatgtaaaacaagaaggttggattaaatgattcattaagttccctacccatctggaaattgaatgattctatgaaatgggtttcactaaacaaacttgaaatggactgcctgctctgtgtcaggcactgtttgacaatggttgtgaaagggctcatgactgagaccctgagacacttagtgcctctgctgcttgttcctgtcagtgtctaaaattggcaatgtggcgatgaccccatacagccagttcctgcgcttcccctgctttgggtcccccaacctccttcccagtcctctacaccaccacatataactttaagtaatggtggtgaatcatggagaagtttttgaaacatattccaccatctgcctgctggagacattcacagtgctgtcatcaagctgcagtgtggtctctagccggcccaatagagaaacaggccagaaagcaatggcagattaatggagttgggaggaaagtggttgatttttgacagaggggtctgtgaaaaccatttgtgagctgagctgaagaactagatctggaaagactctcagcgtcttgattacaagattacttgttccaaaagggaccttgaaaggtccttacagctatatgttcctgctgcaaggtagggagtgcctgatcctgatctatttcagaactttgagaagctttttggattatatccagcaaaggacaaggaagcttttcttaatagccattccagagataacctctcctggttggaaagttgcctcccattttgattgtgggaaaagtgactgatcagtgctctctcagtgacaagtatagggtatgagactagacactccttattttattctatccatttaaacctggctgatgcatcccagttgaaaagcgcgcactaacacactgctggacatgttacccaagtcaaatgggaacaacctgtaactctgtggcgaggtctctttccctctcaccccttatagtaggggcgggtcttgataagttgtcttccttctccttcactcactgaaaacaactttgctcctgatcctcttcagatattgcctccttccaagctaccaggccaggaagtccattcagctggaagccgggacagcaaccttgttttcatttaggctcctttcctgccacttgttccacgatgtatgtcaagagttaaaagctgtctgatccggctgtatttgaattggcagagcagaccctaattcagttatctggttcctccattgcagcctaaagaccatagaactctaaatcaggcagaaggaagggaaggtgggaaaagtactgaaaagcaaaatcccacagggatccaaatggtcctcgagagaataatcttatccagaagcaatgaccaagtggcacataattgagccccaggactggccaaccagatgaaaaataggccagtggagcctacatggtaacttactgcatttggtgctgtgatccaactcatctccccatccctgcagagaaacctgtgaccatgaggagcagcctgaccatggtgggaaccctctgggccttcctgtcccttgttactgctgtgaccagttctaccagttacttcctaccttactggctctttggatcccagatggggaagccagtgtcattcagcacattccggaggtgcaactaccctgtgcggggagagggacacagtctgatcatggtggaagaatgtgggcgctatgccagcttcaatgccatcccaagcctggcctggcagatgtgcacagtggtgacaggtgccggctgtgctctgctgctcctggtggcactagctgctgtcctgggttgctgcatggaggagctcatctccagaatgatgggacgttgcatgggagcagcgcagtttgttggaggtaagactgtgcttctgggattgggtaggttgggtagctttggggcagggaggagtggggagtgtagccttatggggaaacccattctcacccccttcactttgtccaactctaaggctatgaatgaagtctcctttaaaatatttagtctaggacttcccaaagtgcaatcaatatcagagttttattcacagcaaatttggctagtaggcagaattgatatctgttgtttaccctctatttttgtcaccttcatctgcctgcaggttgcccatttaaaaacattatctattaatatgtctgccttccagagtcagcaacatacactgtagtattactgctccaacataaacttaatttctaggagccctgctctctggtagttatctcagagaacagtgatctaataaacacatacacacaggtgcaaattactaacagttctcatcaaagaaatacacctctaatagtgaaatgttgtgtaccacaaaaactgtagatgactacttatctggaccacatctaaggctagccctgtctggcagctattagcagtctacccagatttcttgtgaccttgacccaccttacttgtccttcccctcattcaggctccccctaactttagtgcagggaacctgagatattggcagtgtctggattggctagaaaagagcaaaatgcaaaaatggcagacttcaggaagacagtgacagctgtataatttgaactgtctgagaagaaaaaacaaatttagaaagacaggaaaacatatatgtgaatatttgagtattttgcaaaacctagattgggcactgggaaaaagtgctggtagaatctactgctgaagtttgttgttacagagttttagaattattacccaattcattatcattattatctccattagcatgacagtgtgggtcactagagccaggaaacttggatttcacttctgtttttttcaccaagttgctctgtgaccatagtgggaaaatgacatgacttttcctatgcttcacttcctttgaatttgtcccctggtgatatagcccagatctgatctttctttcttctgtccaatgactgcattcatgtggccttggagtgagatggcagtgatgagctaagacagtgggtctcaatggggactacttttgcatgcccctcccccctggaagacatttggtaatgtctgaaggcattttaaattgtcacaacttggggaaggtcctactgacatcaagtgggtgaaggtgagggatggtgatgaacgtctacaatgcacaagatgaggacaacactcacccacaacaacaaagaggtatccagccaaaatgtcaatagttctaagtttgagaaaccctgggctaggctaccaagctttcctggcttgattatgaaaagcatcagattctgtttgtgataccaattaaagtgatgctttctggtttcctcttttctcagactagctgtaaaagttttaaatctgaattaccattctagcctccgtcatttctaaaatttttcccaccgtttagccactgatgggtttttagccacattggaatgtacaattaagttagtttcttccctttgaaaactgtaatactaaaccagttgctaaggctgatctaagccaattatcttagctggctttggaagctccatgggtattacaaataggtcttaggcttacctttcacttttatttttaaacacgctataattaactcagcactgctatgaacacattatttcaggaagtgacacttggctgatagggcagaggggtcatccttgcaattcatatttatagccctggagcccagttccgtgcctggctggcacaaagcagatgttcagtaactgtagaaagaatgaatgcatggctaaggcaatatctagcatatgttgggataaactgaatatgtgagagctggattagttcacatcctttcctctttttccaggcttccatgcagggctgttagcaccctgagctctcttctcttctgacaaaagagtgacagtttagcttcacttgtatttctaagagtttccagcagagtgaggaggggctaactgtcaggaatcagaaagcctagcaacagcctccatcagattccacacattaaagtggctcccatacccccaggttgcttcctcttttgggctcaactgagactttcacaaagcattcataattctccatatgatgcatttcagttgatttcacctactaggtatagaaactcaaaggaaattgttgataggggatgtaggaaggtagtggagatttggatattcacaggttaggcgggacagaactttgagtggcaggtgtcacatagaggaaataaaaacacgagcatcattttagtttcacatgattctgccattctatatccacgtgagccttgctcataggaacatagtcacagtgttcacatgtagatgagggtctttaaagctgaagaagaaaatgccatttggcagtagtcctacaagtcttcaagaccctgggtgtgctatcaggtttatccctgggcaggggattgatattgggacagatcgctagacctccacagcttccccatctgtaacaccagccaattaagaaccattcctgcctcctttctagagactggtggctgtccaggttatatcagatgtgaaagaatggtgagggttgcttggatgaactcactaggagccccttgacatatgactgtgacctaaggatctttggacatcttcggcctgaccttctgagacaggctttgccagtggaaggaaaccaaggctgggcagcattttgggccccatggataaagacacaagagaaagagtttgggggattaagttcaaacttgtgtagctgaggggaattgattttgttgcttcaggtctggctgcttcttggcagctagcgcattaaccgaaatacattgggggagtagtcaatttttgtcaggtctggtttctctctgccagaccccaaaccactgaagagatggagtatccattaagaactacccccttcccctgcctgactcttgctccccagtttggcggctgcccacagagatgagtggtgggaagtgggagagacaggaagaaataaagagctgctggcctgactcatactcagcaaagtgacctgatggggcccatgggtcccatttgctccacctgtagctgatccatctggataagcccagggtccagagagccttccactgggacctccatgccctgctccaatcaatgaaggaaacacctggccaggagattatgtcaacactggggatgctgagatttctaaacagctggcccccagtccctgagaacatagccactattcacattcccctgtttatacatatgcaagatgcttatgagatcctctatcttcagtgagagctaaacaaagaacaaataggtgagtagtacacataaggaacttcttggcagaaaaacaatgtaagatcttgaatcaggttactcatgggaggccaagaatctttctcgaccaaggaatgtatcagaatcacctggggtgcttaaaaatgtgagctttccaactctctggtctcgtttcccattctgatgtacacaacaacaggtgtaaggttgcatatttagtcaaatctccccagtgactttgatgtgtatgtgtgttccctttccccagcctaagggaggatcactaccctggacattatttttttgttgttaagagaacagcattcaacacaccagtgcttttctccatgtaaggtcctaatattacatgcttcaaactgaataaaagttgccattggagacatatcactgagaacttgatttcaggaagagtgccatgtttctaaaaaccatcatcatctctggaaactatttttttcctggaaagtccttcagagttttaccagatatcattttatttatccttaccatgctgagaaaggattatgaaagcgattttctgtttgggaagtggtattcaaggaagttaacccactagcaaagacttatgtagcaaattggagcagagctgggaatatggtccagtgctcctgactctcagtcctgtgcttcatacactgatgctcttgaattttttttcttttctcttttggaaaagaaatgctatcacagtgttttccacagtggtccatgaaccgcttggattaagaattacctggggtgcttgttattacagattccttagtgctgcagactgcaccagtgcctgctaaagtgcgtattacacaacctctcatgctcatatatttttgaaaatatattatgaaatatttcagatgtactcactactctgtgtaagaaatggaatattagcaatatagctgaagcctcctttataccctgatcacattcccttgtccccactgaaaaggtaacaactgtctgggagttgttatttatcattcactatcatgattccagtacacactaaaatttgagaaactctgctcagccttgtttagggtgttgcttctttctggaattcccttttcttctatccctccctgtaaatatctacctatctctcaaaggccaggtccaatgcagcccttctgtgaagccttccctgatctacttttgacatctttagcagatatgaacgatcctgtaactccaagaggaatatggggtagaatgaatggcgggggctgggggggtggtaagtgaaggaactccctaggaagggaaagctgagatatagttgaaagtcaggcttgtaaattttccactggtttgtgtttgagtcgaagttgttataataacaaattaacccatactaggcttctgctcagggcagtaaatccaagctacccaataattatgtttggaaagtaggattggcagctatgcaaagacaagggaattgagaacaagagcaggaagtttaacaaatgcccacccaacagttgcacttgtgaatagtggaggggtgtgcaaagggagttggtaatacccaatgaggaggttatccctgccagaagacaaagattaggcatctacctatttgagaatgtgtagttgggagaggattatatagcagctgggatatgggcaattagtaatgctgggaacaggggaaagttgaaggcagctgtggtgtggctggaaggagggctccaagttctgtctcagattttgcacctgaaggtgtgtattggtgtcccagtttccacaagggctgaagctgaataaaatgtctaactccagccctcttcttggtcagctcagtaaattcaaaccatggcaactatgtcggggagaacatttggtatgttttgtgataggggattcttagggaggggagcagctgaggaagagaaacaaaatggcagcctattggacatcttcccacgtgtagtaggggagtaaagacagtaacacactctaaaggctttcttttccttcctagaggcatgtgagattagaaaagttcccagctaagcatatgcagttgaaacagacttcttcaggcctggcgcggtggctcacgcctgtaatcctagcactttgggaggccgaggcaggtggattgcctgcgctcaggagtctgacaccagcctgggcaacatggtgaaaccccgtctctactaaaaatacaaacattagtcaggtgtgatggcacgcacttataatcccagctactagggaagctgagacgggagaatcgcttgaacctgggaggcggaggttgcagtgagcggagatcgtgccattgtactccagcctgggtgacagagtgagactccgactcaaaaaaaaggaaaaaaaaaaaaaaagagacagacttcttcaaggggcatatgtggttggaggggaagtcaaactgggagttagcaatgacacagaagagaagtgagagccagggctgcagctcatatgtggcagggctgggatttaaacaagttttctctgccaccagagcttctgctcttaacatttttagtggtgtttttcttaaatgttggtaccaggacaagatacgtccacattacagggtgcttttaaaatgcatattcctgggctgcagttactgaatcaaatacctggggctgaggtccaagaatccacatttttaatgaacctccattctttcagaaggtggcagggactgacacttgtaaatgacttccctgttgctacttgaagcacatcttcacaactccaaattaatgagaactgctggagacaaatataattgagaatgaattactctatgaatccatttttatttttaatgtgttcccaggggcatctttctccagctatgataaaatgtaatggaatcagctgtcagttacaagtcaaatatgtccatgaagtatgtttacaacctaatgtgctcacctgtctaaaagggaggatggagtactggggaagatggcgggggtgggagggcaggttgggcagagcacggagctacatgcactagacctgaacaaatgctttgcagagattcctgttctttcagcgggtacctgtgcaaaattgcaagataactccaacaaggcagcttttgaatcaagccctgttcaggttttgactttttagctgtttgttatgaggttaaagagatgaggaagaaattagcatggagaacacaggtagaaactgggagaggagccacagggagagtcagctgtataagaataataaatttttcttgagcacttgctatgtacgaggcactttatgtatattaattcttggaacacctccataaaatacagtcagccttccgtatctgtaggttctgtgtccacagattcaaccaaccataactcaaaaatatttttaaaaatccaacaagaatacaacaactatttacataccatttacattgcattaggtattataagtaatctagagatggtttaaaatatacaagaagatgtgctaggttatatgcaaacactacatcattttgtataagggatttgagtatgcacaggttttgctatctgcaggggtcctggaaccaatcccctgtgaataccgagggacaagtgtattattattactctgattttacagatgaggtgaatgaggcacagagaaattaagtaacttgcgtaaactcacacagctttcaggtggcagggctggaatttgaattcaggtctagttctgcagtctgactacagaacccattgttttaagccaccatgttgtgctgcaactctcaatctaatgcctagcaaattcctagtgccttgctagagatattgttgccaagaggtaatcatcccaggacacatgtctctagaaggacagagcctctaagggttgttgatgatctctttgatcggggaaaaagggcattgctagttactagctatgtgaccttgggtaaatcattttccctttctgtgtttcaacattcacatctgtaacaaggagagattagcgtaggttatgtccaaaaacgttttcctttctattttttttttatggtgtcagatgtctgggatgatttcccagccctgacatggaagtcccttcagaagggactttccccttgggcagtgtgggcaaaggaagctgtctgttatatagactgtgcatactctgaaacagatgcatttatcgagtacctattatctaccatgtgccaaggacacagaattgaagataagtatgtctcctgccttcaaggaatacacactctagtgagggaggcagatgataaacttttgtaaagaatatatattacaggctattttagtcacaggagtaagcactgggtgctatgggaacagaaagaaggagcgtgtaatttagcctgggggttggggatagcgagggaagacttcctggagaaggaaatccttgacctgggctcctcagtatggtaagatctgaggggcaggggtctgaagaagatggaaggttccctctactgtgccaagaaaggcacttggccagctctagtttccgcttgagaaggcagagttcgtgccagtcccagggatctgaatgtgaaggttagaaaatagagctggtgttcttttataaacttgtgttcttttcttcctagtctgtgtgggaaaactcagtctttattaaattttccctcaaagggtatatactggcagcaggaaaaggcttaggtttcatttctacttttgtccttaacccaatgtgcgtactctggacgacctcttcatatcctaggatttcagtttatctgtggaaaaaacagggggtgttgttgtattgccactggatgaattccagggcctagaaaggtctttgagtgaccagtttcacttcctgtgataccacgagacagataagaatgctttctaattttaagcattccactgaagagaatttctaaccttaattggtcattgttttagtttctaaaaccattctcactgtcagtaaattctccctattttcttatttaaatccttcttgctatttcttaaggtccttctcttcttctgcggcctcaatgagtactgagaaaagctagttgccgtggggcagccaagcttggaggctactttgagatcttcctaaaggattcatctgaaggcaatatgagtttcttagagtatatatggactcttcctcagtgaggaaagagaagtgaagatgaagctggcagtccctagagcagcccgcttttcactgtccagttgagccccagagctctggaacctataaatatgctattcattcaccattgatcaagcagctgctttgtgatggttctgtgctatgtcttactttctgtgtccacattcatgacaagtgtccctcccatgttcattagtgtggcacccaagtatggcgtgattgtaattaggctcttttggttgcaagtagcagaaactcacttgagttgcctcagtgaaaagggaatttattataacataaggaaagtagatttggaaagccatcaggaaggcctggcttctcttttttctagcagtttcactgacagtatggagtttttctcatggtatgtctgtttcatgtcactattctcctctattctctccctctaccaatcagtttgctcagcttatccagaattgatactcactcataactttgaattgaacttggctttagcttgacacagacttgattctaccttctggtgttgtggggttgttttcaacttctgcattatctgttaactagctcagcatctttatgattttttcccctccatttttaaacagactagtcaagtgcagtagtgagaacggggaaagagtagaacaataagttcaatccataactgactgtgaacaatcaattgagacaactcactaccttcagaccagtcatctttatgcttctcaattaaaaattccagaaacaagaaactagcccaggtcacctcttcatgccaggctacaatgtcacccatcactgaccagccaatgaatttgtcttagttgtcagatgccaatgcttgatacaatcctctgtggccagaggcagggtaagagccgtaggatataaaatgtgaaaacgtacgcagcaagaaaaagttgtgagcaacatagttgcccttagaaggcagtgttggcaagcagacccagatttgtatctctggttggaagaataagattatcactaaggtacaacaaaatttccctgtaatgactaaaaaacctaaataaaagggccttcatccttttatttagcgtaaggcgtcatggtgtaaggcatatggaaaccaaagaggggaggactgcttggtataaagctggaatgatttatcgggggaggagtgtggttccctgctcatcggtccagcagctgactccaagttacaggaatcattacatattttcagctggtagggacctgcctgatgtttagaaacagctggattttgggaaagagtagtaacatttacattgttattctctgtgtatcagaccaaggcaaaagaggttggaaaagccaacccagccttgtaagtcattgacaaaagtattttggctgtaaaaagtatattggcctgtctcatttttcaacattttttaaatttatgagttgtcccctctgctacctattacactccactacctgtggcatggccaaaaataaaatcctgttgagttggtactctcatagaaatttagggtaaagggggaagtgtaagctcagttgaggaggcagaatttgagctgaactaatccaaagggaatgttggggtgacagaagacgttatattttttctgtctgtgtgtatgctttctttctagggctgctgataagctcaggctgtgccttataccctttaggatggaatagcccggagataatgcaaacatgtgggaatgtctccaatcaatttcagttaggtaaggtggcctgggcagatggcagtgatggttcatgggaaatgtgttttccaaagtgctttaccacttggagggcactctgctagtggtacttgcctgaatctctctcactgtgttagcttatgggaagtggtagcttaactcacaagagttggctgtaaattccccttctttaactatctctccatacaatttatgcagttttgcccggggacctatgaccagtttagggcaaccctatcttcagagggatttaaaatgcttggagactaacaatctgccatcttctgaataaatcctagttcctactggtgtttccttctaggcaccatttttcaaatgtaagtcaacagtatcgtttgtcaatctccactgaagatgtaacacgaggttatttagtttacctgaagcatgaggaacctagataaatattcaaaattgtttctaacggcaagagctgttaaatattagagtaggtgacagaagtagccctgaaccattctctggttgccagttttcactgagaatgtctcaggttcactattgtgagttgataatatattagattctaattggaagacttcagaaatattcccccacctatcatgatgaaagagagtaggagagggaatgtctaggtttccttgggtattctcaattgtacaaaaggatttgggaacaacaaggccatccaaccacatatagcttgtgctccaatacttccctttctctctgttgcctcagattgatttttgagtcttgcttgactcatttttgagaaagttgttccctgtgcaaacataacatgagggaaggtgtaactagtgtggatgctcaaatgtccagtgttcttcactcaggacaaggctgactggtaaacataatatttctgccatagataaaagaatgagtaaatacttggggcaggtgttgaagaaagggaagcaagccactagtcctgctagctggggtaaaagctaaagattcagcaaatttttcctagttggttgtgggactgattctactttttgaaaatgacagtttcgttgatatataattcttatattatcaaatgtacccatttaatgcatataatcaccgggttttagtataatcacaacattgtctaaccatcaccactatccaattccagaattttttttttttgagatggagccgccctctgtcacccaggctggagtgcagtggtgcgatctcaggtcattacaacctctgcctcccaggttcaagcgattctcctgactcagcctctcaagtggctgggactacaggctcgcgccactacgcccaactaatttttgtatttttagtagagacagggtgtggaggaggggtttccgccatggttcaaactgctgacctcaggtgatccgcctacctttgcctcccaaagtgctgggattacagggagccaccgcaccctgccccagaacattttcatcagcccaaaaagaaacctcttacccattagcagtcagtgactatttccctttgctcccagctgctggtaaccactgtcaatatggatttacctattttggatattttatgtaaatggaatcatataatatgtgtttttttgtgtgtctggctttttcactgagcgagaagttttcaagatgtatacatgtagtagcatgtaccagtactttatttcttttcatgtctgaataatattccatggtataaatgtaacacattttatttatccatttatcatttgatgaatacttgaattgtttctactttttggctattattatataatatttctataaatatttgtgtacacatttttgtgtggacatattttcatttcttttgggtatatatctcaaaattgctgagtcaaatattaactctatgtttaaaccttttgaggaactgccaggctttccagaatgactgcatcattttacattcccaccaacaatgtacaatggtttcaattttctcaacatcttcctcaatacttattttccactttttgttatagctgtcctagtgggagtaaagtgctatcttattgtggttttgattttcatttccctgatgactgatgatttcgaacatctttttgtgtacttattggctgtttttacatctcctttggagaaatgtgcattgaaatcatttgcttggttttttttttttcttttttcttttttttttttgttttttgagatggagtaacactttgtcactcaggctggagtgcagtggtgcgatctctgctcactgcaacctccgcctcccaggttcaagtgattctcctgcctcagcctcctgagtagctgggattacaggcacctgccaccacaccctgctaatttttgtattttttaggagagatggggtttcactatgttggccaggcattcttgaactcctgacctcaagtgatctgcctgcctcggcttccaaaggactgggattacaggtgtgagccactgcaaccagccatcctttgcttatttttaattgggttatttgctgttgttgtcctcgttgttgttgagctgtaagattgttttatgtgttctggatacaagaccctttttggatatatgatttttaaatattttctcccattctgtaggttgtcttttcactttcttgatgacattctttgaagtacaaaaataattttgatcaaatctaatttatctattttcctttttcttttttttttttttgcttctgttttaggtgtcatatttaagaatacattgataaatccaacatcaaaaagatttacccctaggttttcctctaagagttttataattttagctcttatagttaggcctttgttctgttttgagttaattttgaaagtggtatgagatataggtccatattcattcttttggatgtgaatatccagttgttgtagcaccatttcttgaaaagtctattatttcccctcattgaatggtcttggtatccttgttgaaaagtcaattgtccataaatgtaagggtttatatctggattcttcgttctattccattgatatatatgtgtattcctatgccagtaccacactgtattgattatcatagatttgtagcaagttctgaaatcggaagtatgagttttccttctcttttaatactgctttggctattctgattcctttgcatttccatcggaattttagatttagcttgtcaatttctacacaaaatcaagctgatattttgataggaattgtattgaatctgtagattagtttggggagtattgctaccttaataatatgaagttttccaatccatgaacctgagatgactttctatttagttaggtcactttgaattcctttgaatgatgttttgtcattttcagtgtagaacattttcacttatttggataaatttgttcataagtattttattgttattttttaataagtaaagcaggcctattaacacagaattgttttatgcttttattttattttaagattccttattgttattatacagaaataaagatggtcccccaacatactatggtttgacttatgatttttcaactttgcaatggtgcaaaaatgatacacatttagtagaaactgtacttctaattttgaattttgacctctttttaggttagagatttggagtatgatacacttttgagatgctgggccacagtagtgagccacagctctcagtcaggcaccaacaacccatactctacagcatactgtgttgcccagtggttttgctgaactgtaacattataagtgttctgagcacctttagggtaggctaggtgaagctattccattcagtggattaggcatattaaatacatttttgacttacaatatttttaagttacaatgagtttgttgggatgtaaccccactgtaaattgaggagtatatgtacaaatgatttttgcatgttggccttgtatcctgcaaccttgctgaactcctttattaattctaataacttttaagtgtattccttaaaattttctagatacaacaatcatgttatctgagaatagagacaattttacttcttcctttccaatctggatgtcttttgcttgttttccttgcctaattgcccttgcaagaacctccaggacaatgttgaatagaacttgtgagaatggagatccttatcactggtgttagcggtaaaatatccagtttttcatcattaagcattgatgttagctatgttttttttttaatagatggaggacctttattaggttgaagaagttcccttctattcttagtttgctgattgtgttcacaatgaaagggtgttggagttaatcagatgccttttcttcatttactgagataatcatgtaatttttgtcttttatcctttcaatatgatgcatttcattgattgattttcatatgttaaaccaaccttgcatttcttggataaatcacagttggtcatggtgtataattcattctataccttgctggatttagttttctacgattttgttaagggcttttgcatctatatttattagggatattgacctgtatatttcttttcttgtgatgtgttcattgacttttggtattaaggtaatattggctttacagaatgagttcctatgattctactttgattaaggtaaaatgccaaagtaaaaagttggatatgtgatttgcatggagattaccaactttgttttttgccctaatcaccacctaaggacctagttcataaatgagtagttctgggctgagtgcagtggctcatgcttgtaatcccagcacttttggaatctgaggtggatggatcacttgagcccaggagttcaagaccagcctgggaaacatggtgaaaccctctctttacaaaaaataaaaataattagctgggcatggtgatgttcacctatagtcccagctacttgggaagggagatacacagagccaaaaaagaaaagacatggtccctaccagaggaataagctttttaccctgacatggttcagagagatgaagaaggtagggaggagaatagaggcgggcattatcaatccatcagagtaagtaaaaaggatttaccactctgctactctgataggctttctgcagcctcctatatgaagagatcacattcatgtcttcaacctatcttttcttaggttttcattcaagttatcctaaaccatccacactattttttagtcctaatttgaatgatcaaagatacaacttatattaaggcactgatcttgatgtctgcattggattaaagatagccacaaatttcttgatacttttcccatagagaagctgggtctgtctccaattcctattccccaaatcttcactggtgtacagctgctttaagttaatctaattacatctaattggatcattagacttaatactctaattagcttcattatagaagataaatagagtatgacagaagtgacatcaagcttattctaggcctgtggtctaaagaacttgcagtttccttcttggtctcttggagctctgagtcatcatataaaaagtttgactatcttggagagaccacatgggatttccaagagttacttaaagacagaaaagttcagctagtacagccattcctgccaaggcactagacatgtgagtgaagttgttctgaaccctccataccggttaactgaatatcactgaatgacatcagttaatgccatttaaagtagaagaattgcccacctgagctctgaacaattgtgaaaccatgagatataataaaatggttgttttaagctgctgtgctctgaggtagtctgtcatacaacaatggataaccagaaaaatgccaaaccatatttcagatcgttattttaaataaaaataattcatgtatgtgacaaaataaaacaatacatatataaaggtttaaaacttaaaatcagtctttttttctgacctcgataccattccccaaaatgaccattaagttccttttatattctccagaatttttaataaatataaataataaatataaacataaatataaatataatttttaataaatataaaatattttttccaatatttgttccaatatccaatgggatcatattatctagctctctatctatctagctacactgttctgcaccttgcgtttttcgcttattcatatctcttgaaaacctatcaatgtttatagatcttccttctatattttaggtatgccatatttttccattgcagggataacataataacatgctctgtgagggcatagatttttgtctgtgttgtttattgctatctccccagtgcctgcttaaagagtaccaaatagtactgaatatttgttgaatgattgaatcatatgatcattaaccacttctttatgcacatttaggttgcttccagtttttggcttttccaaaacatatttcagggaacaactttatgtatatgtcttagcatactagtttatctgtaggacaaattcctaggagtggaatgattgggttaatggttattttaaattttcagaagtcattgatgaattaaatgctctccaaagagactgtactaaattattctccaacccacaatgtgagtttgcctgatgtcccatagcctcctcagttttgtggattgtcaacatttcagtttcttccactctggtatcttcttttaatctgcatttcaataattatgaaaaggattaaataacatttcatttttattgctcatttcaaataatatattcaactctagcaactttaaaaggtaacagtgtctaatttgcaattacaattctttaaaaattcttaacttttatccatttattttaagtctactttgatttcagaccctgatgagaatgttcctgagatttgccttggtctattttaacttggagtcaaagccctttctagcagctcatctccaactcccaggcaggcttgccatcgaaggacctcatgctgcttctcttggagagaacagttttcagcatatgccatcttccttcagcaaggaaaaggaatagaaagggagggagcagagaataggagacccactttatcctttccattcacttgttcctaactctttcttttttctgtgcatgggattgaggagaataaaaatgatgttaacgataattaatatgtttttgagcatttactatatcccatacattattttacttaaaccttgatgacagttagagagggaataactgaaggagcaaaattcttgagaaggtggttattaagttaccccagggcacagagcttgtaattggcagaaccaggatttaaacccaggcctgggagtctccattgccctagctttcaaccattacttaggtgctgtgatcattacgtaataataattgctatcatttattgaatgcttgcataggcttcatattaattacattttagaattattatgcaatacttcaaatatttttaaagatatgaagtaataccatgaacatccacgtacctattaccgattaagtagctacttaaagttatgtagcttgcctaagttcactcactcagctggtagagtggcagaggtgggatttgaattccaggttagaaaataaaaccttaccaatatgtttgaatctttctatatcctgccccaattacatctctgtgcctccagaagtaactacaatcttgaatttggaggtcttaaaaatgttgtatacacttattatggtgattgtgctatgaacgttaaattcattaccatactggtttcttaaaactattctgtcaggttgatttcatctactgacattatcctgagaggaagaataagactctcatatacctcaactgatagcacaaagcccttggtgccagctttaatgaggcagctccctcctttatgatgcttggcatatttagctatgtgtggcatattttatacagaatcatagaatgtccaaacaaaatagatcttagctatcatttgggtttggctggttctttattatcatttatcttcaatgtcaccacctcaaagtcccccatcatcatacttttctatcacacatctttttggtgtcttttgtagcactaatcacaatatataattattagatttgcttatttgattacctgtgttccttattagaatgtaagcttcatgttggcccagaccttgtgtgtcctttttcacattcaacagaggcttattgagcaaataaatctaatccaacctcctcaaggtaaagacaagaaacctgaggcctggaaaaggacttgccaagatcacacaccgtaggctttctgactcgcaggcaggcactgtgctaggagggaaggaacttcggtggttataaaaatggtagatgttctgatggtgtctaattagtgttgataaatgatatgaaggaagagacagggtttggtgagagaattctagaggggcatctgacttaaattagaggattattagagaaggcctctctaagaaggtaagatttaagaagaaacctgaagggtgggtaggcttaaccaagtgaactacatgaagaagagagttccacacaaagaagtagaatgctataaaggctctaatgtgcgaaagcacatgttgtatttgggtactactctaaggccagttttgctgaatcagaagagtgagtaatgggaagagtaatagatgatctcagagacgtaggcattagtcagaatataaggactttgtattttatcctaactgcaatgagaaaccattgcagggtttgaggaagaaaagagataagatatgatttctattctaggaagtttcctctggcagtgttgtagagaatggctatggggatggtgacgagagtggaagcaggaggccagtcaggaggctgagccatagtctaggcaaagacatgagggttgcaaaggtgacagtggagctggggaaagtaggctgtttcaaaatatattttaaagtgtaatcaattgtacaggtgatagatttgatatgggtatggaagagatgtccaaaaatggggaagactagaggagaagcaactgtggctgggattgagaaaagagaaggaaactcagttttagataggttttggagatacctgtgtgagaaatccaagtggagatgtcaagcaagcagtctggagctcagtgaggtctctgaccttgagtttagaaattgggagttcttagtacatagatgatgtttaaagtaatgggaaagaggattgtaatactaacagtggttatcacctactgactatgacctatgtgccaggcaatgttccaagtgttttatatgtatcatctcatttaattttcacagcaaccaagtgaaataggtgctgtcattatcttcatcttatcatgaggatgagaagttcacagaaaggtaaagagacttatccaagatgaatttagctagggagaaagagttgagtgagaagagaagagagcccagtctaagtaatgggaaattcttcatgtataaagattgggcaatcatagcgaactcctatatggcactcactatacatacaagagctcattacatctttgccacaatctataaagaagatattattagcctcatttacagaaagggaaattgaggttaagagagattaagtaacttgcctaaggtcattcagctgtggagtggcagatagaagtctgatctaagcaacaccatctaacagaagtttttgcaatgatggaaatgttctgtgtgttgctgtctcatgtgttcctagtcacatgttgttgaacaattaaaatatggctaatgggactgaggaactgaattgttacttttaattttattaaataaatatctaattttattaattaatctgatgtaattttattaagtgtaataggcacaatgcgactagtggctaccatattggacagcacgacttgagagagtctgtgctgttagttgcttctctgtacagaaacttactaaggagactcagaggggtagccagagaaacataaaaaagaaaatcaggaatgtgggggtcacagcagccaagagaaaaatgtatgtcaaaaaagaaggtgtaaccaactatgtttaatgctgctgcattaaactcgatgaggacagagaagtgaccattgcagtcagtcagacaaaggtgacctagaagagaagttttggagttacagatactggtagtattgtaagatgaggaaaatgaaggcaatgtgtgtagatagttctttcaagcaattttgctaagaaggagagcagagaaagtgagcagcagctggaggagaatgcgggatgaagaaaggccttttctaagatgaccaaatgcttggatgctgatgggaatgatcctgtagtggagagagaatgatgcaaaaaagcaaagtctctgagaaaccgagggtgcaatgaggaggaatttttttttctactgtattataaagaaatctaagtaagaaccctgaacagatatttcaagtgatttcttaatacactaattgcaactttgatgagattttcaaaatcctcttaaatccacacaccactagaaaattctttcatacccaatggcatatagacaggggacacccaaataggtcccactaaaaacttagagaagctatatacttttttttttttcacaaaaaactagatgtttatttgttccacacatgaaaaaagggatgtgagaagtcatgtccagcaacataaaaggcctccctgattactctgcacaatgagaataaaaggattcatgaatatacatattatgacaaaatttcagaacattaaacagaacaccttaaaaacttgtagagaagaaaaaagttataaaagacaaaatacatataaataacaaaatcattctggcataatatattttatcaaagccaatggatgctagatgaaaaaggtacaatgcttttaaaattttatacccagaaaaactgtcattcaagtaaaataaaataatgaagattttcaacatggaaggccacataacatttatctctcgtgtatttttcataggggaatattggaagatatattacagtcaaaggagagaataaatcccaaaagaggaaggcaagtaatccaggaaaccataaagtgtgcaaatctttgaagaatagcatgaatgaagcctctgtaacacattagaaggcaattgttcacaattggaggaggcttatggccttcagtgaaaaggttgctaaggaaaagggagtcttgaagaaggagaaattctaactgaaaggttaggataatttgtgaataggaaaatgtcagatgacagataaaaagaagattagaaatgcccaggtaaacaaacatgcaataaaaatatataagaaagtcctggtccaaatataaagcaaatgaaaaataagtatgcttttagagatatacctaatgttaaatgacgagttaatgggtgcagcacaccaacatggcacatgtatacatatgtaactaacctgcacgttgtgcacatgtaccctaaaacttaaagtataataaaaaaaaagaagtatgctttaaaacaattgggagctaaagtaagaatacattttaattttaaatatgggttcatttatattaaattagcttaagaaaataacactgtacatgcaagaagtgagaagtatcttagtagagaacttggtcccttgttgaacaatatttactacttcctattattgaaagcactatttgttggtaatagagtcaatctattgtcaaggtatgggagactaggttgtgattgcaagataaaaataatatgtttcaacttataccttctatacctaacacagagtccataataaatgtcctcattaatatttggagaataaataaatacataaatttctttttttaatgttgaaatttttattttacagatgaaaaaggtggaagataaaataatttaagaagtcctattttgtccagcataggggaaaagagaacacagctttgtgagtttgttttttttaatactttaagttctagtctattaaggtagaagtcaaaatattcctatgttaaagctttagtttaattaaaataaaatgatcagcaaacagattttttttagctgattcttatactgttattttcctttactctttagttctgaggaagaggacataaaaatcttgaatttcactcctgttgctcagtgacaatgttcagagaaatgtggcattttaaccatcattttggtaaacttggttatttttgtatggccatctgtccctaaaccacattattaaggatattcttttttaacaattatactttaagttttgggatacatgtgcagaacgtgcaggtttgttacataggtatacacgtgccatggtggtttgccgcacccatcaacccatcatctacattaggtatttctcctaatgctatccctcccctagccccccaccccccaacaggccccggtgtgtgatgtttccctcactgtgtccatgtgttctcattgttcaactagcacttatgagtgagatcatgcagtgtttggttttctgttcctctgttaattggctgaaaatgatggtttccagcttcacccatgtccctgcaaaggacatgaactcatccttttttatggatgcatagtattccatggtgtatatgtgccacattttctttatccactctatcactggtgggcatttgggttggctccaagtctttgctattgtgaataatgctgcaataaacataggtgtgcatgtgtctttatagtggaatgatttataatcctttgggtatatacccagtaatgggattgctgggtcaaatggtatttctgtttctagattcttgaggaattgccaaactgtcttccacaatggttgaactaatttacactcccaccaacagtgtaaaagtgttcttatttctccacatcctctccagcatctgtttattccctgactttttaatgatcaccatcctaactggtgtgagatggtatctcattgtggttttgatttgcatttctctaatgaccagtgatgatgagctttttttcatatgtttgtttgccgcataaatgtcctcttttgagaagtgtctgttcatatcctttgcccactttttgatggagttgttttttttcttgtaaatttgtttaagttccttgtagattctggatattagccctttgtcagatggatagattgcaaaaattttctcccattctgtaggttgcctgttcactctgatgatagtttcttttgctgtacagaagctctttagtttaattagatcccatttgtcaattttggcttttgttgccattgcttttgatattttagtcatgaagtccttgcccatgcctatgtcctgaatggtattgcctaggttttcttctagggtttttatggttccaggtctctaatgagacacagctgcttttaagtaagcttataaaactgtcgtgttataaatagcacttaattctagggtaatgtctgtattgtccatcaatggatcacattcgcaacatgttctcatgaacacaatataataagaccctaaaaaactcaaccatggctgacagtaatatgccatttttatgatgaggaaaacctgagatggagagctaaagtgacttgtgtaaggtcacacagcaaattaaaggcagaataatgaatggagcctatcttctaactcactgcctgtgtgctacaatgacttttttcctctccattggtgagggtatgtcttgagtcatttgagaattttttttctttaggatacacttcagctctattgttttcagaaacaaatgtctgaaacatcatggaaagtacctagtgatgcatcctgtctccccacctcaacccctatctccacccccagtcccccatcaatcttttagtataatcagattaaacataaatcaggaagtggctggacctgatgggattctgaaagagatccccattggaatgaatatatatgggaaattcttaaatgcctctagatttgacttgcactaataaaggaacctaaatggtcctgctaaagtcaatcaaataagaaagatctacaaaaatttttgtgttccacatgttctaagattatatacagtttatctagggcctctctctggtcttctggggtatgtgtttgggggatagggaggatgaaagattggagggggtttggggaagatacagccttgaaaacaaaaccgtacaattgcaaaaagaatctaccagcccccgcaccccccctccccccgcaaaccaggaaagtttgacctccttccttccattgcctgttttgtttccaggttcttctcttgtgtcttccagtccttcttccaggtcccttgctgtcccgggactcccttggtgtccactctaccctcctggaaaattatgtacctgaccctgtcccaccagagtcttcagttgaacagtttaggaaattgactcctttacttcttttcttcacttaaagaagaaactaacagccaaatatttaaaacagaaaatgaacaaacattaaccgggaacctgcactgaaacttaaactgagagggaccttgagatcagtcagtggggcaaataagggcaggtgactttctgaaggccccacaactagtgacctaggactagtttccttactcccacgtatacggtagatgctgcttaatggcaacccagtatctgtttcttgaatgaatcacccattcaacaagagggagaaaacaggtaaaggctccttgcaacagccctgtcaagtgcaatgcttttcatataccttaattttattaaataaatgaaaaattcaagctgagaaaaatgctttgctgcttgttaattgaactccagccatcaaatgaagattttatggacttgatgccacacagatgaattcttgagaagtccaattctaaattgatgctattcttcatcaagcctctaattgaaagagagggttgggcatagattgcctagttgtaagaccgggcttttgcatagctacattcttagctctgtgaccttgggcaaattattcagcatttgtgagtttgttactacctcatggattgttgtgagaattagatgagataatgcatgcaatacatacagtatagtatttggtacatagtaaccagtcaatagttgatatctgatatcatcatcatcatcatcatcatcctgataccagttgttaaaataaaaatgttcccagtactttagttttcagaaaaaggacctattacagcaaggagccagtatatgcagcatgaaggctaaatgcacaggttaatagtagaatgacctgggttcaaatatgagccttaccatttacaagttgtgcaagcctccattaatgaggattggtaatagtatttctctccgtagggttaatgagaagattaagtgaagtatagacacatacaaagcacaataggctgcattatatgtaacttgctattagtagcagcctaggtctcaagagcctttttggaggggatgccccagacttggcttctgggagggaaggagggaccccctccaacacacacttggcaaaggcctgcagtagaggctacccaaaagccatgtgtgtgctccctgtgtttcctctcctggaggttcatttcctttgctctcccatcatttctgctcattcttgccagttcaaagccttttatggtgacttggggtttgacctttgtgggttcagtttccaggcatttcctgttaccttttctttctgtcagtttccttctttatggacagtttgttttcttgtgctcaccacagcacaaagaagcagtctaatacatttccatgcccatagcagggcatcaaagtgtggtagaaacaaccatggccagggtatcagggcacctgggttttgattttcctaagcttgcctgggcacctcactttggcactctgacccttagtttccttgttttcacatagagagcattggactagatcgataagtactcagaggccccagatacatgcctagctccctgtgttgtgatatgcctacttttatggtgaggtctttgatctaatttcacgtctacctattttgtatttaaataacagaagagcagatatcaggtcctcttaatgtgtacacacacacacacacacacacacacaaacaggagaaatatatgctaatttgcttgactgtagtaatcatttcactataggtatataaaaacatcatattgtatatgttaaaaatgtacaataaaaactaaagcaatctacttaaggcatcccttctagaggagaggagctttttagtaatacccaccccatcaagattaagttatagaggaaaagaaaaaaaaagaaagtaatacccacccatggaaggaggggccagagattggccaaagggattgtccaaagcaactcatccataggaggccatccgcccctcacaattttcctgcagcatcagctagaatgccctggcaggcagtccttgaaaatccatggcttaggtgttgcttaagattttttagttgcccatctagcccacacagagaggagtatccagccagagaagaagctgtgctgagctggagcaggcagtgggggaatcagtcagttaaaaggcaacttaagcagctgctctgtgaggaggtagttggtatcgcttctgttttactcatggggagctgaaactcaaaaaggtttgatgacttgccccagaggttaagtttgtgacaggacatgatttcaaccgcacgtccgtagtgcttggcatgctcagtgttgcactgaatggaacgaacaaattgtagggtggctctgttgctatctgactgtatcaccatagataagtaatttcacttctttaaacctgtttccccacgactaaagtgaggatgataatacctactgatatggtttgactctgtgtccccatcaaaatctcaccttgaattgtaataatccccacgtgtctagggcaggactaggtggagataactgaatcatggcgaaagtttcccccatgctgttctcatgataataagcgagtctcacaagatctgatgactttataagcatctggcatttcccctgcttgcactcattctctctcctgctgctctgtgaagaggtgccttctggcatgatgataagtttcctgaggcctccccagccatgtggaactgtgagtcaagtaaacctctttttctttttttttttttttttttttgagacggagtctggctctgtagcccaggctgaagtgcagtggcacgatctcggctcactgcagcctctgacccccaggctcaagcaattcttctgtctcagcctcctgagtagctgagattacaggcatgcaccaccacgcccggctaatttttgtatttttagtagagacagggtttcaccatgttggtcaggctggtctcgaactcctgacctcgtgatccacccgtctcagcctcccaaagtgctgggattacaggcgtgagccactgcgcccggctttttttttttttttttttaaattacccagtttcaggtatttcttcatagcagcatgagaatggactaatatacctaccttccaaaattgttttggccataacatgacaacatgcagataaatgtgctttatgaaaacaatgctctacaggtacaaggcataacagattagaaagctaatttaccattagattttctcactgatcatcttctattaaaaatagtgaggtgcttaaagtaatgagactctatacatcccataggccactaagctactttcattttgaatagaaaaataatgacggtgcttataaacatttctatcttttctgacatagtctgcatgagaatgaggtgctcacccctggagtagttggtgactaaggtgacttccagcttggtgactccagaggaaagcaaggctgttacaatagcctcaaggtcaggtcttctgattcaattggccttattttcacattgccttgcagagggcctagtaggctcaatgactggaaaaatgaatgcagaattgtgagccagttgtctatgcatgagacgaccacacgatggcagtaaagtcaggtgaattcattctctgctgctttctcagtcctgcctctagtccttagatcaaagaatgtgaacacacttaattccttgtttctgtttcttccagttaatgcctgggcaacatggtgaagccccgtctcaacaaaaaatataaatttttatttattttttttaatattttttgttgagacggggcttcaccatgttgcccaggctggtctcaaattgctggactcatctaagctgcccagctcggcctcttaaagtgctgggattacaggcatgagctgcttggcctgacattaactgatagtattactattgttattagtataggttggacaatatagaaggttttttaataaagtgaaatgggtttcaaacgcaggaaccaggaggaaaactagggtcaactgtaatcccaggagcaattccctggcgaggctagagttacagggatgaaaatatatgttatatctgtgttctgtgtcatataactttttcaaatcattgtcacctagcctcaccctggtgaactgtgagaaattatgagaaagagacaaatgtatctttcaagtgaaagctgctagcactgcatcaagcacagtgtaggtttccaaaaaatgtggattcctcttgcttttcctctgaaagttagactgatgtgggctaatgatatggtcctatccagtggttccccatggaaatgtgtatcagaatcatctgggccttctccccagacatactaattttgtagatctggagtggagcctaggaatctgtattttacagctctctcagacacttttgggaacttgttggaccagttgggagtgtgttgagctgagataaagaggatctgagaagtattaattattctaggcatggtgctaagtgctttgtatgtgtcatctttttggccttcagagctgctctgtgagataggtggtatcacttccattttactcacggagaagctgaaacacagaaaggagaaatggcttgcctcacaggttcattttgtgaaaggacgtgatttctagcacagttccctgtaactctcatcccagactcttctccctgtaccacactgacttcctgagcacacacagacctgggctcagtctctattttctctaagtggggaccttggtcagacactttatctggctgttcgattctttcctctataataattcctgcctctggctgggacttgacgaatgaataaaacaaatgaaaaataaataaatgagataatggatcacaaaataccttaaaaatgataaagtactaaactcatattgggtggtattatttgtggcatttgtcattacccaggaaccttggacctggaaaagtctctgtggtgtatatccgttggctgataaagcatggatggaaatagctaatgttcaaagctggcattgctggtatggggctaatttaatggctagaatgagggaacatgcacttctgagtcctgaggtaaatcagctcactgggtctggctttctagcattcttgaatgttcaaggattatgtcaaaaattaataacagtcactcaaaaagcatattctgaacattcactgtattcaagatgctgaataaggcattgtaaaaactacaaagaatttaaggatatagtcttcaacaagcctgtagttaatttgaggagacatgatccatacacacacacacacacacacacacacagatggaatctaacaaaagcagccataatgatgtcaatcacaaatgtgtagtgtcgtcagaaggagtaaattactgttgttacgctaagacacacaatgagaactctagaatctatcttccttctctttatgtaagttctcatctaggttactgaaaatagcccctgactctctctctccctgttccacaaaggtactgcacatcaacgcctttatctatctcccatcctgtggacaaactgatgtttctaaaatgcaaatctgatgtcattatccttctttagcagtggttccccattgccttcaggataaagtccagattctttagcaaggcctacagggactctggctatcacttccatcaccaccctgtcttcttctcttgcccagccacctcgaaaataccatgttcctccacccctttgcaactttgcatgtgttactccctttgctgggaatgcccttcttcccttccttacctagctaacttcttatttttccctgaaaactccccagctcctttcaactggatttgatatctctcacctatatccttgtggcagtccatatcggagcgcttgtcacactaatagtctatttccttgtcccgtttctgcttctggctccctttcactcatctagtttgttgatcttacctatgagaaaacaatatgtttacagagcttactatagtgactggcatatagaaacatttaaccaatattagctattactattccagtaactgacttatttagctgagaaagttcaagtggaagcaagcagaggactactgagcagatgttaggggagaggaaccaatttcctagaggctaagtgtcctcaagagctagcgctgaatcgaatacatccaatatttggtcagatgggttttaacccgtctccttgaggagagcgcccaaagctcttctgagaatctgctccaggtgtagctgacaggctgtataaaaggcaacacggggtgacccagaagtgtttttcagaggcagctaaaggtaaatctggagaaagacctagaagcacaatttaacttggcctgagacatggaagatgagcagagtagctaaaactcaggatagctatatgaaaagtgatataaataagcaatacaggttggcaaaacatgaggaaaggtcggaagctaatgctcaatagtggcgaggaagattttaatcgaaggactcaatttgttcggcagaagtgtgtgagagagaaaagaaaaatcagccaaatcagggcatttctgtcgtcatgaggacttggctcttctttgagtactcccatggactttctagcaagtgtcctggtcttcccttaccctttggaacattgggttgaaccgtgatgaagttgaaaacccagaatgtcctacccctccagcagacctgactggaccaaaaagtcagtggctactcacaataacatatttacctgaacaactgaagttttcagtgggttgttttttattcttcttctctggcaaaggagcctggcaggcttctggaatcttcagtaggttctgggcctccaatctgggctgctgttgacactcacgcccagcttggagagtgagaagagagatgttctcatagctttggctgtctttttactgggggccggggtgggggtggtagggtgtttggcaattgctcttgaattcgttggctttgctttatctttgtggattattcatctgtgtttgctgaacctagcagagaaagttctctgttcatttagcttggctgcattaaaaatgtttttatgttgctacctataaagaccctaaagtcagcagtatgtctctgaatagatgggaccaccagctccttccaaacccctacttttcttgctaacataaaattcaggtcttcatggcaaaaatgcattgagtcagcaaatagcaaccacccctcccttaccctaccatgtgtaccaaacggtagtttgggagatgggttgttacctggtttcatgactttagatggtgccacaatgatgagaagaacagctggctttcctgaactgtgtttattatttcctgaacttgtttattatttcctgaacttgttttattattttcagaaaaaaataataccctcaataggaagaggtctgtaaaagcttaaccctccccagccatcagtctccatgtgccatgatctctatgtctagtgttctaatcttccacccaccccatcaactctcctttagtatctctattgttctaatcttccacccaccccattgattctcctttagtccctttctcttctttgatttctctctattccttcccctcacaccctactctatcaaattccaaaggattcctaggtgcttctctgtagctgaggtttttgtcctcagggccactataggctacctggcttgatatgtggaagcctgtgaaagccatcaaggcccccaggtcactcccaggcagatttctctgtatatctgtcctgctcctctacactgggtggtgaagttgaggatgatatgcaggttcccattttaggttcttctctatccttggtgtcattccttcccttcttttgcctatctaaggccagggcagtgtctcttaaacttcctgattattggagtatattagacgaaaaaacaaatgctaatattgttctctttgccccttacctgaaacaccctccagtcttctaattccaataattcctagaatttggatcttatctttctggtggaatacaatctacacccttgaactattcacattgtccaaatggatttttcccttcttgcctgaccctgaaactccaaaccacttcacaattcttaccccatcttcatgagcctctcccctgccacaccaatatccaacacttcttaccataatccggggtcctagcatgcttgttttttccttctacagtagcagctctcagaacatgactgttggcaacacttgtgcgaaattaaatcttcatatatctgaaggttccattacatttcatctagccctattcagttttggaggtgttagttgtcattatgggcttgctatatccctgcttccctgactcttcctccaacctttcaggagcctggaatttcatcagatgattctctgaaagagaagactcaactcactcaaaagacagacttacctcattctctttttatgccctttcttttcaacattgtttccttcttcctccaaagagaactccttttttggattcactctccagcattcttggcttctaagctggcattctgcacatgctccctgaatgggggagccactctatcagattctgactcactccggtccataattttgatgcccacagcaatgctagatcccaccacaagcattggtttggggctaactccccatagctcatcatgacccattgacagctagccagacaccacaaccctgaagggcataggactgcggctctagggagggtggtcagtttaagtggccgccagtgacaatttatctctaaacagtgagctgtaaaacataacatcgtgctgaatcaaaggaaacagagtcaaattccaatccaatttgatgtgcaacttggaataaaagcaacgtgtcttgatttaaatgtcaggcccactgctgagtgatgatttaataacttgtatgagagattctgtcacagcaaattcaacactggaattcagtgactcacagatagagtgttagaaatgatacagaagagcacaaaaaggaataggcttatctcagggctcatccagaagctttgcataaagctcatttgcagttagaacctcttttctccccctatcctgccaccgatccttctcttcacagacacccatgcatggatatagagaaaatttctaggtgtgatgtcatctccctgcagtatcttctaaggacacagacttttaaacaattctagcgtggaagtagagtcagtgcatttaatctgaaggcaaggaagcagttagtttggtgtttctcaagggactttaaggacgcatctggtcttaatgtgacgtctttagccaggtacttaattatttttccacattttaagggttaaagagctgagacctggtggagttaaaacatttattcaaatatttatcctgtctccttactcccagggaatcagtgcttcctcctcaataccttgtgagatctctccccttgagcttcccttgccttccatggggtaacatactagaatgctcaagactgaccatgcctcagtcccagtctgcttcccaggtcaagaaggaaccatgcatggccgttcttaagggaggaaattccattctgttgggctaatcttttagtcatcaagatttattttgaatagaatttaaagtataaatatctggtgtttgtctacatgaggattgctcaacgtagacaatatcgacactttttggccagatcattttttgttgtggagaactcttttatgtattgttggatgtgtagcagtgtccgtgacctctggtaactctctctgtctatatcctccatttgcctccaatctatttgacacagacctttcaggttaatatttccaggcaatacctctaacttagtggttctcaatagaaagcaacctcccctcataccgggggacatctggcaatgtctggtgacatttttggttttcacaacttggtggggaggaagaataagttgctatagacatatagtgggtagaagccagggtgttacagtgtacaggaaaaccgccccctgcccctgcccccacaccaagtaaatgtccaacccaaaatgtcaatagcgccaaggtcgagaaaccttgctctagcgtatcgttccctgctcagaaactttccattgtttcacactgcttgtaggaaagatgacagatttcatggcctctcctggtgtagattcagtttattattttgtcaactatagctcctttttggaaacagctctgaatgttatgctttctctgaaacatgtcatgtgctttctcactcacataactttgctcacgccaaccactccctctgcctagaatgcccacttcctactactaaagccaagatgaaatgtagcatctacaaaggcttacctgagctcaaattttcccagctgcaaataattcctccttccctggatattcctatagtattttacaaatatatctcttaaagcacttatcatattcatactacaatagaaaatatgatctggaaggggcttttaggattctcttcagtaaatccttccactgaaagtaaaggaaactgaggtccagaaaggtgaagtaattggccgaaggcattgtatattctcgcaagacttggactgtagtaatttgtgttcttggtttcattctcctagcatggttgaaatggataatcatgaactttgagttaggtctggcagtcaaattgcaattctgacacttataagtgggccaagtcatttacctttctgaaactcagttccctgagcagtaaatggaaataatcatggctgttatgagaattaaatgagattgtgtattaaaaatgcctagcatatagtcggtactcaatacatgtttgtcagatgaaaataaggatcaatagtagtttaaataatgggatttgggaatggatgatggtccataggacttcactaaaaggcaacaagaggcaaaatatggcaactcattgccacctgctccctacttttgcacccttccatagacgatttcctcagtgggccatcagatcagcatgcaagttttctgtgaagtaactgagtgctgacagtggctttccaaatggtaaggtagttcttaaaaggtctgctttttctttttcttttacagtgccaatgaatataatctctttttttcctccggtagataacaggtagagttgtggggagggatgtggatggaagatacatttcccctctttctccttagtttcctttatgacagcagtctggggcttagatgccttcagaggtctaacagaaatttctgtgagagggaattcacaaggcacttggggtggcaataggagcactttagtgttggctcctagctcagtgatacctggttctgacttcagtgaggtttattggggcctttctagccagctcttcactctggagctgaccactctgtcagttttcttcctgcctagggctttgggctaatggcatgctatgcatttattctcttcattcagagaaatgagtctttccctgatcccatggggcatgtacctaatagaaatatccttgctactcaaatgaggggatgacctgacaagcagctgaagaaacagaatgagagttctgatgccttgtctagactagatttggaataagctggggaggatgaagttgcttggcaatgggcccacctcagagctggctcctgtctgctctgccaggtgactacaggagatttttgttgaagggggttagaagagaagctcaggtgagtctactacaacttgacttaggagccccccctccttagggcttacaggtcaagggccctgtaagagaaaaatgcttttgggtgtgatgaaaacaaaactgcagagggcagagcactgaattgggagtaaagacacttggtctggatttctgcctctacctctctgcttctgagagagttcccagggctatcaccggagcctcatattatggtttgtgaagtaggtgcaataaagtctgcagtcttcttcccactgatggcagaagttgaaggttttccagtctctggagttttcactctgtgaattccaaaacatttttcaaaccttcctactttgtgtatgtgaaccagggagtgtgtgtgtttgtgtgtgtgtgtccagggggaggagcaacaaggaggggatacagctctacaggctgcttgtctctatatggtattcttcagtttactgtcttgagagtccaccattgttgttcacgtttaaactactttggagatagttgagctcctttctcaaaggaggcttctctttcaaatttgctctttctgagccttcagaggcactattttcatagctgctgtaattgggctttcaccatgattttgggtgggaccacaggagttcaggaactttagactgcccaggtctattggtaaagtactatttcctctgaaggactgtaacacttgacactggtcataagaggggataagggatccattcacccattcaagtagaaaggaaggatacatggtattgtgagagcctctgatgagggaagttgacttaggaaggtcagagaaaacttcactgaagaattaatgattatgtttagttctgaggaattattaaatattgactaagtaaagaaagtagtggaaagtatatgcgtacacgtgcacatgcagtgaatgttttaggcaaaggaaacagaatgtgcataagccttaaagtacaagggatcagggcacattccagaaagaaataaaatactatattcgctggtttttcaactttaattcaaaatttaagccatagttttaggtgttaagggttgaaaatgccaatgtcctcagctttgaagtactgttaggctaaatcacacatactgaaatggtacccacagtggatagagcacatgaaagcataatcacgaaaagaaacaaatgcatctgtactattgagccagcaatctggaagagaggaaagggcagataaaaaaatgtgaaatgtaaatctttctcccaatattttgtccagcaggtacatctgtcaatggagtatacggatacattccgggagggctacctggttgaggtgacatgagcccagcggagtgaatcaagggagggcttcaagcaggtgccaagttctggatagtgttctgaggaagctataaattggtgaataagaggagagaagatgtttctggcaggagaaacagcatgagacatgacttggtggtagactattttatttctgagatgggaaatgtggggataaattaggctggcctgaatgggaaagcgaagcagccaagcttgggcccatcttagactctttctaggagacaccaactaatcaactaaaagcagtaaaattaaggttcaccaggtagtatgtgaaaataaataattagttatttgaatttagcctttaaaaaataaattgtcatacagatcaatcttgacatcctccactgactgtagtcaggattaactttcttcaagatttagatagagagagataggtgaaagttgctgcctatctctcttctcagggactctctgcaattttgtatcactgggaccctaccataatttctggagtcctgtttgcttaagcactttattttagcagttagccactttgataccttgtaaagtaatagctcttatttttctaggcattgacattttctgaaggatggctgaaaagtcacaaatctttcagacaaaggaacctgtctctgatggaatagcaggtggcggggtggatgtttttgagcaggtgacctttcccattaccttttaaagagaaaactacccacttcaaagcttggctttgattccaatgcatattgctttcctgggtgttgaaaggctaggttaggatagagacatgatgtaagagggagttgattttattttacctgtctaatcccctgatgatgcaggcagcccatgtacagtattctatcactgtggttcaaagtgtggagttttgaagttaggatgagtcagcatttgtatctttaccacttgccggctgtgtggttttcagttgcctcatcttctgtagctgtgtgtgcctcagttgcttcgtcctttgtaaaacagggataataagagtacctatctcatataattactgtaatgatcaatgaggtatatgtttaaagagcttagcataatgcttgacatcttatcaagttgttcttgtcatcattgtcattagcattgccacccataccacccccaggctcctactctaacaaaaaaataaaatcttacaacctcttgctgaagcaaagatcagcagtcagcacagaaggaaagaagaaaataggaagcccagggacattcgctgtttcctattctcaccctaaccatagcatcccaaagagaatgtataaaaactgtactttctggaatcatttctatagttcattaccaaagagaaaatatgaaaagacaacccaatcctcattctctgtccctgttctcacaggtacctgtcggcttggctgggcctattactgtgctggaggtggagcagctgcagccatgttgatctgcacctggctctcttgctttgctggaagaaaccccaagcctgtcatattggtggagagcatcatgaggaataccaattcttatgctatggagcttgaccattgcctcaaaccttgagctttgaaagaagattggagagggtgggaaaggggaggagggagccctgaaaagaggtactaaggattaggccatttgtcatctgactgtcattagcatagcctagtgtttgcatgctttttaaactaattgtcgttcattttcacttatctttaagccagtaggtcactggctgtttataaaattcatcagaggaaacattctcagacatttacccaactggcaagtcgtgctaacccgaagacccaaagtacccctttatgcaaaataggatccaaagctaaggctgggtaagaatagttgtgcagggagggagcacgagatgggcagagctggttcctaccactccattcacacagttcatcagttcattcccaagtatttattgtcacccccaaacatctctggagtactactgctcaatttttgtgtcgttatcaggagtataccttggctcttcctttttttctcctgcttccccccgcaccttgtggggaagcttcaggggagcgggggagggtgattcccagtggtggggaaaacattaatcaaggatacttgcatttagcctggagccccttcctcattatgctttagaatattcataggagttccatttgtattctggctgggtgatgagcaaaaaaaatatatagtagcaaatattctctcatcctttagagataaagaaatggtgttcatcaaatgtactgagaatagactagcatttgtggggcactcaataaatttaaattcatggtgacagtgaca

SEQ ID NO: 4929 - DNA, 49496 bp, human
cacacacacacacacacacacagagctgctttgtccgctgtgaggttggaggtttggggactctgtgcccactaagctactttctatttcaagtgcctgtatgtctgaggctgggtttgaagcctccagcgtgtttggagttaatccccattaggttggactccgcccctttctcccaaaggtaaagcaaggttttcaggcatcactgcaaagggcagctagtattcccatccttgtctaacaagctgtaaggagaagttgtttctgagatctgagcctgaagagagggaacaagtcagtcagccttcgtggtcagaaggtaaatatgcaacttgggccaaatgcaattcaaacagctggataagaaactgctttgctctccccttgctcagcccccccttctccccttcctttctcaggtttcctgtcctttcatctcaaagctcagagaagccgttttctacccgagggcagcctggtgcttttttatttcttcatagtccgttgtttgcacagaggctaagatgaatcagggctggattcctatttcatattgacaagatttgaggacctaagggttaagtgctagttggtttccccaggggagttggtaacctgaggagatgaagtgcctgtttctgggagtggagagagtgattttgttatgacctgtctatacaagtaaaaatggatccggtttgctaatgtggtaggttgatctcctggatttgcctaaatctaaggggttatgcgacggaaatggggtaatgaagttaaactgaaatgcaaatattgaggcctctcaggctggaaataaaagaatgcatccatttggtaaatatttatgagttcctactatgtgccaaggcatgacaatttccagaagaacctgaaatacttaaactataaatccattcttgcaaagaacacttggccaagtggtttcattttgtggtggggaactgaaaatagaatgaagcctaggggtgaggaaaaatcacccatggagtggttgtggggagagaaaggggaaaggagagatgttctaaatcttaggtggtttcaagtcttttccattacttatgagagaatagggtcttttctggtagaaagggagagaattgatacctactctggtgttaggtatagtgcagatgtttcacttgaattttatgcttaatcatttccattttataaatgaaaccaaaactcagaggttttaagtgatctttttatgtgcatatagcctgtaaggggcagacctcaggactctgtctctgatctgattccaaaattgtgacttttccactaaaacagtattcctcaatcattagttcccattagaataaattgaggatttttaacaatatgaattcccataaattcgaattcagtgaatcaaggagggggtgacatagtctgcattttgaacaagcattgaaagtgattctgaacaagcattgaaagtgattctgttgagacaaacattcttgatataccatgctgcctctcaacttctctgaagtgattggaaaagcaatcagcccatcttcttcccatatgggccagattcactcaatagaagtggtcagctgtggtgacattttattcccagcttatacaatggagtggagagactaatgggcaacaataacagggctggggtttagggcttaacaatgtcttgccagggatcttgataggggtagtttctaaccagctgagagtgtgagatagaactcgtagccaaccagcttatcactgaagatgatggcacctgtctagccagaataagaactgagatgaagatctctcattggtacctcacttttaaaatcataggatagatggggagctcaaggagcagcatcttggggagagggaaggagagagaagctcatatgaaatttggggaggttattccagttcctacctttccagtctcaaactctggagaaaggaaatagcccagggcctgatgtggaggttctttttatgagctctctttgtctctgcatggtcaaatatatttatttagagttgatcatttcaaagttatcaattgctcagttagtcctttctctccacttagtctctggcttcctgccttttaatgccttacctgcttgtgagcattcccacctctggatggagagatgcaaataaacacataaactcacccaacacagttttgctggtctttctaccccaaactaaaaaaggagggaaggaagaagaaggcccagaaagaagttcagcaaacatgaaatctgaggaatttgaaataaaagacacaagtcaaaagagagatcttcttagagtcaccaagatgagtgagtacatcatgagatgatttcaggcacaggagaactcagagcacttctcataatggagatagccagaggagaagaaacccctgagggagacaggtagcagaacatgaggagagaaatgtttggggagtagcagtatttttttttttttttgaagctttgtctgaaacagaaagatctagcatggtcaggctgcttatatacccaacttgatataaggagtcacatcggtccaacacgtttctctggagcaggactctatttacccactggaaacatatgcctgcatatctcattcatttcctagggaagtctcaactctgagtaagatgtatttgtaacaggattggcaggaagacaatgcacactgtctgggggcgtgaggagaaaggcctgttcacgttcctttgccaacaccagtgccaagaaagctgctcttcacagaccagtcctaaaccagcagtcttgcaggcatgtttccctcagcagctgttaagtcactgactccctttcttaccacttcatgttctagtctttaatttgcttactgttttgcctgtaccctcttaccctgggaaaggcagtgctttccttaactcagaagttgcacaacaagctcaagtggaaacaaaaggatttgtgtctttttctgtgggtactggggaggaggtgatacaggaaggaatagctttgtttttctccaccaagagaaatataaaagcaacgtttcactttcattgatacttcattgtaagtgcccatacattagtaggtatacaagaaagtgaaaaaagtgagaacaaatgattaaaggcttggcaattggacaccacagggagagggagaatgctcattatggggaaaaaggctaaaggtctcctgctagcaatctgagttgatgaagggctctcatttggaagatggtggctagctgttctccattacctctgaggacccaacaaaaggatctggccttaggttgcaacaagaaaagtttataaaggcatataacaaattatttattgacggtgagagttgttaagctactaagagatattatagatttccctttcctagagttctttaaaagtaatggagataaccatttgccatgtatggtttaggtgggtttcctgcatcatataggttgaggtgacttctacccacgaggctgtgctagaatggctagcattatctctaaagatgagcaaacattaggctttagtaaggatagcaaattcagaacagaactcatatttttatcctatttattacaactttctggcaacatccactgcatctcatacaaccaatctcggaaacaggcttgcggcccatctagcagatttaaaaacctgaggaatgagggataatgtgacacctaaagagagaggttcaactgcaatcctatcaatgcctggtaacttgaccactctacaagagcatcagggtgagttcttggttcctgaaatccagtgtggctgtttggctggatattccaggacagggaaacaaagctgttacatacatgaagtatacaacaggaattaagatagaataaaatatagcattgtttgtgatttctagttatgtaaatataaagcgacttaaccggtttctgggaatgaacttggattgctttggagggttgtcatgaaggagattactccattgcaggtggcataactaaaagcattttctagaatacacttcactgtccaccacatgtgaacataaagcagtgtgtgaacagactccatgtgccctgcagcctctctatccagccacaagggaagttgggctgagactcatattgtgttcagaagctattaagtaattggatctctgagatctctttcttgattgcgttcaagtcaagtcgatgatttagaaaggtttgcatttaaagtgtataagcttcatatcttcaatgtttaattccatagtcacttttaactttatattgtttgagtcctgaaaagagaatattagagaattatctgtggcagtgattcttaacctgctgtccacggattgtgctagcccacaacatctctagtcctaaatagggtgaccatttcatccaaggttttttgggactttcctggttttatcactaaaaattccacatcccaggaaacccctgagtcccaggaaaactgacatagttggtcaccctagtcataaatgaaataaggactatgcgtttttcctaaagttgaaagtacttcatctaaattctgaaggacaatgagtttttctaaagctaaacacatttaatttaaattgaattttgagaatttgtcttcctatgtcttggcttcaaaacgtcgcttttaaactgaaatcatggtgacagtagttgatagtattgtagtttaatttaacagcttcatttgtcacaggtgaggacaaccatatattacaacccctcccctcatttctactgtagtcacggcactacacagagatagtccgttcctctgccttaagttctctgcccctcctactggttgttatattgggactttttaaaaaattttatttttccataagttattgggggtacaggtgatatttggttacatgagtaagttctttagtggtgatttgtgagattttggcgcacccatcacccgagtagtatacactgcaccgtatttgtaatcttttatccctcgccttccccccaagtccccaaagtccccaaagtctattgtgtcattcttatgcctttgcatcctcatagcttagctcccacatatccgtgagaaatatgatgttcagttttccattcctgagttacatcacttagaataatagtctccaatctcatccaggtcgctgcaataatgacttctttttctctaggcagatacccagtagtgggattgctggatcaaatggtagttctacttttagttctttagggaatctccacactgttttctatagtggctgtgctagtgtacattcccaccaccagtgtagaagtgttccctgttcactgcatccatgccaacatttactgttttttgattttttgattatggccattcttgcaggagaaaggtggcattgcattgtggttttgatttgcatttccctgatcattagtgatgttgagcattttttcatatatctgttggccatttgtatatcttttttaataattgtctattcatgtctttagcctactttctgatgggattttttttttcttactgatttgtttgagttcgttgtagattctggatattagtactttgtcagatgtatagattgtgaagattttctctctctgtgggttgtctgcttactctgctgactgttccttttgctgtgcaaaagctctttagttcaattaggtccccgctatttatctttgtttttattgcatttgcttttgggttcttggtcatgaaatccttgcctaagccaatgtctagaagggttttttcaatgttatcttctagaatctttatggtttcatgtcttgggtttaagtccttattccatcctcagttgatttttgtataaggtgagagataaggatccagtttcattctcctacatgtggctagccaattatcccagcactagttgttgaaaaggatgtcctttccccactttatgtttttgtttgctttgttgaagatcagttggctgtatttgggtttttctgggttctctattctgttccattggtctatgcgcctatttttataccagtgccacgctgttttggtgactatggccttatagtatagtttgaaatcaggtagtatgatgcttccagatttgttctttttgcttcatactgggacttttcatctccaggtgatgatgtccatgagggacattcggagttagttttgactacaagtgctgagattgaaagaaattatatacttgccctgatggtgtttgcactatgtctggagaaattgggtttccttctgtcttcaatattttttgaaaatctctatgggaaatcatggaggcttttaattgtaatacttttggggtaatactgtaggggaaggcttcaggtaaaagaaaagtgagaaattatggctttgccgttgaatcactgtgtacccttgggtaggtcgcttgtctttctgaagcccaatttgctcatttgtaaatttaggataatatctttcttactaacctaagaagaccgttgggcagagcacatataataatggatttggaagggattgtgatgacacagctaataactgtttgtcagcttgtttcctctcctcctctggcctgggctgcttcatcaggaaatgagtctgtaatggagggctgcttgcactttttgtaatcttacaaactctaatacaacaagcagaggcattacctcattgcggccaaccatacctgctgtctaacagcaattactcaaaactagttccacttctccccctgttgcctttcaatccctcatcacatctttctctcatttctcccattctcagccacaaagcctaattcccaggggcccagctcagggcactttcttcccaagccctaacattccagagtaagcacctgcaatttacgatctctgctcccttcctgcacaaaacacgtagcacaaaatacatatgtatcaataggggaattgtggttgagtaaaaaaagagcattatattaagaatcaaataactgggctctgatctggccagtgtacctcactagcccttcacccttgagtaaatcacttcctctccatattcccacctgtaaagtcatggagagggggtagtttaacattgtgtggtagaaaagtactggcctaggcatctgcagatcaggtttcaggttctgatgttgctgcttgctaacttactctgtgacttgaagaaaatcacttcctcctttactgggcaaaattctcccatatgtaaaacaagaaggttggattaaatgattcattaagttccctacccatctggaaattgaatgattctatgaaatgggtttcactaaacaaacttgaaatggactgcctgctctgtgtcaggcactgtttgacaatggttgtgaaagggctcatgactgagaccctgagacacttagtgcctctgctgcttgttcctgtcagtgtctaaaattggcaatgtggcgatgaccccatacagccagttcctgcgcttcccctgctttgggtcccccaacctccttcccagtcctctacaccaccacatataactttaagtaatggtggtgaatcatggagaagtttttgaaacatattccaccatctgcctgctggagacattcacagtgctgtcatcaagctgcagtgtggtctctagccggcccaatagagaaacaggccagaaagcaatggcagattaatggagttgggaggaaagtggttgatttttgacagaggggtctgtgaaaaccatttgtgagctgagctgaagaactagatctggaaagactctcagcgtcttgattacaagattacttgttccaaaagggaccttgaaaggtccttacagctatatgttcctgctgcaaggtagggagtgcctgatcctgatctatttcagaactttgagaagctttttggattatatccagcaaaggacaaggaagcttttcttaatagccattccagagataacctctcctggttggaaagttgcctcccattttgattgtgggaaaagtgactgatcagtgctctctcagtgacaagtatagggtatgagactagacactccttattttattctatccatttaaacctggctgatgcatcccagttgaaaagcgcgcactaacacactgctggacatgttacccaagtcaaatgggaacaacctgtaactctgtggcgaggtctctttccctctcaccccttatagtaggggcgggtcttgataagttgtcttccttctccttcactcactgaaaacaactttgctcctgatcctcttcagatattgcctccttccaagctaccaggccaggaagtccattcagctggaagccgggacagcaaccttgttttcatttaggctcctttcctgccacttgttccacgatgtatgtcaagagttaaaagctgtctgatccggctgtatttgaattggcagagcagaccctaattcagttatctggttcctccattgcagcctaaagaccatagaactctaaatcaggcagaaggaagggaaggtgggaaaagtactgaaaagcaaaatcccacagggatccaaatggtcctcgagagaataatcttatccagaagcaatgaccaagtggcacataattgagccccaggactggccaaccagatgaaaaataggccagtggagcctacatggtaacttactgcatttggtgctgtgatccaactcatctccccatccctgcagagaaacctgtgaccatgaggagcagcctgaccatggtgggaaccctctgggccttcctgtcccttgttactgctgtgaccagttctaccagttacttcctaccttactggctctttggatcccagatggggaagccagtgtcattcagcacattccggaggtgcaactaccctgtgcggggagagggacacagtctgatcatggtggaagaatgtgggcgctatgccagcttcaatgccatcccaagcctggcctggcagatgtgcacagtggtgacaggtgccggctgtgctctgctgctcctggtggcactagctgctgtcctgggttgctgcatggaggagctcatctccagaatgatgggacgttgcatgggagcagcgcagtttgttggaggtaagactgtgcttctgggattgggtaggttgggtagctttggggcagggaggagtggggagtgtagccttatggggaaacccattctcacccccttcactttgtccaactctaaggctatgaatgaagtctcctttaaaatatttagtctaggacttcccaaagtgcaatcaatatcagagttttattcacagcaaatttggctagtaggcagaattgatatctgttgtttaccctctatttttgtcaccttcatctgcctgcaggttgcccatttaaaaacattatctattaatatgtctgccttccagagtcagcaacatacactgtagtattactgctccaacataaacttaatttctaggagccctgctctctggtagttatctcagagaacagtgatctaataaacacatacacacaggtgcaaattactaacagttctcatcaaagaaatacacctctaatagtgaaatgttgtgtaccacaaaaactgtagatgactacttatctggaccacatctaaggctagccctgtctggcagctattagcagtctacccagatttcttgtgaccttgacccaccttacttgtccttcccctcattcaggctccccctaactttagtgcagggaacctgagatattggcagtgtctggattggctagaaaagagcaaaatgcaaaaatggcagacttcaggaagacagtgacagctgtataatttgaactgtctgagaagaaaaaacaaatttagaaagacaggaaaacatatatgtgaatatttgagtattttgcaaaacctagattgggcactgggaaaaagtgctggtagaatctactgctgaagtttgttgttacagagttttagaattattacccaattcattatcattattatctccattagcatgacagtgtgggtcactagagccaggaaacttggatttcacttctgtttttttcaccaagttgctctgtgaccatagtgggaaaatgacatgacttttcctatgcttcacttcctttgaatttgtcccctggtgatatagcccagatctgatctttctttcttctgtccaatgactgcattcatgtggccttggagtgagatggcagtgatgagctaagacagtgggtctcaatggggactacttttgcatgcccctcccccctggaagacatttggtaatgtctgaaggcattttaaattgtcacaacttggggaaggtcctactgacatcaagtgggtgaaggtgagggatggtgatgaacgtctacaatgcacaagatgaggacaacactcacccacaacaacaaagaggtatccagccaaaatgtcaatagttctaagtttgagaaaccctgggctaggctaccaagctttcctggcttgattatgaaaagcatcagattctgtttgtgataccaattaaagtgatgctttctggtttcctcttttctcagactagctgtaaaagttttaaatctgaattaccattctagcctccgtcatttctaaaatttttcccaccgtttagccactgatgggtttttagccacattggaatgtacaattaagttagtttcttccctttgaaaactgtaatactaaaccagttgctaaggctgatctaagccaattatcttagctggctttggaagctccatgggtattacaaataggtcttaggcttacctttcacttttatttttaaacacgctataattaactcagcactgctatgaacacattatttcaggaagtgacacttggctgatagggcagaggggtcatccttgcaattcatatttatagccctggagcccagttccgtgcctggctggcacaaagcagatgttcagtaactgtagaaagaatgaatgcatggctaaggcaatatctagcatatgttgggataaactgaatatgtgagagctggattagttcacatcctttcctctttttccaggcttccatgcagggctgttagcaccctgagctctcttctcttctgacaaaagagtgacagtttagcttcacttgtatttctaagagtttccagcagagtgaggaggggctaactgtcaggaatcagaaagcctagcaacagcctccatcagattccacacattaaagtggctcccatacccccaggttgcttcctcttttgggctcaactgagactttcacaaagcattcataattctccatatgatgcatttcagttgatttcacctactaggtatagaaactcaaaggaaattgttgataggggatgtaggaaggtagtggagatttggatattcacaggttaggcgggacagaactttgagtggcaggtgtcacatagaggaaataaaaacacgagcatcattttagtttcacatgattctgccattctatatccacgtgagccttgctcataggaacatagtcacagtgttcacatgtagatgagggtctttaaagctgaagaagaaaatgccatttggcagtagtcctacaagtcttcaagaccctgggtgtgctatcaggtttatccctgggcaggggattgatattgggacagatcgctagacctccacagcttccccatctgtaacaccagccaattaagaaccattcctgcctcctttctagagactggtggctgtccaggttatatcagatgtgaaagaatggtgagggttgcttggatgaactcactaggagccccttgacatatgactgtgacctaaggatctttggacatcttcggcctgaccttctgagacaggctttgccagtggaaggaaaccaaggctgggcagcattttgggccccatggataaagacacaagagaaagagtttgggggattaagttcaaacttgtgtagctgaggggaattgattttgttgcttcaggtctggctgcttcttggcagctagcgcattaaccgaaatacattgggggagtagtcaatttttgtcaggtctggtttctctctgccagaccccaaaccactgaagagatggagtatccattaagaactacccccttcccctgcctgactcttgctccccagtttggcggctgcccacagagatgagtggtgggaagtgggagagacaggaagaaataaagagctgctggcctgactcatactcagcaaagtgacctgatggggcccatgggtcccatttgctccacctgtagctgatccatctggataagcccagggtccagagagccttccactgggacctccatgccctgctccaatcaatgaaggaaacacctggccaggagattatgtcaacactggggatgctgagatttctaaacagctggcccccagtccctgagaacatagccactattcacattcccctgtttatacatatgcaagatgcttatgagatcctctatcttcagtgagagctaaacaaagaacaaataggtgagtagtacacataaggaacttcttggcagaaaaacaatgtaagatcttgaatcaggttactcatgggaggccaagaatctttctcgaccaaggaatgtatcagaatcacctggggtgcttaaaaatgtgagctttccaactctctggtctcgtttcccattctgatgtacacaacaacaggtgtaaggttgcatatttagtcaaatctccccagtgactttgatgtgtatgtgtgttccctttccccagcctaagggaggatcactaccctggacattatttttttgttgttaagagaacagcattcaacacaccagtgcttttctccatgtaaggtcctaatattacatgcttcaaactgaataaaagttgccattggagacatatcactgagaacttgatttcaggaagagtgccatgtttctaaaaaccatcatcatctctggaaactatttttttcctggaaagtccttcagagttttaccagatatcattttatttatccttaccatgctgagaaaggattatgaaagcgattttctgtttgggaagtggtattcaaggaagttaacccactagcaaagacttatgtagcaaattggagcagagctgggaatatggtccagtgctcctgactctcagtcctgtgcttcatacactgatgctcttgaattttttttcttttctcttttggaaaagaaatgctatcacagtgttttccacagtggtccatgaaccgcttggattaagaattacctggggtgcttgttattacagattccttagtgctgcagactgcaccagtgcctgctaaagtgcgtattacacaacctctcatgctcatatatttttgaaaatatattatgaaatatttcagatgtactcactactctgtgtaagaaatggaatattagcaatatagctgaagcctcctttataccctgatcacattcccttgtccccactgaaaaggtaacaactgtctgggagttgttatttatcattcactatcatgattccagtacacactaaaatttgagaaactctgctcagccttgtttagggtgttgcttctttctggaattcccttttcttctatccctccctgtaaatatctacctatctctcaaaggccaggtccaatgcagcccttctgtgaagccttccctgatctacttttgacatctttagcagatatgaacgatcctgtaactccaagaggaatatggggtagaatgaatggcgggggctgggggggtggtaagtgaaggaactccctaggaagggaaagctgagatatagttgaaagtcaggcttgtaaattttccactggtttgtgtttgagtcgaagttgttataataacaaattaacccatactaggcttctgctcagggcagtaaatccaagctacccaataattatgtttggaaagtaggattggcagctatgcaaagacaagggaattgagaacaagagcaggaagtttaacaaatgcccacccaacagttgcacttgtgaatagtggaggggtgtgcaaagggagttggtaatacccaatgaggaggttatccctgccagaagacaaagattaggcatctacctatttgagaatgtgtagttgggagaggattatatagcagctgggatatgggcaattagtaatgctgggaacaggggaaagttgaaggcagctgtggtgtggctggaaggagggctccaagttctgtctcagattttgcacctgaaggtgtgtattggtgtcccagtttccacaagggctgaagctgaataaaatgtctaactccagccctcttcttggtcagctcagtaaattcaaaccatggcaactatgtcggggagaacatttggtatgttttgtgataggggattcttagggaggggagcagctgaggaagagaaacaaaatggcagcctattggacatcttcccacgtgtagtaggggagtaaagacagtaacacactctaaaggctttcttttccttcctagaggcatgtgagattagaaaagttcccagctaagcatatgcagttgaaacagacttcttcaggcctggcgcggtggctcacgcctgtaatcctagcactttgggaggccgaggcaggtggattgcctgcgctcaggagtctgacaccagcctgggcaacatggtgaaaccccgtctctactaaaaatacaaacattagtcaggtgtgatggcacgcacttataatcccagctactagggaagctgagacgggagaatcgcttgaacctgggaggcggaggttgcagtgagcggagatcgtgccattgtactccagcctgggtgacagagtgagactccgactcaaaaaaaaggaaaaaaaaaaaaaaagagacagacttcttcaaggggcatatgtggttggaggggaagtcaaactgggagttagcaatgacacagaagagaagtgagagccagggctgcagctcatatgtggcagggctgggatttaaacaagttttctctgccaccagagcttctgctcttaacatttttagtggtgtttttcttaaatgttggtaccaggacaagatacgtccacattacagggtgcttttaaaatgcatattcctgggctgcagttactgaatcaaatacctggggctgaggtccaagaatccacatttttaatgaacctccattctttcagaaggtggcagggactgacacttgtaaatgacttccctgttgctacttgaagcacatcttcacaactccaaattaatgagaactgctggagacaaatataattgagaatgaattactctatgaatccatttttatttttaatgtgttcccaggggcatctttctccagctatgataaaatgtaatggaatcagctgtcagttacaagtcaaatatgtccatgaagtatgtttacaacctaatgtgctcacctgtctaaaagggaggatggagtactggggaagatggcgggggtgggagggcaggttgggcagagcacggagctacatgcactagacctgaacaaatgctttgcagagattcctgttctttcagcgggtacctgtgcaaaattgcaagataactccaacaaggcagcttttgaatcaagccctgttcaggttttgactttttagctgtttgttatgaggttaaagagatgaggaagaaattagcatggagaacacaggtagaaactgggagaggagccacagggagagtcagctgtataagaataataaatttttcttgagcacttgctatgtacgaggcactttatgtatattaattcttggaacacctccataaaatacagtcagccttccgtatctgtaggttctgtgtccacagattcaaccaaccataactcaaaaatatttttaaaaatccaacaagaatacaacaactatttacataccatttacattgcattaggtattataagtaatctagagatggtttaaaatatacaagaagatgtgctaggttatatgcaaacactacatcattttgtataagggatttgagtatgcacaggttttgctatctgcaggggtcctggaaccaatcccctgtgaataccgagggacaagtgtattattattactctgattttacagatgaggtgaatgaggcacagagaaattaagtaacttgcgtaaactcacacagctttcaggtggcagggctggaatttgaattcaggtctagttctgcagtctgactacagaacccattgttttaagccaccatgttgtgctgcaactctcaatctaatgcctagcaaattcctagtgccttgctagagatattgttgccaagaggtaatcatcccaggacacatgtctctagaaggacagagcctctaagggttgttgatgatctctttgatcggggaaaaagggcattgctagttactagctatgtgaccttgggtaaatcattttccctttctgtgtttcaacattcacatctgtaacaaggagagattagcgtaggttatgtccaaaaacgttttcctttctattttttttttatggtgtcagatgtctgggatgatttcccagccctgacatggaagtcccttcagaagggactttccccttgggcagtgtgggcaaaggaagctgtctgttatatagactgtgcatactctgaaacagatgcatttatcgagtacctattatctaccatgtgccaaggacacagaattgaagataagtatgtctcctgccttcaaggaatacacactctagtgagggaggcagatgataaacttttgtaaagaatatatattacaggctattttagtcacaggagtaagcactgggtgctatgggaacagaaagaaggagcgtgtaatttagcctgggggttggggatagcgagggaagacttcctggagaaggaaatccttgacctgggctcctcagtatggtaagatctgaggggcaggggtctgaagaagatggaaggttccctctactgtgccaagaaaggcacttggccagctctagtttccgcttgagaaggcagagttcgtgccagtcccagggatctgaatgtgaaggttagaaaatagagctggtgttcttttataaacttgtgttcttttcttcctagtctgtgtgggaaaactcagtctttattaaattttccctcaaagggtatatactggcagcaggaaaaggcttaggtttcatttctacttttgtccttaacccaatgtgcgtactctggacgacctcttcatatcctaggatttcagtttatctgtggaaaaaacagggggtgttgttgtattgccactggatgaattccagggcctagaaaggtctttgagtgaccagtttcacttcctgtgataccacgagacagataagaatgctttctaattttaagcattccactgaagagaatttctaaccttaattggtcattgttttagtttctaaaaccattctcactgtcagtaaattctccctattttcttatttaaatccttcttgctatttcttaaggtccttctcttcttctgcggcctcaatgagtactgagaaaagctagttgccgtggggcagccaagcttggaggctactttgagatcttcctaaaggattcatctgaaggcaatatgagtttcttagagtatatatggactcttcctcagtgaggaaagagaagtgaagatgaagctggcagtccctagagcagcccgcttttcactgtccagttgagccccagagctctggaacctataaatatgctattcattcaccattgatcaagcagctgctttgtgatggttctgtgctatgtcttactttctgtgtccacattcatgacaagtgtccctcccatgttcattagtgtggcacccaagtatggcgtgattgtaattaggctcttttggttgcaagtagcagaaactcacttgagttgcctcagtgaaaagggaatttattataacataaggaaagtagatttggaaagccatcaggaaggcctggcttctcttttttctagcagtttcactgacagtatggagtttttctcatggtatgtctgtttcatgtcactattctcctctattctctccctctaccaatcagtttgctcagcttatccagaattgatactcactcataactttgaattgaacttggctttagcttgacacagacttgattctaccttctggtgttgtggggttgttttcaacttctgcattatctgttaactagctcagcatctttatgattttttcccctccatttttaaacagactagtcaagtgcagtagtgagaacggggaaagagtagaacaataagttcaatccataactgactgtgaacaatcaattgagacaactcactaccttcagaccagtcatctttatgcttctcaattaaaaattccagaaacaagaaactagcccaggtcacctcttcatgccaggctacaatgtcacccatcactgaccagccaatgaatttgtcttagttgtcagatgccaatgcttgatacaatcctctgtggccagaggcagggtaagagccgtaggatataaaatgtgaaaacgtacgcagcaagaaaaagttgtgagcaacatagttgcccttagaaggcagtgttggcaagcagacccagatttgtatctctggttggaagaataagattatcactaaggtacaacaaaatttccctgtaatgactaaaaaacctaaataaaagggccttcatccttttatttagcgtaaggcgtcatggtgtaaggcatatggaaaccaaagaggggaggactgcttggtataaagctggaatgatttatcgggggaggagtgtggttccctgctcatcggtccagcagctgactccaagttacaggaatcattacatattttcagctggtagggacctgcctgatgtttagaaacagctggattttgggaaagagtagtaacatttacattgttattctctgtgtatcagaccaaggcaaaagaggttggaaaagccaacccagccttgtaagtcattgacaaaagtattttggctgtaaaaagtatattggcctgtctcatttttcaacattttttaaatttatgagttgtcccctctgctacctattacactccactacctgtggcatggccaaaaataaaatcctgttgagttggtactctcatagaaatttagggtaaagggggaagtgtaagctcagttgaggaggcagaatttgagctgaactaatccaaagggaatgttggggtgacagaagacgttatattttttctgtctgtgtgtatgctttctttctagggctgctgataagctcaggctgtgccttataccctttaggatggaatagcccggagataatgcaaacatgtgggaatgtctccaatcaatttcagttaggtaaggtggcctgggcagatggcagtgatggttcatgggaaatgtgttttccaaagtgctttaccacttggagggcactctgctagtggtacttgcctgaatctctctcactgtgttagcttatgggaagtggtagcttaactcacaagagttggctgtaaattccccttctttaactatctctccatacaatttatgcagttttgcccggggacctatgaccagtttagggcaaccctatcttcagagggatttaaaatgcttggagactaacaatctgccatcttctgaataaatcctagttcctactggtgtttccttctaggcaccatttttcaaatgtaagtcaacagtatcgtttgtcaatctccactgaagatgtaacacgaggttatttagtttacctgaagcatgaggaacctagataaatattcaaaattgtttctaacggcaagagctgttaaatattagagtaggtgacagaagtagccctgaaccattctctggttgccagttttcactgagaatgtctcaggttcactattgtgagttgataatatattagattctaattggaagacttcagaaatattcccccacctatcatgatgaaagagagtaggagagggaatgtctaggtttccttgggtattctcaattgtacaaaaggatttgggaacaacaaggccatccaaccacatatagcttgtgctccaatacttccctttctctctgttgcctcagattgatttttgagtcttgcttgactcatttttgagaaagttgttccctgtgcaaacataacatgagggaaggtgtaactagtgtggatgctcaaatgtccagtgttcttcactcaggacaaggctgactggtaaacataatatttctgccatagataaaagaatgagtaaatacttggggcaggtgttgaagaaagggaagcaagccactagtcctgctagctggggtaaaagctaaagattcagcaaatttttcctagttggttgtgggactgattctactttttgaaaatgacagtttcgttgatatataattcttatattatcaaatgtacccatttaatgcatataatcaccgggttttagtataatcacaacattgtctaaccatcaccactatccaattccagaattttttttttttgagatggagccgccctctgtcacccaggctggagtgcagtggtgcgatctcaggtcattacaacctctgcctcccaggttcaagcgattctcctgactcagcctctcaagtggctgggactacaggctcgcgccactacgcccaactaatttttgtatttttagtagagacagggtgtggaggaggggtttccgccatggttcaaactgctgacctcaggtgatccgcctacctttgcctcccaaagtgctgggattacagggagccaccgcaccctgccccagaacattttcatcagcccaaaaagaaacctcttacccattagcagtcagtgactatttccctttgctcccagctgctggtaaccactgtcaatatggatttacctattttggatattttatgtaaatggaatcatataatatgtgtttttttgtgtgtctggctttttcactgagcgagaagttttcaagatgtatacatgtagtagcatgtaccagtactttatttcttttcatgtctgaataatattccatggtataaatgtaacacattttatttatccatttatcatttgatgaatacttgaattgtttctactttttggctattattatataatatttctataaatatttgtgtacacatttttgtgtggacatattttcatttcttttgggtatatatctcaaaattgctgagtcaaatattaactctatgtttaaaccttttgaggaactgccaggctttccagaatgactgcatcattttacattcccaccaacaatgtacaatggtttcaattttctcaacatcttcctcaatacttattttccactttttgttatagctgtcctagtgggagtaaagtgctatcttattgtggttttgattttcatttccctgatgactgatgatttcgaacatctttttgtgtacttattggctgtttttacatctcctttggagaaatgtgcattgaaatcatttgcttggttttttttttttcttttttcttttttttttttgttttttgagatggagtaacactttgtcactcaggctggagtgcagtggtgcgatctctgctcactgcaacctccgcctcccaggttcaagtgattctcctgcctcagcctcctgagtagctgggattacaggcacctgccaccacaccctgctaatttttgtattttttaggagagatggggtttcactatgttggccaggcattcttgaactcctgacctcaagtgatctgcctgcctcggcttccaaaggactgggattacaggtgtgagccactgcaaccagccatcctttgcttatttttaattgggttatttgctgttgttgtcctcgttgttgttgagctgtaagattgttttatgtgttctggatacaagaccctttttggatatatgatttttaaatattttctcccattctgtaggttgtcttttcactttcttgatgacattctttgaagtacaaaaataattttgatcaaatctaatttatctattttcctttttcttttttttttttttgcttctgttttaggtgtcatatttaagaatacattgataaatccaacatcaaaaagatttacccctaggttttcctctaagagttttataattttagctcttatagttaggcctttgttctgttttgagttaattttgaaagtggtatgagatataggtccatattcattcttttggatgtgaatatccagttgttgtagcaccatttcttgaaaagtctattatttcccctcattgaatggtcttggtatccttgttgaaaagtcaattgtccataaatgtaagggtttatatctggattcttcgttctattccattgatatatatgtgtattcctatgccagtaccacactgtattgattatcatagatttgtagcaagttctgaaatcggaagtatgagttttccttctcttttaatactgctttggctattctgattcctttgcatttccatcggaattttagatttagcttgtcaatttctacacaaaatcaagctgatattttgataggaattgtattgaatctgtagattagtttggggagtattgctaccttaataatatgaagttttccaatccatgaacctgagatgactttctatttagttaggtcactttgaattcctttgaatgatgttttgtcattttcagtgtagaacattttcacttatttggataaatttgttcataagtattttattgttattttttaataagtaaagcaggcctattaacacagaattgttttatgcttttattttattttaagattccttattgttattatacagaaataaagatggtcccccaacatactatggtttgacttatgatttttcaactttgcaatggtgcaaaaatgatacacatttagtagaaactgtacttctaattttgaattttgacctctttttaggttagagatttggagtatgatacacttttgagatgctgggccacagtagtgagccacagctctcagtcaggcaccaacaacccatactctacagcatactgtgttgcccagtggttttgctgaactgtaacattataagtgttctgagcacctttagggtaggctaggtgaagctattccattcagtggattaggcatattaaatacatttttgacttacaatatttttaagttacaatgagtttgttgggatgtaaccccactgtaaattgaggagtatatgtacaaatgatttttgcatgttggccttgtatcctgcaaccttgctgaactcctttattaattctaataacttttaagtgtattccttaaaattttctagatacaacaatcatgttatctgagaatagagacaattttacttcttcctttccaatctggatgtcttttgcttgttttccttgcctaattgcccttgcaagaacctccaggacaatgttgaatagaacttgtgagaatggagatccttatcactggtgttagcggtaaaatatccagtttttcatcattaagcattgatgttagctatgttttttttttaatagatggaggacctttattaggttgaagaagttcccttctattcttagtttgctgattgtgttcacaatgaaagggtgttggagttaatcagatgccttttcttcatttactgagataatcatgtaatttttgtcttttatcctttcaatatgatgcatttcattgattgattttcatatgttaaaccaaccttgcatttcttggataaatcacagttggtcatggtgtataattcattctataccttgctggatttagttttctacgattttgttaagggcttttgcatctatatttattagggatattgacctgtatatttcttttcttgtgatgtgttcattgacttttggtattaaggtaatattggctttacagaatgagttcctatgattctactttgattaaggtaaaatgccaaagtaaaaagttggatatgtgatttgcatggagattaccaactttgttttttgccctaatcaccacctaaggacctagttcataaatgagtagttctgggctgagtgcagtggctcatgcttgtaatcccagcacttttggaatctgaggtggatggatcacttgagcccaggagttcaagaccagcctgggaaacatggtgaaaccctctctttacaaaaaataaaaataattagctgggcatggtgatgttcacctatagtcccagctacttgggaagggagatacacagagccaaaaaagaaaagacatggtccctaccagaggaataagctttttaccctgacatggttcagagagatgaagaaggtagggaggagaatagaggcgggcattatcaatccatcagagtaagtaaaaaggatttaccactctgctactctgataggctttctgcagcctcctatatgaagagatcacattcatgtcttcaacctatcttttcttaggttttcattcaagttatcctaaaccatccacactattttttagtcctaatttgaatgatcaaagatacaacttatattaaggcactgatcttgatgtctgcattggattaaagatagccacaaatttcttgatacttttcccatagagaagctgggtctgtctccaattcctattccccaaatcttcactggtgtacagctgctttaagttaatctaattacatctaattggatcattagacttaatactctaattagcttcattatagaagataaatagagtatgacagaagtgacatcaagcttattctaggcctgtggtctaaagaacttgcagtttccttcttggtctcttggagctctgagtcatcatataaaaagtttgactatcttggagagaccacatgggatttccaagagttacttaaagacagaaaagttcagctagtacagccattcctgccaaggcactagacatgtgagtgaagttgttctgaaccctccataccggttaactgaatatcactgaatgacatcagttaatgccatttaaagtagaagaattgcccacctgagctctgaacaattgtgaaaccatgagatataataaaatggttgttttaagctgctgtgctctgaggtagtctgtcatacaacaatggataaccagaaaaatgccaaaccatatttcagatcgttattttaaataaaaataattcatgtatgtgacaaaataaaacaatacatatataaaggtttaaaacttaaaatcagtctttttttctgacctcgataccattccccaaaatgaccattaagttccttttatattctccagaatttttaataaatataaataataaatataaacataaatataaatataatttttaataaatataaaatattttttccaatatttgttccaatatccaatgggatcatattatctagctctctatctatctagctacactgttctgcaccttgcgtttttcgcttattcatatctcttgaaaacctatcaatgtttatagatcttccttctatattttaggtatgccatatttttccattgcagggataacataataacatgctctgtgagggcatagatttttgtctgtgttgtttattgctatctccccagtgcctgcttaaagagtaccaaatagtactgaatatttgttgaatgattgaatcatatgatcattaaccacttctttatgcacatttaggttgcttccagtttttggcttttccaaaacatatttcagggaacaactttatgtatatgtcttagcatactagtttatctgtaggacaaattcctaggagtggaatgattgggttaatggttattttaaattttcagaagtcattgatgaattaaatgctctccaaagagactgtactaaattattctccaacccacaatgtgagtttgcctgatgtcccatagcctcctcagttttgtggattgtcaacatttcagtttcttccactctggtatcttcttttaatctgcatttcaataattatgaaaaggattaaataacatttcatttttattgctcatttcaaataatatattcaactctagcaactttaaaaggtaacagtgtctaatttgcaattacaattctttaaaaattcttaacttttatccatttattttaagtctactttgatttcagaccctgatgagaatgttcctgagatttgccttggtctattttaacttggagtcaaagccctttctagcagctcatctccaactcccaggcaggcttgccatcgaaggacctcatgctgcttctcttggagagaacagttttcagcatatgccatcttccttcagcaaggaaaaggaatagaaagggagggagcagagaataggagacccactttatcctttccattcacttgttcctaactctttcttttttctgtgcatgggattgaggagaataaaaatgatgttaacgataattaatatgtttttgagcatttactatatcccatacattattttacttaaaccttgatgacagttagagagggaataactgaaggagcaaaattcttgagaaggtggttattaagttaccccagggcacagagcttgtaattggcagaaccaggatttaaacccaggcctgggagtctccattgccctagctttcaaccattacttaggtgctgtgatcattacgtaataataattgctatcatttattgaatgcttgcataggcttcatattaattacattttagaattattatgcaatacttcaaatatttttaaagatatgaagtaataccatgaacatccacgtacctattaccgattaagtagctacttaaagttatgtagcttgcctaagttcactcactcagctggtagagtggcagaggtgggatttgaattccaggttagaaaataaaaccttaccaatatgtttgaatctttctatatcctgccccaattacatctctgtgcctccagaagtaactacaatcttgaatttggaggtcttaaaaatgttgtatacacttattatggtgattgtgctatgaacgttaaattcattaccatactggtttcttaaaactattctgtcaggttgatttcatctactgacattatcctgagaggaagaataagactctcatatacctcaactgatagcacaaagcccttggtgccagctttaatgaggcagctccctcctttatgatgcttggcatatttagctatgtgtggcatattttatacagaatcatagaatgtccaaacaaaatagatcttagctatcatttgggtttggctggttctttattatcatttatcttcaatgtcaccacctcaaagtcccccatcatcatacttttctatcacacatctttttggtgtcttttgtagcactaatcacaatatataattattagatttgcttatttgattacctgtgttccttattagaatgtaagcttcatgttggcccagaccttgtgtgtcctttttcacattcaacagaggcttattgagcaaataaatctaatccaacctcctcaaggtaaagacaagaaacctgaggcctggaaaaggacttgccaagatcacacaccgtaggctttctgactcgcaggcaggcactgtgctaggagggaaggaacttcggtggttataaaaatggtagatgttctgatggtgtctaattagtgttgataaatgatatgaaggaagagacagggtttggtgagagaattctagaggggcatctgacttaaattagaggattattagagaaggcctctctaagaaggtaagatttaagaagaaacctgaagggtgggtaggcttaaccaagtgaactacatgaagaagagagttccacacaaagaagtagaatgctataaaggctctaatgtgcgaaagcacatgttgtatttgggtactactctaaggccagttttgctgaatcagaagagtgagtaatgggaagagtaatagatgatctcagagacgtaggcattagtcagaatataaggactttgtattttatcctaactgcaatgagaaaccattgcagggtttgaggaagaaaagagataagatatgatttctattctaggaagtttcctctggcagtgttgtagagaatggctatggggatggtgacgagagtggaagcaggaggccagtcaggaggctgagccatagtctaggcaaagacatgagggttgcaaaggtgacagtggagctggggaaagtaggctgtttcaaaatatattttaaagtgtaatcaattgtacaggtgatagatttgatatgggtatggaagagatgtccaaaaatggggaagactagaggagaagcaactgtggctgggattgagaaaagagaaggaaactcagttttagataggttttggagatacctgtgtgagaaatccaagtggagatgtcaagcaagcagtctggagctcagtgaggtctctgaccttgagtttagaaattgggagttcttagtacatagatgatgtttaaagtaatgggaaagaggattgtaatactaacagtggttatcacctactgactatgacctatgtgccaggcaatgttccaagtgttttatatgtatcatctcatttaattttcacagcaaccaagtgaaataggtgctgtcattatcttcatcttatcatgaggatgagaagttcacagaaaggtaaagagacttatccaagatgaatttagctagggagaaagagttgagtgagaagagaagagagcccagtctaagtaatgggaaattcttcatgtataaagattgggcaatcatagcgaactcctatatggcactcactatacatacaagagctcattacatctttgccacaatctataaagaagatattattagcctcatttacagaaagggaaattgaggttaagagagattaagtaacttgcctaaggtcattcagctgtggagtggcagatagaagtctgatctaagcaacaccatctaacagaagtttttgcaatgatggaaatgttctgtgtgttgctgtctcatgtgttcctagtcacatgttgttgaacaattaaaatatggctaatgggactgaggaactgaattgttacttttaattttattaaataaatatctaattttattaattaatctgatgtaattttattaagtgtaataggcacaatgcgactagtggctaccatattggacagcacgacttgagagagtctgtgctgttagttgcttctctgtacagaaacttactaaggagactcagaggggtagccagagaaacataaaaaagaaaatcaggaatgtgggggtcacagcagccaagagaaaaatgtatgtcaaaaaagaaggtgtaaccaactatgtttaatgctgctgcattaaactcgatgaggacagagaagtgaccattgcagtcagtcagacaaaggtgacctagaagagaagttttggagttacagatactggtagtattgtaagatgaggaaaatgaaggcaatgtgtgtagatagttctttcaagcaattttgctaagaaggagagcagagaaagtgagcagcagctggaggagaatgcgggatgaagaaaggccttttctaagatgaccaaatgcttggatgctgatgggaatgatcctgtagtggagagagaatgatgcaaaaaagcaaagtctctgagaaaccgagggtgcaatgaggaggaatttttttttctactgtattataaagaaatctaagtaagaaccctgaacagatatttcaagtgatttcttaatacactaattgcaactttgatgagattttcaaaatcctcttaaatccacacaccactagaaaattctttcatacccaatggcatatagacaggggacacccaaataggtcccactaaaaacttagagaagctatatacttttttttttttcacaaaaaactagatgtttatttgttccacacatgaaaaaagggatgtgagaagtcatgtccagcaacataaaaggcctccctgattactctgcacaatgagaataaaaggattcatgaatatacatattatgacaaaatttcagaacattaaacagaacaccttaaaaacttgtagagaagaaaaaagttataaaagacaaaatacatataaataacaaaatcattctggcataatatattttatcaaagccaatggatgctagatgaaaaaggtacaatgcttttaaaattttatacccagaaaaactgtcattcaagtaaaataaaataatgaagattttcaacatggaaggccacataacatttatctctcgtgtatttttcataggggaatattggaagatatattacagtcaaaggagagaataaatcccaaaagaggaaggcaagtaatccaggaaaccataaagtgtgcaaatctttgaagaatagcatgaatgaagcctctgtaacacattagaaggcaattgttcacaattggaggaggcttatggccttcagtgaaaaggttgctaaggaaaagggagtcttgaagaaggagaaattctaactgaaaggttaggataatttgtgaataggaaaatgtcagatgacagataaaaagaagattagaaatgcccaggtaaacaaacatgcaataaaaatatataagaaagtcctggtccaaatataaagcaaatgaaaaataagtatgcttttagagatatacctaatgttaaatgacgagttaatgggtgcagcacaccaacatggcacatgtatacatatgtaactaacctgcacgttgtgcacatgtaccctaaaacttaaagtataataaaaaaaaagaagtatgctttaaaacaattgggagctaaagtaagaatacattttaattttaaatatgggttcatttatattaaattagcttaagaaaataacactgtacatgcaagaagtgagaagtatcttagtagagaacttggtcccttgttgaacaatatttactacttcctattattgaaagcactatttgttggtaatagagtcaatctattgtcaaggtatgggagactaggttgtgattgcaagataaaaataatatgtttcaacttataccttctatacctaacacagagtccataataaatgtcctcattaatatttggagaataaataaatacataaatttctttttttaatgttgaaatttttattttacagatgaaaaaggtggaagataaaataatttaagaagtcctattttgtccagcataggggaaaagagaacacagctttgtgagtttgttttttttaatactttaagttctagtctattaaggtagaagtcaaaatattcctatgttaaagctttagtttaattaaaataaaatgatcagcaaacagattttttttagctgattcttatactgttattttcctttactctttagttctgaggaagaggacataaaaatcttgaatttcactcctgttgctcagtgacaatgttcagagaaatgtggcattttaaccatcattttggtaaacttggttatttttgtatggccatctgtccctaaaccacattattaaggatattcttttttaacaattatactttaagttttgggatacatgtgcagaacgtgcaggtttgttacataggtatacacgtgccatggtggtttgccgcacccatcaacccatcatctacattaggtatttctcctaatgctatccctcccctagccccccaccccccaacaggccccggtgtgtgatgtttccctcactgtgtccatgtgttctcattgttcaactagcacttatgagtgagatcatgcagtgtttggttttctgttcctctgttaattggctgaaaatgatggtttccagcttcacccatgtccctgcaaaggacatgaactcatccttttttatggatgcatagtattccatggtgtatatgtgccacattttctttatccactctatcactggtgggcatttgggttggctccaagtctttgctattgtgaataatgctgcaataaacataggtgtgcatgtgtctttatagtggaatgatttataatcctttgggtatatacccagtaatgggattgctgggtcaaatggtatttctgtttctagattcttgaggaattgccaaactgtcttccacaatggttgaactaatttacactcccaccaacagtgtaaaagtgttcttatttctccacatcctctccagcatctgtttattccctgactttttaatgatcaccatcctaactggtgtgagatggtatctcattgtggttttgatttgcatttctctaatgaccagtgatgatgagctttttttcatatgtttgtttgccgcataaatgtcctcttttgagaagtgtctgttcatatcctttgcccactttttgatggagttgttttttttcttgtaaatttgtttaagttccttgtagattctggatattagccctttgtcagatggatagattgcaaaaattttctcccattctgtaggttgcctgttcactctgatgatagtttcttttgctgtacagaagctctttagtttaattagatcccatttgtcaattttggcttttgttgccattgcttttgatattttagtcatgaagtccttgcccatgcctatgtcctgaatggtattgcctaggttttcttctagggtttttatggttccaggtctctaatgagacacagctgcttttaagtaagcttataaaactgtcgtgttataaatagcacttaattctagggtaatgtctgtattgtccatcaatggatcacattcgcaacatgttctcatgaacacaatataataagaccctaaaaaactcaaccatggctgacagtaatatgccatttttatgatgaggaaaacctgagatggagagctaaagtgacttgtgtaaggtcacacagcaaattaaaggcagaataatgaatggagcctatcttctaactcactgcctgtgtgctacaatgacttttttcctctccattggtgagggtatgtcttgagtcatttgagaattttttttctttaggatacacttcagctctattgttttcagaaacaaatgtctgaaacatcatggaaagtacctagtgatgcatcctgtctccccacctcaacccctatctccacccccagtcccccatcaatcttttagtataatcagattaaacataaatcaggaagtggctggacctgatgggattctgaaagagatccccattggaatgaatatatatgggaaattcttaaatgcctctagatttgacttgcactaataaaggaacctaaatggtcctgctaaagtcaatcaaataagaaagatctacaaaaatttttgtgttccacatgttctaagattatatacagtttatctagggcctctctctggtcttctggggtatgtgtttgggggatagggaggatgaaagattggagggggtttggggaagatacagccttgaaaacaaaaccgtacaattgcaaaaagaatctaccagcccccgcaccccccctccccccgcaaaccaggaaagtttgacctccttccttccattgcctgttttgtttccaggttcttctcttgtgtcttccagtccttcttccaggtcccttgctgtcccgggactcccttggtgtccactctaccctcctggaaaattatgtacctgaccctgtcccaccagagtcttcagttgaacagtttaggaaattgactcctttacttcttttcttcacttaaagaagaaactaacagccaaatatttaaaacagaaaatgaacaaacattaaccgggaacctgcactgaaacttaaactgagagggaccttgagatcagtcagtggggcaaataagggcaggtgactttctgaaggccccacaactagtgacctaggactagtttccttactcccacgtatacggtagatgctgcttaatggcaacccagtatctgtttcttgaatgaatcacccattcaacaagagggagaaaacaggtaaaggctccttgcaacagccctgtcaagtgcaatgcttttcatataccttaattttattaaataaatgaaaaattcaagctgagaaaaatgctttgctgcttgttaattgaactccagccatcaaatgaagattttatggacttgatgccacacagatgaattcttgagaagtccaattctaaattgatgctattcttcatcaagcctctaattgaaagagagggttgggcatagattgcctagttgtaagaccgggcttttgcatagctacattcttagctctgtgaccttgggcaaattattcagcatttgtgagtttgttactacctcatggattgttgtgagaattagatgagataatgcatgcaatacatacagtatagtatttggtacatagtaaccagtcaatagttgatatctgatatcatcatcatcatcatcatcatcctgataccagttgttaaaataaaaatgttcccagtactttagttttcagaaaaaggacctattacagcaaggagccagtatatgcagcatgaaggctaaatgcacaggttaatagtagaatgacctgggttcaaatatgagccttaccatttacaagttgtgcaagcctccattaatgaggattggtaatagtatttctctccgtagggttaatgagaagattaagtgaagtatagacacatacaaagcacaataggctgcattatatgtaacttgctattagtagcagcctaggtctcaagagcctttttggaggggatgccccagacttggcttctgggagggaaggagggaccccctccaacacacacttggcaaaggcctgcagtagaggctacccaaaagccatgtgtgtgctccctgtgtttcctctcctggaggttcatttcctttgctctcccatcatttctgctcattcttgccagttcaaagccttttatggtgacttggggtttgacctttgtgggttcagtttccaggcatttcctgttaccttttctttctgtcagtttccttctttatggacagtttgttttcttgtgctcaccacagcacaaagaagcagtctaatacatttccatgcccatagcagggcatcaaagtgtggtagaaacaaccatggccagggtatcagggcacctgggttttgattttcctaagcttgcctgggcacctcactttggcactctgacccttagtttccttgttttcacatagagagcattggactagatcgataagtactcagaggccccagatacatgcctagctccctgtgttgtgatatgcctacttttatggtgaggtctttgatctaatttcacgtctacctattttgtatttaaataacagaagagcagatatcaggtcctcttaatgtgtacacacacacacacacacacacacacaaacaggagaaatatatgctaatttgcttgactgtagtaatcatttcactataggtatataaaaacatcatattgtatatgttaaaaatgtacaataaaaactaaagcaatctacttaaggcatcccttctagaggagaggagctttttagtaatacccaccccatcaagattaagttatagaggaaaagaaaaaaaaagaaagtaatacccacccatggaaggaggggccagagattggccaaagggattgtccaaagcaactcatccataggaggccatccgcccctcacaattttcctgcagcatcagctagaatgccctggcaggcagtccttgaaaatccatggcttaggtgttgcttaagattttttagttgcccatctagcccacacagagaggagtatccagccagagaagaagctgtgctgagctggagcaggcagtgggggaatcagtcagttaaaaggcaacttaagcagctgctctgtgaggaggtagttggtatcgcttctgttttactcatggggagctgaaactcaaaaaggtttgatgacttgccccagaggttaagtttgtgacaggacatgatttcaaccgcacgtccgtagtgcttggcatgctcagtgttgcactgaatggaacgaacaaattgtagggtggctctgttgctatctgactgtatcaccatagataagtaatttcacttctttaaacctgtttccccacgactaaagtgaggatgataatacctactgatatggtttgactctgtgtccccatcaaaatctcaccttgaattgtaataatccccacgtgtctagggcaggactaggtggagataactgaatcatggcgaaagtttcccccatgctgttctcatgataataagcgagtctcacaagatctgatgactttataagcatctggcatttcccctgcttgcactcattctctctcctgctgctctgtgaagaggtgccttctggcatgatgataagtttcctgaggcctccccagccatgtggaactgtgagtcaagtaaacctctttttctttttttttttttttttttttgagacggagtctggctctgtagcccaggctgaagtgcagtggcacgatctcggctcactgcagcctctgacccccaggctcaagcaattcttctgtctcagcctcctgagtagctgagattacaggcatgcaccaccacgcccggctaatttttgtatttttagtagagacagggtttcaccatgttggtcaggctggtctcgaactcctgacctcgtgatccacccgtctcagcctcccaaagtgctgggattacaggcgtgagccactgcgcccggctttttttttttttttttttaaattacccagtttcaggtatttcttcatagcagcatgagaatggactaatatacctaccttccaaaattgttttggccataacatgacaacatgcagataaatgtgctttatgaaaacaatgctctacaggtacaaggcataacagattagaaagctaatttaccattagattttctcactgatcatcttctattaaaaatagtgaggtgcttaaagtaatgagactctatacatcccataggccactaagctactttcattttgaatagaaaaataatgacggtgcttataaacatttctatcttttctgacatagtctgcatgagaatgaggtgctcacccctggagtagttggtgactaaggtgacttccagcttggtgactccagaggaaagcaaggctgttacaatagcctcaaggtcaggtcttctgattcaattggccttattttcacattgccttgcagagggcctagtaggctcaatgactggaaaaatgaatgcagaattgtgagccagttgtctatgcatgagacgaccacacgatggcagtaaagtcaggtgaattcattctctgctgctttctcagtcctgcctctagtccttagatcaaagaatgtgaacacacttaattccttgtttctgtttcttccagttaatgcctgggcaacatggtgaagccccgtctcaacaaaaaatataaatttttatttattttttttaatattttttgttgagacggggcttcaccatgttgcccaggctggtctcaaattgctggactcatctaagctgcccagctcggcctcttaaagtgctgggattacaggcatgagctgcttggcctgacattaactgatagtattactattgttattagtataggttggacaatatagaaggttttttaataaagtgaaatgggtttcaaacgcaggaaccaggaggaaaactagggtcaactgtaatcccaggagcaattccctggcgaggctagagttacagggatgaaaatatatgttatatctgtgttctgtgtcatataactttttcaaatcattgtcacctagcctcaccctggtgaactgtgagaaattatgagaaagagacaaatgtatctttcaagtgaaagctgctagcactgcatcaagcacagtgtaggtttccaaaaaatgtggattcctcttgcttttcctctgaaagttagactgatgtgggctaatgatatggtcctatccagtggttccccatggaaatgtgtatcagaatcatctgggccttctccccagacatactaattttgtagatctggagtggagcctaggaatctgtattttacagctctctcagacacttttgggaacttgttggaccagttgggagtgtgttgagctgagataaagaggatctgagaagtattaattattctaggcatggtgctaagtgctttgtatgtgtcatctttttggccttcagagctgctctgtgagataggtggtatcacttccattttactcacggagaagctgaaacacagaaaggagaaatggcttgcctcacaggttcattttgtgaaaggacgtgatttctagcacagttccctgtaactctcatcccagactcttctccctgtaccacactgacttcctgagcacacacagacctgggctcagtctctattttctctaagtggggaccttggtcagacactttatctggctgttcgattctttcctctataataattcctgcctctggctgggacttgacgaatgaataaaacaaatgaaaaataaataaatgagataatggatcacaaaataccttaaaaatgataaagtactaaactcatattgggtggtattatttgtggcatttgtcattacccaggaaccttggacctggaaaagtctctgtggtgtatatccgttggctgataaagcatggatggaaatagctaatgttcaaagctggcattgctggtatggggctaatttaatggctagaatgagggaacatgcacttctgagtcctgaggtaaatcagctcactgggtctggctttctagcattcttgaatgttcaaggattatgtcaaaaattaataacagtcactcaaaaagcatattctgaacattcactgtattcaagatgctgaataaggcattgtaaaaactacaaagaatttaaggatatagtcttcaacaagcctgtagttaatttgaggagacatgatccatacacacacacacacacacacacacacagatggaatctaacaaaagcagccataatgatgtcaatcacaaatgtgtagtgtcgtcagaaggagtaaattactgttgttacgctaagacacacaatgagaactctagaatctatcttccttctctttatgtaagttctcatctaggttactgaaaatagcccctgactctctctctccctgttccacaaaggtactgcacatcaacgcctttatctatctcccatcctgtggacaaactgatgtttctaaaatgcaaatctgatgtcattatccttctttagcagtggttccccattgccttcaggataaagtccagattctttagcaaggcctacagggactctggctatcacttccatcaccaccctgtcttcttctcttgcccagccacctcgaaaataccatgttcctccacccctttgcaactttgcatgtgttactccctttgctgggaatgcccttcttcccttccttacctagctaacttcttatttttccctgaaaactccccagctcctttcaactggatttgatatctctcacctatatccttgtggcagtccatatcggagcgcttgtcacactaatagtctatttccttgtcccgtttctgcttctggctccctttcactcatctagtttgttgatcttacctatgagaaaacaatatgtttacagagcttactatagtgactggcatatagaaacatttaaccaatattagctattactattccagtaactgacttatttagctgagaaagttcaagtggaagcaagcagaggactactgagcagatgttaggggagaggaaccaatttcctagaggctaagtgtcctcaagagctagcgctgaatcgaatacatccaatatttggtcagatgggttttaacccgtctccttgaggagagcgcccaaagctcttctgagaatctgctccaggtgtagctgacaggctgtataaaaggcaacacggggtgacccagaagtgtttttcagaggcagctaaaggtaaatctggagaaagacctagaagcacaatttaacttggcctgagacatggaagatgagcagagtagctaaaactcaggatagctatatgaaaagtgatataaataagcaatacaggttggcaaaacatgaggaaaggtcggaagctaatgctcaatagtggcgaggaagattttaatcgaaggactcaatttgttcggcagaagtgtgtgagagagaaaagaaaaatcagccaaatcagggcatttctgtcgtcatgaggacttggctcttctttgagtactcccatggactttctagcaagtgtcctggtcttcccttaccctttggaacattgggttgaaccgtgatgaagttgaaaacccagaatgtcctacccctccagcagacctgactggaccaaaaagtcagtggctactcacaataacatatttacctgaacaactgaagttttcagtgggttgttttttattcttcttctctggcaaaggagcctggcaggcttctggaatcttcagtaggttctgggcctccaatctgggctgctgttgacactcacgcccagcttggagagtgagaagagagatgttctcatagctttggctgtctttttactgggggccggggtgggggtggtagggtgtttggcaattgctcttgaattcgttggctttgctttatctttgtggattattcatctgtgtttgctgaacctagcagagaaagttctctgttcatttagcttggctgcattaaaaatgtttttatgttgctacctataaagaccctaaagtcagcagtatgtctctgaatagatgggaccaccagctccttccaaacccctacttttcttgctaacataaaattcaggtcttcatggcaaaaatgcattgagtcagcaaatagcaaccacccctcccttaccctaccatgtgtaccaaacggtagtttgggagatgggttgttacctggtttcatgactttagatggtgccacaatgatgagaagaacagctggctttcctgaactgtgtttattatttcctgaacttgtttattatttcctgaacttgttttattattttcagaaaaaaataataccctcaataggaagaggtctgtaaaagcttaaccctccccagccatcagtctccatgtgccatgatctctatgtctagtgttctaatcttccacccaccccatcaactctcctttagtatctctattgttctaatcttccacccaccccattgattctcctttagtccctttctcttctttgatttctctctattccttcccctcacaccctactctatcaaattccaaaggattcctaggtgcttctctgtagctgaggtttttgtcctcagggccactataggctacctggcttgatatgtggaagcctgtgaaagccatcaaggcccccaggtcactcccaggcagatttctctgtatatctgtcctgctcctctacactgggtggtgaagttgaggatgatatgcaggttcccattttaggttcttctctatccttggtgtcattccttcccttcttttgcctatctaaggccagggcagtgtctcttaaacttcctgattattggagtatattagacgaaaaaacaaatgctaatattgttctctttgccccttacctgaaacaccctccagtcttctaattccaataattcctagaatttggatcttatctttctggtggaatacaatctacacccttgaactattcacattgtccaaatggatttttcccttcttgcctgaccctgaaactccaaaccacttcacaattcttaccccatcttcatgagcctctcccctgccacaccaatatccaacacttcttaccataatccggggtcctagcatgcttgttttttccttctacagtagcagctctcagaacatgactgttggcaacacttgtgcgaaattaaatcttcatatatctgaaggttccattacatttcatctagccctattcagttttggaggtgttagttgtcattatgggcttgctatatccctgcttccctgactcttcctccaacctttcaggagcctggaatttcatcagatgattctctgaaagagaagactcaactcactcaaaagacagacttacctcattctctttttatgccctttcttttcaacattgtttccttcttcctccaaagagaactccttttttggattcactctccagcattcttggcttctaagctggcattctgcacatgctccctgaatgggggagccactctatcagattctgactcactccggtccataattttgatgcccacagcaatgctagatcccaccacaagcattggtttggggctaactccccatagctcatcatgacccattgacagctagccagacaccacaaccctgaagggcataggactgcggctctagggagggtggtcagtttaagtggccgccagtgacaatttatctctaaacagtgagctgtaaaacataacatcgtgctgaatcaaaggaaacagagtcaaattccaatccaatttgatgtgcaacttggaataaaagcaacgtgtcttgatttaaatgtcaggcccactgctgagtgatgatttaataacttgtatgagagattctgtcacagcaaattcaacactggaattcagtgactcacagatagagtgttagaaatgatacagaagagcacaaaaaggaataggcttatctcagggctcatccagaagctttgcataaagctcatttgcagttagaacctcttttctccccctatcctgccaccgatccttctcttcacagacacccatgcatggatatagagaaaatttctaggtgtgatgtcatctccctgcagtatcttctaaggacacagacttttaaacaattctagcgtggaagtagagtcagtgcatttaatctgaaggcaaggaagcagttagtttggtgtttctcaagggactttaaggacgcatctggtcttaatgtgacgtctttagccaggtacttaattatttttccacattttaagggttaaagagctgagacctggtggagttaaaacatttattcaaatatttatcctgtctccttactcccagggaatcagtgcttcctcctcaataccttgtgagatctctccccttgagcttcccttgccttccatggggtaacatactagaatgctcaagactgaccatgcctcagtcccagtctgcttcccaggtcaagaaggaaccatgcatggccgttcttaagggaggaaattccattctgttgggctaatcttttagtcatcaagatttattttgaatagaatttaaagtataaatatctggtgtttgtctacatgaggattgctcaacgtagacaatatcgacactttttggccagatcattttttgttgtggagaactcttttatgtattgttggatgtgtagcagtgtccgtgacctctggtaactctctctgtctatatcctccatttgcctccaatctatttgacacagacctttcaggttaatatttccaggcaatacctctaacttagtggttctcaatagaaagcaacctcccctcataccgggggacatctggcaatgtctggtgacatttttggttttcacaacttggtggggaggaagaataagttgctatagacatatagtgggtagaagccagggtgttacagtgtacaggaaaaccgccccctgcccctgcccccacaccaagtaaatgtccaacccaaaatgtcaatagcgccaaggtcgagaaaccttgctctagcgtatcgttccctgctcagaaactttccattgtttcacactgcttgtaggaaagatgacagatttcatggcctctcctggtgtagattcagtttattattttgtcaactatagctcctttttggaaacagctctgaatgttatgctttctctgaaacatgtcatgtgctttctcactcacataactttgctcacgccaaccactccctctgcctagaatgcccacttcctactactaaagccaagatgaaatgtagcatctacaaaggcttacctgagctcaaattttcccagctgcaaataattcctccttccctggatattcctatagtattttacaaatatatctcttaaagcacttatcatattcatactacaatagaaaatatgatctggaaggggcttttaggattctcttcagtaaatccttccactgaaagtaaaggaaactgaggtccagaaaggtgaagtaattggccgaaggcattgtatattctcgcaagacttggactgtagtaatttgtgttcttggtttcattctcctagcatggttgaaatggataatcatgaactttgagttaggtctggcagtcaaattgcaattctgacacttataagtgggccaagtcatttacctttctgaaactcagttccctgagcagtaaatggaaataatcatggctgttatgagaattaaatgagattgtgtattaaaaatgcctagcatatagtcggtactcaatacatgtttgtcagatgaaaataaggatcaatagtagtttaaataatgggatttgggaatggatgatggtccataggacttcactaaaaggcaacaagaggcaaaatatggcaactcattgccacctgctccctacttttgcacccttccatagacgatttcctcagtgggccatcagatcagcatgcaagttttctgtgaagtaactgagtgctgacagtggctttccaaatggtaaggtagttcttaaaaggtctgctttttctttttcttttacagtgccaatgaatataatctctttttttcctccggtagataacaggtagagttgtggggagggatgtggatggaagatacatttcccctctttctccttagtttcctttatgacagcagtctggggcttagatgccttcagaggtctaacagaaatttctgtgagagggaattcacaaggcacttggggtggcaataggagcactttagtgttggctcctagctcagtgatacctggttctgacttcagtgaggtttattggggcctttctagccagctcttcactctggagctgaccactctgtcagttttcttcctgcctagggctttgggctaatggcatgctatgcatttattctcttcattcagagaaatgagtctttccctgatcccatggggcatgtacctaatagaaatatccttgctactcaaatgaggggatgacctgacaagcagctgaagaaacagaatgagagttctgatgccttgtctagactagatttggaataagctggggaggatgaagttgcttggcaatgggcccacctcagagctggctcctgtctgctctgccaggtgactacaggagatttttgttgaagggggttagaagagaagctcaggtgagtctactacaacttgacttaggagccccccctccttagggcttacaggtcaagggccctgtaagagaaaaatgcttttgggtgtgatgaaaacaaaactgcagagggcagagcactgaattgggagtaaagacacttggtctggatttctgcctctacctctctgcttctgagagagttcccagggctatcaccggagcctcatattatggtttgtgaagtaggtgcaataaagtctgcagtcttcttcccactgatggcagaagttgaaggttttccagtctctggagttttcactctgtgaattccaaaacatttttcaaaccttcctactttgtgtatgtgaaccagggagtgtgtgtgtttgtgtgtgtgtgtccagggggaggagcaacaaggaggggatacagctctacaggctgcttgtctctatatggtattcttcagtttactgtcttgagagtccaccattgttgttcacgtttaaactactttggagatagttgagctcctttctcaaaggaggcttctctttcaaatttgctctttctgagccttcagaggcactattttcatagctgctgtaattgggctttcaccatgattttgggtgggaccacaggagttcaggaactttagactgcccaggtctattggtaaagtactatttcctctgaaggactgtaacacttgacactggtcataagaggggataagggatccattcacccattcaagtagaaaggaaggatacatggtattgtgagagcctctgatgagggaagttgacttaggaaggtcagagaaaacttcactgaagaattaatgattatgtttagttctgaggaattattaaatattgactaagtaaagaaagtagtggaaagtatatgcgtacacgtgcacatgcagtgaatgttttaggcaaaggaaacagaatgtgcataagccttaaagtacaagggatcagggcacattccagaaagaaataaaatactatattcgctggtttttcaactttaattcaaaatttaagccatagttttaggtgttaagggttgaaaatgccaatgtcctcagctttgaagtactgttaggctaaatcacacatactgaaatggtacccacagtggatagagcacatgaaagcataatcacgaaaagaaacaaatgcatctgtactattgagccagcaatctggaagagaggaaagggcagataaaaaaatgtgaaatgtaaatctttctcccaatattttgtccagcaggtacatctgtcaatggagtatacggatacattccgggagggctacctggttgaggtgacatgagcccagcggagtgaatcaagggagggcttcaagcaggtgccaagttctggatagtgttctgaggaagctataaattggtgaataagaggagagaagatgtttctggcaggagaaacagcatgagacatgacttggtggtagactattttatttctgagatgggaaatgtggggataaattaggctggcctgaatgggaaagcgaagcagccaagcttgggcccatcttagactctttctaggagacaccaactaatcaactaaaagcagtaaaattaaggttcaccaggtagtatgtgaaaataaataattagttatttgaatttagcctttaaaaaataaattgtcatacagatcaatcttgacatcctccactgactgtagtcaggattaactttcttcaagatttagatagagagagataggtgaaagttgctgcctatctctcttctcagggactctctgcaattttgtatcactgggaccctaccataatttctggagtcctgtttgcttaagcactttattttagcagttagccactttgataccttgtaaagtaatagctcttatttttctaggcattgacattttctgaaggatggctgaaaagtcacaaatctttcagacaaaggaacctgtctctgatggaatagcaggtggcggggtggatgtttttgagcaggtgacctttcccattaccttttaaagagaaaactacccacttcaaagcttggctttgattccaatgcatattgctttcctgggtgttgaaaggctaggttaggatagagacatgatgtaagagggagttgattttattttacctgtctaatcccctgatgatgcaggcagcccatgtacagtattctatcactgtggttcaaagtgtggagttttgaagttaggatgagtcagcatttgtatctttaccacttgccggctgtgtggttttcagttgcctcatcttctgtagctgtgtgtgcctcagttgcttcgtcctttgtaaaacagggataataagagtacctatctcatataattactgtaatgatcaatgaggtatatgtttaaagagcttagcataatgcttgacatcttatcaagttgttcttgtcatcattgtcattagcattgccacccataccacccccaggctcctactctaacaaaaaaataaaatcttacaacctcttgctgaagcaaagatcagcagtcagcacagaaggaaagaagaaaataggaagcccagggacattcgctgtttcctattctcaccctaaccatagcatcccaaagagaatgtataaaaactgtactttctggaatcatttctatagttcattaccaaagagaaaatatgaaaagacaacccaatcctcattctctgtccctgttctcacaggtacctgtcggcttggctgggcctattactgtgctggaggtggagcagctgcagccatgttgatctgcacctggctctcttgctttgctggaagaaaccccaagcctgtcatattggtggagagcatcatgaggaataccaattcttatgctatggagcttgaccattgcctcaaaccttgagctttgaaagaagattggagagggtgggaaaggggaggagggagccctgaaaagaggtactaaggattaggccatttgtcatctgactgtcattagcatagcctagtgtttgcatgctttttaaactaattgtcgttcattttcacttatctttaagccagtaggtcactggctgtttataaaattcatcagaggaaacattctcagacatttacccaactggcaagtcgtgctaacccgaagacccaaagtacccctttatgcaaaataggatccaaagctaaggctgggtaagaatagttgtgcagggagggagcacgagatgggcagagctggttcctaccactccattcacacagttcatcagttcattcccaagtatttattgtcacccccaaacatctctggagtactactgctcaatttttgtgtcgttatcaggagtataccttggctcttcctttttttctcctgcttccccccgcaccttgtggggaagcttcaggggagcgggggagggtgattcccagtggtggggaaaacattaatcaaggatacttgcatttagcctggagccccttcctcattatgctttagaatattcataggagttccatttgtattctggctgggtgatgagcaaaaaaaatatatagtagcaaatattctctcatcctttagagataaagaaatggtgttcatcaaatgtactgagaatagactagcatttgtggggcactcaataaatttaaattcatggtgacagtg

SEQ ID NO: 4930 - DNA, 48780 bp, human
tgcctgtatgtctgaggctgggtttgaagcctccagcgtgtttggagttaatccccattaggttggactccgcccctttctcccaaaggtaaagcaaggttttcaggcatcactgcaaagggcagctagtattcccatccttgtctaacaagctgtaaggagaagttgtttctgagatctgagcctgaagagagggaacaagtcagtcagccttcgtggtcagaaggtaaatatgcaacttgggccaaatgcaattcaaacagctggataagaaactgctttgctctccccttgctcagcccccccttctccccttcctttctcaggtttcctgtcctttcatctcaaagctcagagaagccgttttctacccgagggcagcctggtgcttttttatttcttcatagtccgttgtttgcacagaggctaagatgaatcagggctggattcctatttcatattgacaagatttgaggacctaagggttaagtgctagttggtttccccaggggagttggtaacctgaggagatgaagtgcctgtttctgggagtggagagagtgattttgttatgacctgtctatacaagtaaaaatggatccggtttgctaatgtggtaggttgatctcctggatttgcctaaatctaaggggttatgcgacggaaatggggtaatgaagttaaactgaaatgcaaatattgaggcctctcaggctggaaataaaagaatgcatccatttggtaaatatttatgagttcctactatgtgccaaggcatgacaatttccagaagaacctgaaatacttaaactataaatccattcttgcaaagaacacttggccaagtggtttcattttgtggtggggaactgaaaatagaatgaagcctaggggtgaggaaaaatcacccatggagtggttgtggggagagaaaggggaaaggagagatgttctaaatcttaggtggtttcaagtcttttccattacttatgagagaatagggtcttttctggtagaaagggagagaattgatacctactctggtgttaggtatagtgcagatgtttcacttgaattttatgcttaatcatttccattttataaatgaaaccaaaactcagaggttttaagtgatctttttatgtgcatatagcctgtaaggggcagacctcaggactctgtctctgatctgattccaaaattgtgacttttccactaaaacagtattcctcaatcattagttcccattagaataaattgaggatttttaacaatatgaattcccataaattcgaattcagtgaatcaaggagggggtgacatagtctgcattttgaacaagcattgaaagtgattctgaacaagcattgaaagtgattctgttgagacaaacattcttgatataccatgctgcctctcaacttctctgaagtgattggaaaagcaatcagcccatcttcttcccatatgggccagattcactcaatagaagtggtcagctgtggtgacattttattcccagcttatacaatggagtggagagactaatgggcaacaataacagggctggggtttagggcttaacaatgtcttgccagggatcttgataggggtagtttctaaccagctgagagtgtgagatagaactcgtagccaaccagcttatcactgaagatgatggcacctgtctagccagaataagaactgagatgaagatctctcattggtacctcacttttaaaatcataggatagatggggagctcaaggagcagcatcttggggagagggaaggagagagaagctcatatgaaatttggggaggttattccagttcctacctttccagtctcaaactctggagaaaggaaatagcccagggcctgatgtggaggttctttttatgagctctctttgtctctgcatggtcaaatatatttatttagagttgatcatttcaaagttatcaattgctcagttagtcctttctctccacttagtctctggcttcctgccttttaatgccttacctgcttgtgagcattcccacctctggatggagagatgcaaataaacacataaactcacccaacacagttttgctggtctttctaccccaaactaaaaaaggagggaaggaagaagaaggcccagaaagaagttcagcaaacatgaaatctgaggaatttgaaataaaagacacaagtcaaaagagagatcttcttagagtcaccaagatgagtgagtacatcatgagatgatttcaggcacaggagaactcagagcacttctcataatggagatagccagaggagaagaaacccctgagggagacaggtagcagaacatgaggagagaaatgtttggggagtagcagtatttttttttttttttgaagctttgtctgaaacagaaagatctagcatggtcaggctgcttatatacccaacttgatataaggagtcacatcggtccaacacgtttctctggagcaggactctatttacccactggaaacatatgcctgcatatctcattcatttcctagggaagtctcaactctgagtaagatgtatttgtaacaggattggcaggaagacaatgcacactgtctgggggcgtgaggagaaaggcctgttcacgttcctttgccaacaccagtgccaagaaagctgctcttcacagaccagtcctaaaccagcagtcttgcaggcatgtttccctcagcagctgttaagtcactgactccctttcttaccacttcatgttctagtctttaatttgcttactgttttgcctgtaccctcttaccctgggaaaggcagtgctttccttaactcagaagttgcacaacaagctcaagtggaaacaaaaggatttgtgtctttttctgtgggtactggggaggaggtgatacaggaaggaatagctttgtttttctccaccaagagaaatataaaagcaacgtttcactttcattgatacttcattgtaagtgcccatacattagtaggtatacaagaaagtgaaaaaagtgagaacaaatgattaaaggcttggcaattggacaccacagggagagggagaatgctcattatggggaaaaaggctaaaggtctcctgctagcaatctgagttgatgaagggctctcatttggaagatggtggctagctgttctccattacctctgaggacccaacaaaaggatctggccttaggttgcaacaagaaaagtttataaaggcatataacaaattatttattgacggtgagagttgttaagctactaagagatattatagatttccctttcctagagttctttaaaagtaatggagataaccatttgccatgtatggtttaggtgggtttcctgcatcatataggttgaggtgacttctacccacgaggctgtgctagaatggctagcattatctctaaagatgagcaaacattaggctttagtaaggatagcaaattcagaacagaactcatatttttatcctatttattacaactttctggcaacatccactgcatctcatacaaccaatctcggaaacaggcttgcggcccatctagcagatttaaaaacctgaggaatgagggataatgtgacacctaaagagagaggttcaactgcaatcctatcaatgcctggtaacttgaccactctacaagagcatcagggtgagttcttggttcctgaaatccagtgtggctgtttggctggatattccaggacagggaaacaaagctgttacatacatgaagtatacaacaggaattaagatagaataaaatatagcattgtttgtgatttctagttatgtaaatataaagcgacttaaccggtttctgggaatgaacttggattgctttggagggttgtcatgaaggagattactccattgcaggtggcataactaaaagcattttctagaatacacttcactgtccaccacatgtgaacataaagcagtgtgtgaacagactccatgtgccctgcagcctctctatccagccacaagggaagttgggctgagactcatattgtgttcagaagctattaagtaattggatctctgagatctctttcttgattgcgttcaagtcaagtcgatgatttagaaaggtttgcatttaaagtgtataagcttcatatcttcaatgtttaattccatagtcacttttaactttatattgtttgagtcctgaaaagagaatattagagaattatctgtggcagtgattcttaacctgctgtccacggattgtgctagcccacaacatctctagtcctaaatagggtgaccatttcatccaaggttttttgggactttcctggttttatcactaaaaattccacatcccaggaaacccctgagtcccaggaaaactgacatagttggtcaccctagtcataaatgaaataaggactatgcgtttttcctaaagttgaaagtacttcatctaaattctgaaggacaatgagtttttctaaagctaaacacatttaatttaaattgaattttgagaatttgtcttcctatgtcttggcttcaaaacgtcgcttttaaactgaaatcatggtgacagtagttgatagtattgtagtttaatttaacagcttcatttgtcacaggtgaggacaaccatatattacaacccctcccctcatttctactgtagtcacggcactacacagagatagtccgttcctctgccttaagttctctgcccctcctactggttgttatattgggactttttaaaaaattttatttttccataagttattgggggtacaggtgatatttggttacatgagtaagttctttagtggtgatttgtgagattttggcgcacccatcacccgagtagtatacactgcaccgtatttgtaatcttttatccctcgccttccccccaagtccccaaagtccccaaagtctattgtgtcattcttatgcctttgcatcctcatagcttagctcccacatatccgtgagaaatatgatgttcagttttccattcctgagttacatcacttagaataatagtctccaatctcatccaggtcgctgcaataatgacttctttttctctaggcagatacccagtagtgggattgctggatcaaatggtagttctacttttagttctttagggaatctccacactgttttctatagtggctgtgctagtgtacattcccaccaccagtgtagaagtgttccctgttcactgcatccatgccaacatttactgttttttgattttttgattatggccattcttgcaggagaaaggtggcattgcattgtggttttgatttgcatttccctgatcattagtgatgttgagcattttttcatatatctgttggccatttgtatatcttttttaataattgtctattcatgtctttagcctactttctgatgggattttttttttcttactgatttgtttgagttcgttgtagattctggatattagtactttgtcagatgtatagattgtgaagattttctctctctgtgggttgtctgcttactctgctgactgttccttttgctgtgcaaaagctctttagttcaattaggtccccgctatttatctttgtttttattgcatttgcttttgggttcttggtcatgaaatccttgcctaagccaatgtctagaagggttttttcaatgttatcttctagaatctttatggtttcatgtcttgggtttaagtccttattccatcctcagttgatttttgtataaggtgagagataaggatccagtttcattctcctacatgtggctagccaattatcccagcactagttgttgaaaaggatgtcctttccccactttatgtttttgtttgctttgttgaagatcagttggctgtatttgggtttttctgggttctctattctgttccattggtctatgcgcctatttttataccagtgccacgctgttttggtgactatggccttatagtatagtttgaaatcaggtagtatgatgcttccagatttgttctttttgcttcatactgggacttttcatctccaggtgatgatgtccatgagggacattcggagttagttttgactacaagtgctgagattgaaagaaattatatacttgccctgatggtgtttgcactatgtctggagaaattgggtttccttctgtcttcaatattttttgaaaatctctatgggaaatcatggaggcttttaattgtaatacttttggggtaatactgtaggggaaggcttcaggtaaaagaaaagtgagaaattatggctttgccgttgaatcactgtgtacccttgggtaggtcgcttgtctttctgaagcccaatttgctcatttgtaaatttaggataatatctttcttactaacctaagaagaccgttgggcagagcacatataataatggatttggaagggattgtgatgacacagctaataactgtttgtcagcttgtttcctctcctcctctggcctgggctgcttcatcaggaaatgagtctgtaatggagggctgcttgcactttttgtaatcttacaaactctaatacaacaagcagaggcattacctcattgcggccaaccatacctgctgtctaacagcaattactcaaaactagttccacttctccccctgttgcctttcaatccctcatcacatctttctctcatttctcccattctcagccacaaagcctaattcccaggggcccagctcagggcactttcttcccaagccctaacattccagagtaagcacctgcaatttacgatctctgctcccttcctgcacaaaacacgtagcacaaaatacatatgtatcaataggggaattgtggttgagtaaaaaaagagcattatattaagaatcaaataactgggctctgatctggccagtgtacctcactagcccttcacccttgagtaaatcacttcctctccatattcccacctgtaaagtcatggagagggggtagtttaacattgtgtggtagaaaagtactggcctaggcatctgcagatcaggtttcaggttctgatgttgctgcttgctaacttactctgtgacttgaagaaaatcacttcctcctttactgggcaaaattctcccatatgtaaaacaagaaggttggattaaatgattcattaagttccctacccatctggaaattgaatgattctatgaaatgggtttcactaaacaaacttgaaatggactgcctgctctgtgtcaggcactgtttgacaatggttgtgaaagggctcatgactgagaccctgagacacttagtgcctctgctgcttgttcctgtcagtgtctaaaattggcaatgtggcgatgaccccatacagccagttcctgcgcttcccctgctttgggtcccccaacctccttcccagtcctctacaccaccacatataactttaagtaatggtggtgaatcatggagaagtttttgaaacatattccaccatctgcctgctggagacattcacagtgctgtcatcaagctgcagtgtggtctctagccggcccaatagagaaacaggccagaaagcaatggcagattaatggagttgggaggaaagtggttgatttttgacagaggggtctgtgaaaaccatttgtgagctgagctgaagaactagatctggaaagactctcagcgtcttgattacaagattacttgttccaaaagggaccttgaaaggtccttacagctatatgttcctgctgcaaggtagggagtgcctgatcctgatctatttcagaactttgagaagctttttggattatatccagcaaaggacaaggaagcttttcttaatagccattccagagataacctctcctggttggaaagttgcctcccattttgattgtgggaaaagtgactgatcagtgctctctcagtgacaagtatagggtatgagactagacactccttattttattctatccatttaaacctggctgatgcatcccagttgaaaagcgcgcactaacacactgctggacatgttacccaagtcaaatgggaacaacctgtaactctgtggcgaggtctctttccctctcaccccttatagtaggggcgggtcttgataagttgtcttccttctccttcactcactgaaaacaactttgctcctgatcctcttcagatattgcctccttccaagctaccaggccaggaagtccattcagctggaagccgggacagcaaccttgttttcatttaggctcctttcctgccacttgttccacgatgtatgtcaagagttaaaagctgtctgatccggctgtatttgaattggcagagcagaccctaattcagttatctggttcctccattgcagcctaaagaccatagaactctaaatcaggcagaaggaagggaaggtgggaaaagtactgaaaagcaaaatcccacagggatccaaatggtcctcgagagaataatcttatccagaagcaatgaccaagtggcacataattgagccccaggactggccaaccagatgaaaaataggccagtggagcctacatggtaacttactgcatttggtgctgtgatccaactcatctccccatccctgcagagaaacctgtgaccatgaggagcagcctgaccatggtgggaaccctctgggccttcctgtcccttgttactgctgtgaccagttctaccagttacttcctaccttactggctctttggatcccagatggggaagccagtgtcattcagcacattccggaggtgcaactaccctgtgcggggagagggacacagtctgatcatggtggaagaatgtgggcgctatgccagcttcaatgccatcccaagcctggcctggcagatgtgcacagtggtgacaggtgccggctgtgctctgctgctcctggtggcactagctgctgtcctgggttgctgcatggaggagctcatctccagaatgatgggacgttgcatgggagcagcgcagtttgttggaggtaagactgtgcttctgggattgggtaggttgggtagctttggggcagggaggagtggggagtgtagccttatggggaaacccattctcacccccttcactttgtccaactctaaggctatgaatgaagtctcctttaaaatatttagtctaggacttcccaaagtgcaatcaatatcagagttttattcacagcaaatttggctagtaggcagaattgatatctgttgtttaccctctatttttgtcaccttcatctgcctgcaggttgcccatttaaaaacattatctattaatatgtctgccttccagagtcagcaacatacactgtagtattactgctccaacataaacttaatttctaggagccctgctctctggtagttatctcagagaacagtgatctaataaacacatacacacaggtgcaaattactaacagttctcatcaaagaaatacacctctaatagtgaaatgttgtgtaccacaaaaactgtagatgactacttatctggaccacatctaaggctagccctgtctggcagctattagcagtctacccagatttcttgtgaccttgacccaccttacttgtccttcccctcattcaggctccccctaactttagtgcagggaacctgagatattggcagtgtctggattggctagaaaagagcaaaatgcaaaaatggcagacttcaggaagacagtgacagctgtataatttgaactgtctgagaagaaaaaacaaatttagaaagacaggaaaacatatatgtgaatatttgagtattttgcaaaacctagattgggcactgggaaaaagtgctggtagaatctactgctgaagtttgttgttacagagttttagaattattacccaattcattatcattattatctccattagcatgacagtgtgggtcactagagccaggaaacttggatttcacttctgtttttttcaccaagttgctctgtgaccatagtgggaaaatgacatgacttttcctatgcttcacttcctttgaatttgtcccctggtgatatagcccagatctgatctttctttcttctgtccaatgactgcattcatgtggccttggagtgagatggcagtgatgagctaagacagtgggtctcaatggggactacttttgcatgcccctcccccctggaagacatttggtaatgtctgaaggcattttaaattgtcacaacttggggaaggtcctactgacatcaagtgggtgaaggtgagggatggtgatgaacgtctacaatgcacaagatgaggacaacactcacccacaacaacaaagaggtatccagccaaaatgtcaatagttctaagtttgagaaaccctgggctaggctaccaagctttcctggcttgattatgaaaagcatcagattctgtttgtgataccaattaaagtgatgctttctggtttcctcttttctcagactagctgtaaaagttttaaatctgaattaccattctagcctccgtcatttctaaaatttttcccaccgtttagccactgatgggtttttagccacattggaatgtacaattaagttagtttcttccctttgaaaactgtaatactaaaccagttgctaaggctgatctaagccaattatcttagctggctttggaagctccatgggtattacaaataggtcttaggcttacctttcacttttatttttaaacacgctataattaactcagcactgctatgaacacattatttcaggaagtgacacttggctgatagggcagaggggtcatccttgcaattcatatttatagccctggagcccagttccgtgcctggctggcacaaagcagatgttcagtaactgtagaaagaatgaatgcatggctaaggcaatatctagcatatgttgggataaactgaatatgtgagagctggattagttcacatcctttcctctttttccaggcttccatgcagggctgttagcaccctgagctctcttctcttctgacaaaagagtgacagtttagcttcacttgtatttctaagagtttccagcagagtgaggaggggctaactgtcaggaatcagaaagcctagcaacagcctccatcagattccacacattaaagtggctcccatacccccaggttgcttcctcttttgggctcaactgagactttcacaaagcattcataattctccatatgatgcatttcagttgatttcacctactaggtatagaaactcaaaggaaattgttgataggggatgtaggaaggtagtggagatttggatattcacaggttaggcgggacagaactttgagtggcaggtgtcacatagaggaaataaaaacacgagcatcattttagtttcacatgattctgccattctatatccacgtgagccttgctcataggaacatagtcacagtgttcacatgtagatgagggtctttaaagctgaagaagaaaatgccatttggcagtagtcctacaagtcttcaagaccctgggtgtgctatcaggtttatccctgggcaggggattgatattgggacagatcgctagacctccacagcttccccatctgtaacaccagccaattaagaaccattcctgcctcctttctagagactggtggctgtccaggttatatcagatgtgaaagaatggtgagggttgcttggatgaactcactaggagccccttgacatatgactgtgacctaaggatctttggacatcttcggcctgaccttctgagacaggctttgccagtggaaggaaaccaaggctgggcagcattttgggccccatggataaagacacaagagaaagagtttgggggattaagttcaaacttgtgtagctgaggggaattgattttgttgcttcaggtctggctgcttcttggcagctagcgcattaaccgaaatacattgggggagtagtcaatttttgtcaggtctggtttctctctgccagaccccaaaccactgaagagatggagtatccattaagaactacccccttcccctgcctgactcttgctccccagtttggcggctgcccacagagatgagtggtgggaagtgggagagacaggaagaaataaagagctgctggcctgactcatactcagcaaagtgacctgatggggcccatgggtcccatttgctccacctgtagctgatccatctggataagcccagggtccagagagccttccactgggacctccatgccctgctccaatcaatgaaggaaacacctggccaggagattatgtcaacactggggatgctgagatttctaaacagctggcccccagtccctgagaacatagccactattcacattcccctgtttatacatatgcaagatgcttatgagatcctctatcttcagtgagagctaaacaaagaacaaataggtgagtagtacacataaggaacttcttggcagaaaaacaatgtaagatcttgaatcaggttactcatgggaggccaagaatctttctcgaccaaggaatgtatcagaatcacctggggtgcttaaaaatgtgagctttccaactctctggtctcgtttcccattctgatgtacacaacaacaggtgtaaggttgcatatttagtcaaatctccccagtgactttgatgtgtatgtgtgttccctttccccagcctaagggaggatcactaccctggacattatttttttgttgttaagagaacagcattcaacacaccagtgcttttctccatgtaaggtcctaatattacatgcttcaaactgaataaaagttgccattggagacatatcactgagaacttgatttcaggaagagtgccatgtttctaaaaaccatcatcatctctggaaactatttttttcctggaaagtccttcagagttttaccagatatcattttatttatccttaccatgctgagaaaggattatgaaagcgattttctgtttgggaagtggtattcaaggaagttaacccactagcaaagacttatgtagcaaattggagcagagctgggaatatggtccagtgctcctgactctcagtcctgtgcttcatacactgatgctcttgaattttttttcttttctcttttggaaaagaaatgctatcacagtgttttccacagtggtccatgaaccgcttggattaagaattacctggggtgcttgttattacagattccttagtgctgcagactgcaccagtgcctgctaaagtgcgtattacacaacctctcatgctcatatatttttgaaaatatattatgaaatatttcagatgtactcactactctgtgtaagaaatggaatattagcaatatagctgaagcctcctttataccctgatcacattcccttgtccccactgaaaaggtaacaactgtctgggagttgttatttatcattcactatcatgattccagtacacactaaaatttgagaaactctgctcagccttgtttagggtgttgcttctttctggaattcccttttcttctatccctccctgtaaatatctacctatctctcaaaggccaggtccaatgcagcccttctgtgaagccttccctgatctacttttgacatctttagcagatatgaacgatcctgtaactccaagaggaatatggggtagaatgaatggcgggggctgggggggtggtaagtgaaggaactccctaggaagggaaagctgagatatagttgaaagtcaggcttgtaaattttccactggtttgtgtttgagtcgaagttgttataataacaaattaacccatactaggcttctgctcagggcagtaaatccaagctacccaataattatgtttggaaagtaggattggcagctatgcaaagacaagggaattgagaacaagagcaggaagtttaacaaatgcccacccaacagttgcacttgtgaatagtggaggggtgtgcaaagggagttggtaatacccaatgaggaggttatccctgccagaagacaaagattaggcatctacctatttgagaatgtgtagttgggagaggattatatagcagctgggatatgggcaattagtaatgctgggaacaggggaaagttgaaggcagctgtggtgtggctggaaggagggctccaagttctgtctcagattttgcacctgaaggtgtgtattggtgtcccagtttccacaagggctgaagctgaataaaatgtctaactccagccctcttcttggtcagctcagtaaattcaaaccatggcaactatgtcggggagaacatttggtatgttttgtgataggggattcttagggaggggagcagctgaggaagagaaacaaaatggcagcctattggacatcttcccacgtgtagtaggggagtaaagacagtaacacactctaaaggctttcttttccttcctagaggcatgtgagattagaaaagttcccagctaagcatatgcagttgaaacagacttcttcaggcctggcgcggtggctcacgcctgtaatcctagcactttgggaggccgaggcaggtggattgcctgcgctcaggagtctgacaccagcctgggcaacatggtgaaaccccgtctctactaaaaatacaaacattagtcaggtgtgatggcacgcacttataatcccagctactagggaagctgagacgggagaatcgcttgaacctgggaggcggaggttgcagtgagcggagatcgtgccattgtactccagcctgggtgacagagtgagactccgactcaaaaaaaaggaaaaaaaaaaaaaaagagacagacttcttcaaggggcatatgtggttggaggggaagtcaaactgggagttagcaatgacacagaagagaagtgagagccagggctgcagctcatatgtggcagggctgggatttaaacaagttttctctgccaccagagcttctgctcttaacatttttagtggtgtttttcttaaatgttggtaccaggacaagatacgtccacattacagggtgcttttaaaatgcatattcctgggctgcagttactgaatcaaatacctggggctgaggtccaagaatccacatttttaatgaacctccattctttcagaaggtggcagggactgacacttgtaaatgacttccctgttgctacttgaagcacatcttcacaactccaaattaatgagaactgctggagacaaatataattgagaatgaattactctatgaatccatttttatttttaatgtgttcccaggggcatctttctccagctatgataaaatgtaatggaatcagctgtcagttacaagtcaaatatgtccatgaagtatgtttacaacctaatgtgctcacctgtctaaaagggaggatggagtactggggaagatggcgggggtgggagggcaggttgggcagagcacggagctacatgcactagacctgaacaaatgctttgcagagattcctgttctttcagcgggtacctgtgcaaaattgcaagataactccaacaaggcagcttttgaatcaagccctgttcaggttttgactttttagctgtttgttatgaggttaaagagatgaggaagaaattagcatggagaacacaggtagaaactgggagaggagccacagggagagtcagctgtataagaataataaatttttcttgagcacttgctatgtacgaggcactttatgtatattaattcttggaacacctccataaaatacagtcagccttccgtatctgtaggttctgtgtccacagattcaaccaaccataactcaaaaatatttttaaaaatccaacaagaatacaacaactatttacataccatttacattgcattaggtattataagtaatctagagatggtttaaaatatacaagaagatgtgctaggttatatgcaaacactacatcattttgtataagggatttgagtatgcacaggttttgctatctgcaggggtcctggaaccaatcccctgtgaataccgagggacaagtgtattattattactctgattttacagatgaggtgaatgaggcacagagaaattaagtaacttgcgtaaactcacacagctttcaggtggcagggctggaatttgaattcaggtctagttctgcagtctgactacagaacccattgttttaagccaccatgttgtgctgcaactctcaatctaatgcctagcaaattcctagtgccttgctagagatattgttgccaagaggtaatcatcccaggacacatgtctctagaaggacagagcctctaagggttgttgatgatctctttgatcggggaaaaagggcattgctagttactagctatgtgaccttgggtaaatcattttccctttctgtgtttcaacattcacatctgtaacaaggagagattagcgtaggttatgtccaaaaacgttttcctttctattttttttttatggtgtcagatgtctgggatgatttcccagccctgacatggaagtcccttcagaagggactttccccttgggcagtgtgggcaaaggaagctgtctgttatatagactgtgcatactctgaaacagatgcatttatcgagtacctattatctaccatgtgccaaggacacagaattgaagataagtatgtctcctgccttcaaggaatacacactctagtgagggaggcagatgataaacttttgtaaagaatatatattacaggctattttagtcacaggagtaagcactgggtgctatgggaacagaaagaaggagcgtgtaatttagcctgggggttggggatagcgagggaagacttcctggagaaggaaatccttgacctgggctcctcagtatggtaagatctgaggggcaggggtctgaagaagatggaaggttccctctactgtgccaagaaaggcacttggccagctctagtttccgcttgagaaggcagagttcgtgccagtcccagggatctgaatgtgaaggttagaaaatagagctggtgttcttttataaacttgtgttcttttcttcctagtctgtgtgggaaaactcagtctttattaaattttccctcaaagggtatatactggcagcaggaaaaggcttaggtttcatttctacttttgtccttaacccaatgtgcgtactctggacgacctcttcatatcctaggatttcagtttatctgtggaaaaaacagggggtgttgttgtattgccactggatgaattccagggcctagaaaggtctttgagtgaccagtttcacttcctgtgataccacgagacagataagaatgctttctaattttaagcattccactgaagagaatttctaaccttaattggtcattgttttagtttctaaaaccattctcactgtcagtaaattctccctattttcttatttaaatccttcttgctatttcttaaggtccttctcttcttctgcggcctcaatgagtactgagaaaagctagttgccgtggggcagccaagcttggaggctactttgagatcttcctaaaggattcatctgaaggcaatatgagtttcttagagtatatatggactcttcctcagtgaggaaagagaagtgaagatgaagctggcagtccctagagcagcccgcttttcactgtccagttgagccccagagctctggaacctataaatatgctattcattcaccattgatcaagcagctgctttgtgatggttctgtgctatgtcttactttctgtgtccacattcatgacaagtgtccctcccatgttcattagtgtggcacccaagtatggcgtgattgtaattaggctcttttggttgcaagtagcagaaactcacttgagttgcctcagtgaaaagggaatttattataacataaggaaagtagatttggaaagccatcaggaaggcctggcttctcttttttctagcagtttcactgacagtatggagtttttctcatggtatgtctgtttcatgtcactattctcctctattctctccctctaccaatcagtttgctcagcttatccagaattgatactcactcataactttgaattgaacttggctttagcttgacacagacttgattctaccttctggtgttgtggggttgttttcaacttctgcattatctgttaactagctcagcatctttatgattttttcccctccatttttaaacagactagtcaagtgcagtagtgagaacggggaaagagtagaacaataagttcaatccataactgactgtgaacaatcaattgagacaactcactaccttcagaccagtcatctttatgcttctcaattaaaaattccagaaacaagaaactagcccaggtcacctcttcatgccaggctacaatgtcacccatcactgaccagccaatgaatttgtcttagttgtcagatgccaatgcttgatacaatcctctgtggccagaggcagggtaagagccgtaggatataaaatgtgaaaacgtacgcagcaagaaaaagttgtgagcaacatagttgcccttagaaggcagtgttggcaagcagacccagatttgtatctctggttggaagaataagattatcactaaggtacaacaaaatttccctgtaatgactaaaaaacctaaataaaagggccttcatccttttatttagcgtaaggcgtcatggtgtaaggcatatggaaaccaaagaggggaggactgcttggtataaagctggaatgatttatcgggggaggagtgtggttccctgctcatcggtccagcagctgactccaagttacaggaatcattacatattttcagctggtagggacctgcctgatgtttagaaacagctggattttgggaaagagtagtaacatttacattgttattctctgtgtatcagaccaaggcaaaagaggttggaaaagccaacccagccttgtaagtcattgacaaaagtattttggctgtaaaaagtatattggcctgtctcatttttcaacattttttaaatttatgagttgtcccctctgctacctattacactccactacctgtggcatggccaaaaataaaatcctgttgagttggtactctcatagaaatttagggtaaagggggaagtgtaagctcagttgaggaggcagaatttgagctgaactaatccaaagggaatgttggggtgacagaagacgttatattttttctgtctgtgtgtatgctttctttctagggctgctgataagctcaggctgtgccttataccctttaggatggaatagcccggagataatgcaaacatgtgggaatgtctccaatcaatttcagttaggtaaggtggcctgggcagatggcagtgatggttcatgggaaatgtgttttccaaagtgctttaccacttggagggcactctgctagtggtacttgcctgaatctctctcactgtgttagcttatgggaagtggtagcttaactcacaagagttggctgtaaattccccttctttaactatctctccatacaatttatgcagttttgcccggggacctatgaccagtttagggcaaccctatcttcagagggatttaaaatgcttggagactaacaatctgccatcttctgaataaatcctagttcctactggtgtttccttctaggcaccatttttcaaatgtaagtcaacagtatcgtttgtcaatctccactgaagatgtaacacgaggttatttagtttacctgaagcatgaggaacctagataaatattcaaaattgtttctaacggcaagagctgttaaatattagagtaggtgacagaagtagccctgaaccattctctggttgccagttttcactgagaatgtctcaggttcactattgtgagttgataatatattagattctaattggaagacttcagaaatattcccccacctatcatgatgaaagagagtaggagagggaatgtctaggtttccttgggtattctcaattgtacaaaaggatttgggaacaacaaggccatccaaccacatatagcttgtgctccaatacttccctttctctctgttgcctcagattgatttttgagtcttgcttgactcatttttgagaaagttgttccctgtgcaaacataacatgagggaaggtgtaactagtgtggatgctcaaatgtccagtgttcttcactcaggacaaggctgactggtaaacataatatttctgccatagataaaagaatgagtaaatacttggggcaggtgttgaagaaagggaagcaagccactagtcctgctagctggggtaaaagctaaagattcagcaaatttttcctagttggttgtgggactgattctactttttgaaaatgacagtttcgttgatatataattcttatattatcaaatgtacccatttaatgcatataatcaccgggttttagtataatcacaacattgtctaaccatcaccactatccaattccagaattttttttttttgagatggagccgccctctgtcacccaggctggagtgcagtggtgcgatctcaggtcattacaacctctgcctcccaggttcaagcgattctcctgactcagcctctcaagtggctgggactacaggctcgcgccactacgcccaactaatttttgtatttttagtagagacagggtgtggaggaggggtttccgccatggttcaaactgctgacctcaggtgatccgcctacctttgcctcccaaagtgctgggattacagggagccaccgcaccctgccccagaacattttcatcagcccaaaaagaaacctcttacccattagcagtcagtgactatttccctttgctcccagctgctggtaaccactgtcaatatggatttacctattttggatattttatgtaaatggaatcatataatatgtgtttttttgtgtgtctggctttttcactgagcgagaagttttcaagatgtatacatgtagtagcatgtaccagtactttatttcttttcatgtctgaataatattccatggtataaatgtaacacattttatttatccatttatcatttgatgaatacttgaattgtttctactttttggctattattatataatatttctataaatatttgtgtacacatttttgtgtggacatattttcatttcttttgggtatatatctcaaaattgctgagtcaaatattaactctatgtttaaaccttttgaggaactgccaggctttccagaatgactgcatcattttacattcccaccaacaatgtacaatggtttcaattttctcaacatcttcctcaatacttattttccactttttgttatagctgtcctagtgggagtaaagtgctatcttattgtggttttgattttcatttccctgatgactgatgatttcgaacatctttttgtgtacttattggctgtttttacatctcctttggagaaatgtgcattgaaatcatttgcttggttttttttttttcttttttcttttttttttttgttttttgagatggagtaacactttgtcactcaggctggagtgcagtggtgcgatctctgctcactgcaacctccgcctcccaggttcaagtgattctcctgcctcagcctcctgagtagctgggattacaggcacctgccaccacaccctgctaatttttgtattttttaggagagatggggtttcactatgttggccaggcattcttgaactcctgacctcaagtgatctgcctgcctcggcttccaaaggactgggattacaggtgtgagccactgcaaccagccatcctttgcttatttttaattgggttatttgctgttgttgtcctcgttgttgttgagctgtaagattgttttatgtgttctggatacaagaccctttttggatatatgatttttaaatattttctcccattctgtaggttgtcttttcactttcttgatgacattctttgaagtacaaaaataattttgatcaaatctaatttatctattttcctttttcttttttttttttttgcttctgttttaggtgtcatatttaagaatacattgataaatccaacatcaaaaagatttacccctaggttttcctctaagagttttataattttagctcttatagttaggcctttgttctgttttgagttaattttgaaagtggtatgagatataggtccatattcattcttttggatgtgaatatccagttgttgtagcaccatttcttgaaaagtctattatttcccctcattgaatggtcttggtatccttgttgaaaagtcaattgtccataaatgtaagggtttatatctggattcttcgttctattccattgatatatatgtgtattcctatgccagtaccacactgtattgattatcatagatttgtagcaagttctgaaatcggaagtatgagttttccttctcttttaatactgctttggctattctgattcctttgcatttccatcggaattttagatttagcttgtcaatttctacacaaaatcaagctgatattttgataggaattgtattgaatctgtagattagtttggggagtattgctaccttaataatatgaagttttccaatccatgaacctgagatgactttctatttagttaggtcactttgaattcctttgaatgatgttttgtcattttcagtgtagaacattttcacttatttggataaatttgttcataagtattttattgttattttttaataagtaaagcaggcctattaacacagaattgttttatgcttttattttattttaagattccttattgttattatacagaaataaagatggtcccccaacatactatggtttgacttatgatttttcaactttgcaatggtgcaaaaatgatacacatttagtagaaactgtacttctaattttgaattttgacctctttttaggttagagatttggagtatgatacacttttgagatgctgggccacagtagtgagccacagctctcagtcaggcaccaacaacccatactctacagcatactgtgttgcccagtggttttgctgaactgtaacattataagtgttctgagcacctttagggtaggctaggtgaagctattccattcagtggattaggcatattaaatacatttttgacttacaatatttttaagttacaatgagtttgttgggatgtaaccccactgtaaattgaggagtatatgtacaaatgatttttgcatgttggccttgtatcctgcaaccttgctgaactcctttattaattctaataacttttaagtgtattccttaaaattttctagatacaacaatcatgttatctgagaatagagacaattttacttcttcctttccaatctggatgtcttttgcttgttttccttgcctaattgcccttgcaagaacctccaggacaatgttgaatagaacttgtgagaatggagatccttatcactggtgttagcggtaaaatatccagtttttcatcattaagcattgatgttagctatgttttttttttaatagatggaggacctttattaggttgaagaagttcccttctattcttagtttgctgattgtgttcacaatgaaagggtgttggagttaatcagatgccttttcttcatttactgagataatcatgtaatttttgtcttttatcctttcaatatgatgcatttcattgattgattttcatatgttaaaccaaccttgcatttcttggataaatcacagttggtcatggtgtataattcattctataccttgctggatttagttttctacgattttgttaagggcttttgcatctatatttattagggatattgacctgtatatttcttttcttgtgatgtgttcattgacttttggtattaaggtaatattggctttacagaatgagttcctatgattctactttgattaaggtaaaatgccaaagtaaaaagttggatatgtgatttgcatggagattaccaactttgttttttgccctaatcaccacctaaggacctagttcataaatgagtagttctgggctgagtgcagtggctcatgcttgtaatcccagcacttttggaatctgaggtggatggatcacttgagcccaggagttcaagaccagcctgggaaacatggtgaaaccctctctttacaaaaaataaaaataattagctgggcatggtgatgttcacctatagtcccagctacttgggaagggagatacacagagccaaaaaagaaaagacatggtccctaccagaggaataagctttttaccctgacatggttcagagagatgaagaaggtagggaggagaatagaggcgggcattatcaatccatcagagtaagtaaaaaggatttaccactctgctactctgataggctttctgcagcctcctatatgaagagatcacattcatgtcttcaacctatcttttcttaggttttcattcaagttatcctaaaccatccacactattttttagtcctaatttgaatgatcaaagatacaacttatattaaggcactgatcttgatgtctgcattggattaaagatagccacaaatttcttgatacttttcccatagagaagctgggtctgtctccaattcctattccccaaatcttcactggtgtacagctgctttaagttaatctaattacatctaattggatcattagacttaatactctaattagcttcattatagaagataaatagagtatgacagaagtgacatcaagcttattctaggcctgtggtctaaagaacttgcagtttccttcttggtctcttggagctctgagtcatcatataaaaagtttgactatcttggagagaccacatgggatttccaagagttacttaaagacagaaaagttcagctagtacagccattcctgccaaggcactagacatgtgagtgaagttgttctgaaccctccataccggttaactgaatatcactgaatgacatcagttaatgccatttaaagtagaagaattgcccacctgagctctgaacaattgtgaaaccatgagatataataaaatggttgttttaagctgctgtgctctgaggtagtctgtcatacaacaatggataaccagaaaaatgccaaaccatatttcagatcgttattttaaataaaaataattcatgtatgtgacaaaataaaacaatacatatataaaggtttaaaacttaaaatcagtctttttttctgacctcgataccattccccaaaatgaccattaagttccttttatattctccagaatttttaataaatataaataataaatataaacataaatataaatataatttttaataaatataaaatattttttccaatatttgttccaatatccaatgggatcatattatctagctctctatctatctagctacactgttctgcaccttgcgtttttcgcttattcatatctcttgaaaacctatcaatgtttatagatcttccttctatattttaggtatgccatatttttccattgcagggataacataataacatgctctgtgagggcatagatttttgtctgtgttgtttattgctatctccccagtgcctgcttaaagagtaccaaatagtactgaatatttgttgaatgattgaatcatatgatcattaaccacttctttatgcacatttaggttgcttccagtttttggcttttccaaaacatatttcagggaacaactttatgtatatgtcttagcatactagtttatctgtaggacaaattcctaggagtggaatgattgggttaatggttattttaaattttcagaagtcattgatgaattaaatgctctccaaagagactgtactaaattattctccaacccacaatgtgagtttgcctgatgtcccatagcctcctcagttttgtggattgtcaacatttcagtttcttccactctggtatcttcttttaatctgcatttcaataattatgaaaaggattaaataacatttcatttttattgctcatttcaaataatatattcaactctagcaactttaaaaggtaacagtgtctaatttgcaattacaattctttaaaaattcttaacttttatccatttattttaagtctactttgatttcagaccctgatgagaatgttcctgagatttgccttggtctattttaacttggagtcaaagccctttctagcagctcatctccaactcccaggcaggcttgccatcgaaggacctcatgctgcttctcttggagagaacagttttcagcatatgccatcttccttcagcaaggaaaaggaatagaaagggagggagcagagaataggagacccactttatcctttccattcacttgttcctaactctttcttttttctgtgcatgggattgaggagaataaaaatgatgttaacgataattaatatgtttttgagcatttactatatcccatacattattttacttaaaccttgatgacagttagagagggaataactgaaggagcaaaattcttgagaaggtggttattaagttaccccagggcacagagcttgtaattggcagaaccaggatttaaacccaggcctgggagtctccattgccctagctttcaaccattacttaggtgctgtgatcattacgtaataataattgctatcatttattgaatgcttgcataggcttcatattaattacattttagaattattatgcaatacttcaaatatttttaaagatatgaagtaataccatgaacatccacgtacctattaccgattaagtagctacttaaagttatgtagcttgcctaagttcactcactcagctggtagagtggcagaggtgggatttgaattccaggttagaaaataaaaccttaccaatatgtttgaatctttctatatcctgccccaattacatctctgtgcctccagaagtaactacaatcttgaatttggaggtcttaaaaatgttgtatacacttattatggtgattgtgctatgaacgttaaattcattaccatactggtttcttaaaactattctgtcaggttgatttcatctactgacattatcctgagaggaagaataagactctcatatacctcaactgatagcacaaagcccttggtgccagctttaatgaggcagctccctcctttatgatgcttggcatatttagctatgtgtggcatattttatacagaatcatagaatgtccaaacaaaatagatcttagctatcatttgggtttggctggttctttattatcatttatcttcaatgtcaccacctcaaagtcccccatcatcatacttttctatcacacatctttttggtgtcttttgtagcactaatcacaatatataattattagatttgcttatttgattacctgtgttccttattagaatgtaagcttcatgttggcccagaccttgtgtgtcctttttcacattcaacagaggcttattgagcaaataaatctaatccaacctcctcaaggtaaagacaagaaacctgaggcctggaaaaggacttgccaagatcacacaccgtaggctttctgactcgcaggcaggcactgtgctaggagggaaggaacttcggtggttataaaaatggtagatgttctgatggtgtctaattagtgttgataaatgatatgaaggaagagacagggtttggtgagagaattctagaggggcatctgacttaaattagaggattattagagaaggcctctctaagaaggtaagatttaagaagaaacctgaagggtgggtaggcttaaccaagtgaactacatgaagaagagagttccacacaaagaagtagaatgctataaaggctctaatgtgcgaaagcacatgttgtatttgggtactactctaaggccagttttgctgaatcagaagagtgagtaatgggaagagtaatagatgatctcagagacgtaggcattagtcagaatataaggactttgtattttatcctaactgcaatgagaaaccattgcagggtttgaggaagaaaagagataagatatgatttctattctaggaagtttcctctggcagtgttgtagagaatggctatggggatggtgacgagagtggaagcaggaggccagtcaggaggctgagccatagtctaggcaaagacatgagggttgcaaaggtgacagtggagctggggaaagtaggctgtttcaaaatatattttaaagtgtaatcaattgtacaggtgatagatttgatatgggtatggaagagatgtccaaaaatggggaagactagaggagaagcaactgtggctgggattgagaaaagagaaggaaactcagttttagataggttttggagatacctgtgtgagaaatccaagtggagatgtcaagcaagcagtctggagctcagtgaggtctctgaccttgagtttagaaattgggagttcttagtacatagatgatgtttaaagtaatgggaaagaggattgtaatactaacagtggttatcacctactgactatgacctatgtgccaggcaatgttccaagtgttttatatgtatcatctcatttaattttcacagcaaccaagtgaaataggtgctgtcattatcttcatcttatcatgaggatgagaagttcacagaaaggtaaagagacttatccaagatgaatttagctagggagaaagagttgagtgagaagagaagagagcccagtctaagtaatgggaaattcttcatgtataaagattgggcaatcatagcgaactcctatatggcactcactatacatacaagagctcattacatctttgccacaatctataaagaagatattattagcctcatttacagaaagggaaattgaggttaagagagattaagtaacttgcctaaggtcattcagctgtggagtggcagatagaagtctgatctaagcaacaccatctaacagaagtttttgcaatgatggaaatgttctgtgtgttgctgtctcatgtgttcctagtcacatgttgttgaacaattaaaatatggctaatgggactgaggaactgaattgttacttttaattttattaaataaatatctaattttattaattaatctgatgtaattttattaagtgtaataggcacaatgcgactagtggctaccatattggacagcacgacttgagagagtctgtgctgttagttgcttctctgtacagaaacttactaaggagactcagaggggtagccagagaaacataaaaaagaaaatcaggaatgtgggggtcacagcagccaagagaaaaatgtatgtcaaaaaagaaggtgtaaccaactatgtttaatgctgctgcattaaactcgatgaggacagagaagtgaccattgcagtcagtcagacaaaggtgacctagaagagaagttttggagttacagatactggtagtattgtaagatgaggaaaatgaaggcaatgtgtgtagatagttctttcaagcaattttgctaagaaggagagcagagaaagtgagcagcagctggaggagaatgcgggatgaagaaaggccttttctaagatgaccaaatgcttggatgctgatgggaatgatcctgtagtggagagagaatgatgcaaaaaagcaaagtctctgagaaaccgagggtgcaatgaggaggaatttttttttctactgtattataaagaaatctaagtaagaaccctgaacagatatttcaagtgatttcttaatacactaattgcaactttgatgagattttcaaaatcctcttaaatccacacaccactagaaaattctttcatacccaatggcatatagacaggggacacccaaataggtcccactaaaaacttagagaagctatatacttttttttttttcacaaaaaactagatgtttatttgttccacacatgaaaaaagggatgtgagaagtcatgtccagcaacataaaaggcctccctgattactctgcacaatgagaataaaaggattcatgaatatacatattatgacaaaatttcagaacattaaacagaacaccttaaaaacttgtagagaagaaaaaagttataaaagacaaaatacatataaataacaaaatcattctggcataatatattttatcaaagccaatggatgctagatgaaaaaggtacaatgcttttaaaattttatacccagaaaaactgtcattcaagtaaaataaaataatgaagattttcaacatggaaggccacataacatttatctctcgtgtatttttcataggggaatattggaagatatattacagtcaaaggagagaataaatcccaaaagaggaaggcaagtaatccaggaaaccataaagtgtgcaaatctttgaagaatagcatgaatgaagcctctgtaacacattagaaggcaattgttcacaattggaggaggcttatggccttcagtgaaaaggttgctaaggaaaagggagtcttgaagaaggagaaattctaactgaaaggttaggataatttgtgaataggaaaatgtcagatgacagataaaaagaagattagaaatgcccaggtaaacaaacatgcaataaaaatatataagaaagtcctggtccaaatataaagcaaatgaaaaataagtatgcttttagagatatacctaatgttaaatgacgagttaatgggtgcagcacaccaacatggcacatgtatacatatgtaactaacctgcacgttgtgcacatgtaccctaaaacttaaagtataataaaaaaaaagaagtatgctttaaaacaattgggagctaaagtaagaatacattttaattttaaatatgggttcatttatattaaattagcttaagaaaataacactgtacatgcaagaagtgagaagtatcttagtagagaacttggtcccttgttgaacaatatttactacttcctattattgaaagcactatttgttggtaatagagtcaatctattgtcaaggtatgggagactaggttgtgattgcaagataaaaataatatgtttcaacttataccttctatacctaacacagagtccataataaatgtcctcattaatatttggagaataaataaatacataaatttctttttttaatgttgaaatttttattttacagatgaaaaaggtggaagataaaataatttaagaagtcctattttgtccagcataggggaaaagagaacacagctttgtgagtttgttttttttaatactttaagttctagtctattaaggtagaagtcaaaatattcctatgttaaagctttagtttaattaaaataaaatgatcagcaaacagattttttttagctgattcttatactgttattttcctttactctttagttctgaggaagaggacataaaaatcttgaatttcactcctgttgctcagtgacaatgttcagagaaatgtggcattttaaccatcattttggtaaacttggttatttttgtatggccatctgtccctaaaccacattattaaggatattcttttttaacaattatactttaagttttgggatacatgtgcagaacgtgcaggtttgttacataggtatacacgtgccatggtggtttgccgcacccatcaacccatcatctacattaggtatttctcctaatgctatccctcccctagccccccaccccccaacaggccccggtgtgtgatgtttccctcactgtgtccatgtgttctcattgttcaactagcacttatgagtgagatcatgcagtgtttggttttctgttcctctgttaattggctgaaaatgatggtttccagcttcacccatgtccctgcaaaggacatgaactcatccttttttatggatgcatagtattccatggtgtatatgtgccacattttctttatccactctatcactggtgggcatttgggttggctccaagtctttgctattgtgaataatgctgcaataaacataggtgtgcatgtgtctttatagtggaatgatttataatcctttgggtatatacccagtaatgggattgctgggtcaaatggtatttctgtttctagattcttgaggaattgccaaactgtcttccacaatggttgaactaatttacactcccaccaacagtgtaaaagtgttcttatttctccacatcctctccagcatctgtttattccctgactttttaatgatcaccatcctaactggtgtgagatggtatctcattgtggttttgatttgcatttctctaatgaccagtgatgatgagctttttttcatatgtttgtttgccgcataaatgtcctcttttgagaagtgtctgttcatatcctttgcccactttttgatggagttgttttttttcttgtaaatttgtttaagttccttgtagattctggatattagccctttgtcagatggatagattgcaaaaattttctcccattctgtaggttgcctgttcactctgatgatagtttcttttgctgtacagaagctctttagtttaattagatcccatttgtcaattttggcttttgttgccattgcttttgatattttagtcatgaagtccttgcccatgcctatgtcctgaatggtattgcctaggttttcttctagggtttttatggttccaggtctctaatgagacacagctgcttttaagtaagcttataaaactgtcgtgttataaatagcacttaattctagggtaatgtctgtattgtccatcaatggatcacattcgcaacatgttctcatgaacacaatataataagaccctaaaaaactcaaccatggctgacagtaatatgccatttttatgatgaggaaaacctgagatggagagctaaagtgacttgtgtaaggtcacacagcaaattaaaggcagaataatgaatggagcctatcttctaactcactgcctgtgtgctacaatgacttttttcctctccattggtgagggtatgtcttgagtcatttgagaattttttttctttaggatacacttcagctctattgttttcagaaacaaatgtctgaaacatcatggaaagtacctagtgatgcatcctgtctccccacctcaacccctatctccacccccagtcccccatcaatcttttagtataatcagattaaacataaatcaggaagtggctggacctgatgggattctgaaagagatccccattggaatgaatatatatgggaaattcttaaatgcctctagatttgacttgcactaataaaggaacctaaatggtcctgctaaagtcaatcaaataagaaagatctacaaaaatttttgtgttccacatgttctaagattatatacagtttatctagggcctctctctggtcttctggggtatgtgtttgggggatagggaggatgaaagattggagggggtttggggaagatacagccttgaaaacaaaaccgtacaattgcaaaaagaatctaccagcccccgcaccccccctccccccgcaaaccaggaaagtttgacctccttccttccattgcctgttttgtttccaggttcttctcttgtgtcttccagtccttcttccaggtcccttgctgtcccgggactcccttggtgtccactctaccctcctggaaaattatgtacctgaccctgtcccaccagagtcttcagttgaacagtttaggaaattgactcctttacttcttttcttcacttaaagaagaaactaacagccaaatatttaaaacagaaaatgaacaaacattaaccgggaacctgcactgaaacttaaactgagagggaccttgagatcagtcagtggggcaaataagggcaggtgactttctgaaggccccacaactagtgacctaggactagtttccttactcccacgtatacggtagatgctgcttaatggcaacccagtatctgtttcttgaatgaatcacccattcaacaagagggagaaaacaggtaaaggctccttgcaacagccctgtcaagtgcaatgcttttcatataccttaattttattaaataaatgaaaaattcaagctgagaaaaatgctttgctgcttgttaattgaactccagccatcaaatgaagattttatggacttgatgccacacagatgaattcttgagaagtccaattctaaattgatgctattcttcatcaagcctctaattgaaagagagggttgggcatagattgcctagttgtaagaccgggcttttgcatagctacattcttagctctgtgaccttgggcaaattattcagcatttgtgagtttgttactacctcatggattgttgtgagaattagatgagataatgcatgcaatacatacagtatagtatttggtacatagtaaccagtcaatagttgatatctgatatcatcatcatcatcatcatcatcctgataccagttgttaaaataaaaatgttcccagtactttagttttcagaaaaaggacctattacagcaaggagccagtatatgcagcatgaaggctaaatgcacaggttaatagtagaatgacctgggttcaaatatgagccttaccatttacaagttgtgcaagcctccattaatgaggattggtaatagtatttctctccgtagggttaatgagaagattaagtgaagtatagacacatacaaagcacaataggctgcattatatgtaacttgctattagtagcagcctaggtctcaagagcctttttggaggggatgccccagacttggcttctgggagggaaggagggaccccctccaacacacacttggcaaaggcctgcagtagaggctacccaaaagccatgtgtgtgctccctgtgtttcctctcctggaggttcatttcctttgctctcccatcatttctgctcattcttgccagttcaaagccttttatggtgacttggggtttgacctttgtgggttcagtttccaggcatttcctgttaccttttctttctgtcagtttccttctttatggacagtttgttttcttgtgctcaccacagcacaaagaagcagtctaatacatttccatgcccatagcagggcatcaaagtgtggtagaaacaaccatggccagggtatcagggcacctgggttttgattttcctaagcttgcctgggcacctcactttggcactctgacccttagtttccttgttttcacatagagagcattggactagatcgataagtactcagaggccccagatacatgcctagctccctgtgttgtgatatgcctacttttatggtgaggtctttgatctaatttcacgtctacctattttgtatttaaataacagaagagcagatatcaggtcctcttaatgtgtacacacacacacacacacacacacacaaacaggagaaatatatgctaatttgcttgactgtagtaatcatttcactataggtatataaaaacatcatattgtatatgttaaaaatgtacaataaaaactaaagcaatctacttaaggcatcccttctagaggagaggagctttttagtaatacccaccccatcaagattaagttatagaggaaaagaaaaaaaaagaaagtaatacccacccatggaaggaggggccagagattggccaaagggattgtccaaagcaactcatccataggaggccatccgcccctcacaattttcctgcagcatcagctagaatgccctggcaggcagtccttgaaaatccatggcttaggtgttgcttaagattttttagttgcccatctagcccacacagagaggagtatccagccagagaagaagctgtgctgagctggagcaggcagtgggggaatcagtcagttaaaaggcaacttaagcagctgctctgtgaggaggtagttggtatcgcttctgttttactcatggggagctgaaactcaaaaaggtttgatgacttgccccagaggttaagtttgtgacaggacatgatttcaaccgcacgtccgtagtgcttggcatgctcagtgttgcactgaatggaacgaacaaattgtagggtggctctgttgctatctgactgtatcaccatagataagtaatttcacttctttaaacctgtttccccacgactaaagtgaggatgataatacctactgatatggtttgactctgtgtccccatcaaaatctcaccttgaattgtaataatccccacgtgtctagggcaggactaggtggagataactgaatcatggcgaaagtttcccccatgctgttctcatgataataagcgagtctcacaagatctgatgactttataagcatctggcatttcccctgcttgcactcattctctctcctgctgctctgtgaagaggtgccttctggcatgatgataagtttcctgaggcctccccagccatgtggaactgtgagtcaagtaaacctctttttctttttttttttttttttttttgagacggagtctggctctgtagcccaggctgaagtgcagtggcacgatctcggctcactgcagcctctgacccccaggctcaagcaattcttctgtctcagcctcctgagtagctgagattacaggcatgcaccaccacgcccggctaatttttgtatttttagtagagacagggtttcaccatgttggtcaggctggtctcgaactcctgacctcgtgatccacccgtctcagcctcccaaagtgctgggattacaggcgtgagccactgcgcccggctttttttttttttttttttaaattacccagtttcaggtatttcttcatagcagcatgagaatggactaatatacctaccttccaaaattgttttggccataacatgacaacatgcagataaatgtgctttatgaaaacaatgctctacaggtacaaggcataacagattagaaagctaatttaccattagattttctcactgatcatcttctattaaaaatagtgaggtgcttaaagtaatgagactctatacatcccataggccactaagctactttcattttgaatagaaaaataatgacggtgcttataaacatttctatcttttctgacatagtctgcatgagaatgaggtgctcacccctggagtagttggtgactaaggtgacttccagcttggtgactccagaggaaagcaaggctgttacaatagcctcaaggtcaggtcttctgattcaattggccttattttcacattgccttgcagagggcctagtaggctcaatgactggaaaaatgaatgcagaattgtgagccagttgtctatgcatgagacgaccacacgatggcagtaaagtcaggtgaattcattctctgctgctttctcagtcctgcctctagtccttagatcaaagaatgtgaacacacttaattccttgtttctgtttcttccagttaatgcctgggcaacatggtgaagccccgtctcaacaaaaaatataaatttttatttattttttttaatattttttgttgagacggggcttcaccatgttgcccaggctggtctcaaattgctggactcatctaagctgcccagctcggcctcttaaagtgctgggattacaggcatgagctgcttggcctgacattaactgatagtattactattgttattagtataggttggacaatatagaaggttttttaataaagtgaaatgggtttcaaacgcaggaaccaggaggaaaactagggtcaactgtaatcccaggagcaattccctggcgaggctagagttacagggatgaaaatatatgttatatctgtgttctgtgtcatataactttttcaaatcattgtcacctagcctcaccctggtgaactgtgagaaattatgagaaagagacaaatgtatctttcaagtgaaagctgctagcactgcatcaagcacagtgtaggtttccaaaaaatgtggattcctcttgcttttcctctgaaagttagactgatgtgggctaatgatatggtcctatccagtggttccccatggaaatgtgtatcagaatcatctgggccttctccccagacatactaattttgtagatctggagtggagcctaggaatctgtattttacagctctctcagacacttttgggaacttgttggaccagttgggagtgtgttgagctgagataaagaggatctgagaagtattaattattctaggcatggtgctaagtgctttgtatgtgtcatctttttggccttcagagctgctctgtgagataggtggtatcacttccattttactcacggagaagctgaaacacagaaaggagaaatggcttgcctcacaggttcattttgtgaaaggacgtgatttctagcacagttccctgtaactctcatcccagactcttctccctgtaccacactgacttcctgagcacacacagacctgggctcagtctctattttctctaagtggggaccttggtcagacactttatctggctgttcgattctttcctctataataattcctgcctctggctgggacttgacgaatgaataaaacaaatgaaaaataaataaatgagataatggatcacaaaataccttaaaaatgataaagtactaaactcatattgggtggtattatttgtggcatttgtcattacccaggaaccttggacctggaaaagtctctgtggtgtatatccgttggctgataaagcatggatggaaatagctaatgttcaaagctggcattgctggtatggggctaatttaatggctagaatgagggaacatgcacttctgagtcctgaggtaaatcagctcactgggtctggctttctagcattcttgaatgttcaaggattatgtcaaaaattaataacagtcactcaaaaagcatattctgaacattcactgtattcaagatgctgaataaggcattgtaaaaactacaaagaatttaaggatatagtcttcaacaagcctgtagttaatttgaggagacatgatccatacacacacacacacacacacacacacagatggaatctaacaaaagcagccataatgatgtcaatcacaaatgtgtagtgtcgtcagaaggagtaaattactgttgttacgctaagacacacaatgagaactctagaatctatcttccttctctttatgtaagttctcatctaggttactgaaaatagcccctgactctctctctccctgttccacaaaggtactgcacatcaacgcctttatctatctcccatcctgtggacaaactgatgtttctaaaatgcaaatctgatgtcattatccttctttagcagtggttccccattgccttcaggataaagtccagattctttagcaaggcctacagggactctggctatcacttccatcaccaccctgtcttcttctcttgcccagccacctcgaaaataccatgttcctccacccctttgcaactttgcatgtgttactccctttgctgggaatgcccttcttcccttccttacctagctaacttcttatttttccctgaaaactccccagctcctttcaactggatttgatatctctcacctatatccttgtggcagtccatatcggagcgcttgtcacactaatagtctatttccttgtcccgtttctgcttctggctccctttcactcatctagtttgttgatcttacctatgagaaaacaatatgtttacagagcttactatagtgactggcatatagaaacatttaaccaatattagctattactattccagtaactgacttatttagctgagaaagttcaagtggaagcaagcagaggactactgagcagatgttaggggagaggaaccaatttcctagaggctaagtgtcctcaagagctagcgctgaatcgaatacatccaatatttggtcagatgggttttaacccgtctccttgaggagagcgcccaaagctcttctgagaatctgctccaggtgtagctgacaggctgtataaaaggcaacacggggtgacccagaagtgtttttcagaggcagctaaaggtaaatctggagaaagacctagaagcacaatttaacttggcctgagacatggaagatgagcagagtagctaaaactcaggatagctatatgaaaagtgatataaataagcaatacaggttggcaaaacatgaggaaaggtcggaagctaatgctcaatagtggcgaggaagattttaatcgaaggactcaatttgttcggcagaagtgtgtgagagagaaaagaaaaatcagccaaatcagggcatttctgtcgtcatgaggacttggctcttctttgagtactcccatggactttctagcaagtgtcctggtcttcccttaccctttggaacattgggttgaaccgtgatgaagttgaaaacccagaatgtcctacccctccagcagacctgactggaccaaaaagtcagtggctactcacaataacatatttacctgaacaactgaagttttcagtgggttgttttttattcttcttctctggcaaaggagcctggcaggcttctggaatcttcagtaggttctgggcctccaatctgggctgctgttgacactcacgcccagcttggagagtgagaagagagatgttctcatagctttggctgtctttttactgggggccggggtgggggtggtagggtgtttggcaattgctcttgaattcgttggctttgctttatctttgtggattattcatctgtgtttgctgaacctagcagagaaagttctctgttcatttagcttggctgcattaaaaatgtttttatgttgctacctataaagaccctaaagtcagcagtatgtctctgaatagatgggaccaccagctccttccaaacccctacttttcttgctaacataaaattcaggtcttcatggcaaaaatgcattgagtcagcaaatagcaaccacccctcccttaccctaccatgtgtaccaaacggtagtttgggagatgggttgttacctggtttcatgactttagatggtgccacaatgatgagaagaacagctggctttcctgaactgtgtttattatttcctgaacttgtttattatttcctgaacttgttttattattttcagaaaaaaataataccctcaataggaagaggtctgtaaaagcttaaccctccccagccatcagtctccatgtgccatgatctctatgtctagtgttctaatcttccacccaccccatcaactctcctttagtatctctattgttctaatcttccacccaccccattgattctcctttagtccctttctcttctttgatttctctctattccttcccctcacaccctactctatcaaattccaaaggattcctaggtgcttctctgtagctgaggtttttgtcctcagggccactataggctacctggcttgatatgtggaagcctgtgaaagccatcaaggcccccaggtcactcccaggcagatttctctgtatatctgtcctgctcctctacactgggtggtgaagttgaggatgatatgcaggttcccattttaggttcttctctatccttggtgtcattccttcccttcttttgcctatctaaggccagggcagtgtctcttaaacttcctgattattggagtatattagacgaaaaaacaaatgctaatattgttctctttgccccttacctgaaacaccctccagtcttctaattccaataattcctagaatttggatcttatctttctggtggaatacaatctacacccttgaactattcacattgtccaaatggatttttcccttcttgcctgaccctgaaactccaaaccacttcacaattcttaccccatcttcatgagcctctcccctgccacaccaatatccaacacttcttaccataatccggggtcctagcatgcttgttttttccttctacagtagcagctctcagaacatgactgttggcaacacttgtgcgaaattaaatcttcatatatctgaaggttccattacatttcatctagccctattcagttttggaggtgttagttgtcattatgggcttgctatatccctgcttccctgactcttcctccaacctttcaggagcctggaatttcatcagatgattctctgaaagagaagactcaactcactcaaaagacagacttacctcattctctttttatgccctttcttttcaacattgtttccttcttcctccaaagagaactccttttttggattcactctccagcattcttggcttctaagctggcattctgcacatgctccctgaatgggggagccactctatcagattctgactcactccggtccataattttgatgcccacagcaatgctagatcccaccacaagcattggtttggggctaactccccatagctcatcatgacccattgacagctagccagacaccacaaccctgaagggcataggactgcggctctagggagggtggtcagtttaagtggccgccagtgacaatttatctctaaacagtgagctgtaaaacataacatcgtgctgaatcaaaggaaacagagtcaaattccaatccaatttgatgtgcaacttggaataaaagcaacgtgtcttgatttaaatgtcaggcccactgctgagtgatgatttaataacttgtatgagagattctgtcacagcaaattcaacactggaattcagtgactcacagatagagtgttagaaatgatacagaagagcacaaaaaggaataggcttatctcagggctcatccagaagctttgcataaagctcatttgcagttagaacctcttttctccccctatcctgccaccgatccttctcttcacagacacccatgcatggatatagagaaaatttctaggtgtgatgtcatctccctgcagtatcttctaaggacacagacttttaaacaattctagcgtggaagtagagtcagtgcatttaatctgaaggcaaggaagcagttagtttggtgtttctcaagggactttaaggacgcatctggtcttaatgtgacgtctttagccaggtacttaattatttttccacattttaagggttaaagagctgagacctggtggagttaaaacatttattcaaatatttatcctgtctccttactcccagggaatcagtgcttcctcctcaataccttgtgagatctctccccttgagcttcccttgccttccatggggtaacatactagaatgctcaagactgaccatgcctcagtcccagtctgcttcccaggtcaagaaggaaccatgcatggccgttcttaagggaggaaattccattctgttgggctaatcttttagtcatcaagatttattttgaatagaatttaaagtataaatatctggtgtttgtctacatgaggattgctcaacgtagacaatatcgacactttttggccagatcattttttgttgtggagaactcttttatgtattgttggatgtgtagcagtgtccgtgacctctggtaactctctctgtctatatcctccatttgcctccaatctatttgacacagacctttcaggttaatatttccaggcaatacctctaacttagtggttctcaatagaaagcaacctcccctcataccgggggacatctggcaatgtctggtgacatttttggttttcacaacttggtggggaggaagaataagttgctatagacatatagtgggtagaagccagggtgttacagtgtacaggaaaaccgccccctgcccctgcccccacaccaagtaaatgtccaacccaaaatgtcaatagcgccaaggtcgagaaaccttgctctagcgtatcgttccctgctcagaaactttccattgtttcacactgcttgtaggaaagatgacagatttcatggcctctcctggtgtagattcagtttattattttgtcaactatagctcctttttggaaacagctctgaatgttatgctttctctgaaacatgtcatgtgctttctcactcacataactttgctcacgccaaccactccctctgcctagaatgcccacttcctactactaaagccaagatgaaatgtagcatctacaaaggcttacctgagctcaaattttcccagctgcaaataattcctccttccctggatattcctatagtattttacaaatatatctcttaaagcacttatcatattcatactacaatagaaaatatgatctggaaggggcttttaggattctcttcagtaaatccttccactgaaagtaaaggaaactgaggtccagaaaggtgaagtaattggccgaaggcattgtatattctcgcaagacttggactgtagtaatttgtgttcttggtttcattctcctagcatggttgaaatggataatcatgaactttgagttaggtctggcagtcaaattgcaattctgacacttataagtgggccaagtcatttacctttctgaaactcagttccctgagcagtaaatggaaataatcatggctgttatgagaattaaatgagattgtgtattaaaaatgcctagcatatagtcggtactcaatacatgtttgtcagatgaaaataaggatcaatagtagtttaaataatgggatttgggaatggatgatggtccataggacttcactaaaaggcaacaagaggcaaaatatggcaactcattgccacctgctccctacttttgcacccttccatagacgatttcctcagtgggccatcagatcagcatgcaagttttctgtgaagtaactgagtgctgacagtggctttccaaatggtaaggtagttcttaaaaggtctgctttttctttttcttttacagtgccaatgaatataatctctttttttcctccggtagataacaggtagagttgtggggagggatgtggatggaagatacatttcccctctttctccttagtttcctttatgacagcagtctggggcttagatgccttcagaggtctaacagaaatttctgtgagagggaattcacaaggcacttggggtggcaataggagcactttagtgttggctcctagctcagtgatacctggttctgacttcagtgaggtttattggggcctttctagccagctcttcactctggagctgaccactctgtcagttttcttcctgcctagggctttgggctaatggcatgctatgcatttattctcttcattcagagaaatgagtctttccctgatcccatggggcatgtacctaatagaaatatccttgctactcaaatgaggggatgacctgacaagcagctgaagaaacagaatgagagttctgatgccttgtctagactagatttggaataagctggggaggatgaagttgcttggcaatgggcccacctcagagctggctcctgtctgctctgccaggtgactacaggagatttttgttgaagggggttagaagagaagctcaggtgagtctactacaacttgacttaggagccccccctccttagggcttacaggtcaagggccctgtaagagaaaaatgcttttgggtgtgatgaaaacaaaactgcagagggcagagcactgaattgggagtaaagacacttggtctggatttctgcctctacctctctgcttctgagagagttcccagggctatcaccggagcctcatattatggtttgtgaagtaggtgcaataaagtctgcagtcttcttcccactgatggcagaagttgaaggttttccagtctctggagttttcactctgtgaattccaaaacatttttcaaaccttcctactttgtgtatgtgaaccagggagtgtgtgtgtttgtgtgtgtgtgtccagggggaggagcaacaaggaggggatacagctctacaggctgcttgtctctatatggtattcttcagtttactgtcttgagagtccaccattgttgttcacgtttaaactactttggagatagttgagctcctttctcaaaggaggcttctctttcaaatttgctctttctgagccttcagaggcactattttcatagctgctgtaattgggctttcaccatgattttgggtgggaccacaggagttcaggaactttagactgcccaggtctattggtaaagtactatttcctctgaaggactgtaacacttgacactggtcataagaggggataagggatccattcacccattcaagtagaaaggaaggatacatggtattgtgagagcctctgatgagggaagttgacttaggaaggtcagagaaaacttcactgaagaattaatgattatgtttagttctgaggaattattaaatattgactaagtaaagaaagtagtggaaagtatatgcgtacacgtgcacatgcagtgaatgttttaggcaaaggaaacagaatgtgcataagccttaaagtacaagggatcagggcacattccagaaagaaataaaatactatattcgctggtttttcaactttaattcaaaatttaagccatagttttaggtgttaagggttgaaaatgccaatgtcctcagctttgaagtactgttaggctaaatcacacatactgaaatggtacccacagtggatagagcacatgaaagcataatcacgaaaagaaacaaatgcatctgtactattgagccagcaatctggaagagaggaaagggcagataaaaaaatgtgaaatgtaaatctttctcccaatattttgtccagcaggtacatctgtcaatggagtatacggatacattccgggagggctacctggttgaggtgacatgagcccagcggagtgaatcaagggagggcttcaagcaggtgccaagttctggatagtgttctgaggaagctataaattggtgaataagaggagagaagatgtttctggcaggagaaacagcatgagacatgacttggtggtagactattttatttctgagatgggaaatgtggggataaattaggctggcctgaatgggaaagcgaagcagccaagcttgggcccatcttagactctttctaggagacaccaactaatcaactaaaagcagtaaaattaaggttcaccaggtagtatgtgaaaataaataattagttatttgaatttagcctttaaaaaataaattgtcatacagatcaatcttgacatcctccactgactgtagtcaggattaactttcttcaagatttagatagagagagataggtgaaagttgctgcctatctctcttctcagggactctctgcaattttgtatcactgggaccctaccataatttctggagtcctgtttgcttaagcactttattttagcagttagccactttgataccttgtaaagtaatagctcttatttttctaggcattgacattttctgaaggatggctgaaaagtcacaaatctttcagacaaaggaacctgtctctgatggaatagcaggtggcggggtggatgtttttgagcaggtgacctttcccattaccttttaaagagaaaactacccacttcaaagcttggctttgattccaatgcatattgctttcctgggtgttgaaaggctaggttaggatagagacatgatgtaagagggagttgattttattttacctgtctaatcccctgatgatgcaggcagcccatgtacagtattctatcactgtggttcaaagtgtggagttttgaagttaggatgagtcagcatttgtatctttaccacttgccggctgtgtggttttcagttgcctcatcttctgtagctgtgtgtgcctcagttgcttcgtcctttgtaaaacagggataataagagtacctatctcatataattactgtaatgatcaatgaggtatatgtttaaagagcttagcataatgcttgacatcttatcaagttgttcttgtcatcattgtcattagcattgccacccataccacccccaggctcctactctaacaaaaaaataaaatcttacaacctcttgctgaagcaaagatcagcagtcagcacagaaggaaagaagaaaataggaagcccagggacattcgctgtttcctattctcaccctaaccatagcatcccaaagagaatgtataaaaactgtactttctggaatcatttctatagttcattaccaaagagaaaatatgaaaagacaacccaatcctcattctctgtccctgttctcacaggtacctgtcggcttggctgggcctattactgtgctggaggtggagcagctgcagccatgttgatctgcacctggctctcttgctttgctggaagaaaccccaagcctgtcatattggtggagagcatcatgaggaataccaattcttatgctatggagcttgaccattgcctcaaaccttgagctttgaaagaagattggagagggtgggaaaggggaggagggagccctgaaaagaggtactaaggattaggccatttgtcatctgactgtcattagcatagcctagtgtttgcatgctttttaaactaattgtcgttcattttca

SEQ ID NO: 4931 - DNA, 17546 bp, human
cccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcccatccctggccgctggcccgggaccgaagccacttgagcgagcagagagtcgtcaccttgtcttctttgccttcaggggtaggagacgcgtggttacttttcgcggggaactggggcaggaatccatggtggcatgaacttggtcgtgccctcggcgtgagtgaatcgatctaggcgcgtgtgggaatgcccgtgtgttctactttctttgcagctcgccatgagtttttttggatgtgcagcaagttaaatcggttagagtgtgcgctgctttcccgtcctacttcggtgaggagatgctagtgggtaccactactagatggtacttttacttctttacctcctggggttcttgtgggtctctaggtaattaatcacattgaggagctaaagacccgagggaagctgaaatctacatttagcccagcatgcatgtcagtgcttatctcagataactagataggtttctgctaagtgcttaggcttggggtggggactcacactccctgaggcgggagcaggaggggtaggaccgtgaattcttgaagttttaaagtctgtgtaatctaaaacaaggctactctttgagatgtgtggtggtggtggtagtgcttgtggtggtagtgatagtggtggtgaggagggagttgcccctatctgctttagaagatccaaagatgttagtaaatagttttgggggatcttgagggtgtcttgagggtccaagcctgggccactgcacattggtgcttcaacagtaagatgggcttcatgggtttgtgaaaatgaagagaaagaaaagggggagggaaaataacagtctttaatagactgtgagcagttcctggtagattgccactaataataatataataatttgcataaagggactaagtagaattaaatgagcaaggaaagagaaagttggtgagaaacagcattttcaatctctagtgtatgttttagaacgaacttttcaacaacctgggatgtttagtgcatgaagttctcctccctccccgccatgaagagtggacgttgggaggcagtttaaaacttttatgaatataaccctcttctcccattcagagaagaagataattagtcaccataatcttcaatgatgaagggctaaggatatttaagtctccttgagctaggctttgtgaaaagttctttctcaggccagcctttgtgaagccttctcagttagacctttcagcaccctcatttagtagctaagaatagtttgaaatgccattttggatgtggtatacattttcatccatctcccacctatcttcaattggacaagtgcgtcaagcctgtaagtgatggtgttcaaagacttattactgagatgtccttaacccattgcttatttgggaacacattattaacatacattttaaaataactttggttgattttaatgagtgaaaggaaagtaggaaggtagagaagggcgacaattttaaaggctatcctgtttcagatcagctgggagggaaaagctggcctgaccaaactacattttataactggcctgggacattttaacagccaggtggttgtagagtagttgcctctatttacagatgataactaaggttccaactattctgtatgggtttatccggcgtcattgacagacactttctggcactacatcatacttcattttaaattacttctttccttggaaaagttcgtggctttgtaaaattgtaagtgctttttctaccttcacagtctagatgtgaagtaaacctctgaccacaattgtatgtggagtcacttttacatgaaatttgtggatctgtttacctatttaaaagattttagaaagggaattttaataattcatagtcaatgcagttttggatttggaaattaaaatttcatttctggtttatgaagtttgatttattagactaattcccaacaaggacatttgtagagttgctttttctttctgaggttttgtaaagactgcatcagactctagaatgctttaagaatagcctaatcagaaggcagggggatggatactatgaccttgaggtcccattgagtgccagaattctaagtgggtacatctgcttctgtgcctctcccaagagccctctcccagggcctgcgccttctttaaaagggtgtctttgtaattaagcggcccttcttccccatccccctttcttcctttgatccagctttttaaggcctttttttccatttggagacaagaggggtttctcacactttcctgttcccctcttaacgcttcttttcctttaccccagaaaagtcccctgaagttctcaggatggttagaagttgttttgttttgtttggggcgtgggggtggagtgggggagttgttaccaatgaggaggaatagaggatatattccctcttgggaaatgcttgtgaccaggtagcctcctccatggagactgagcatttggaatgcatgagaacagtctattcttggggactgtctggtagaaattgtcctttgcacccattaagcccagcttaaacactgaaaggggtggggagaggtgtgtgtggtcgtactggagccttttaggatggtaaatgggtaaatgtttccaaatctcctattacatcatctctttctcccatggattcagtaggtttagtgatctgcttgacaagttaattagctggggactaaaccaatttgtttagaattgtgatccattgatttcctgtccccaggaatttttgttggtgttttactatgatgtgttgtctttagtcttacttacttttccctccttgctgccttttgtggactttggtccaaattctagggttccacccccaagtcaaaggttagaattttgtcccaggaactaagggggtattaaacaggctggccatactgcattactctcctccatggtgggcttctgaccccttttaacccagagaaaggagggaagtcgccccttccacacacaacacacacaatctgaacaaaaaaaaagaaaaagaaaaagaaagaaagaaaataggaggtcatttgctttataaaagaatccacaacaggttttctttgtaagtactagctttcctagttagtgcctttaaactatgacttgatatataaaaattcactctaactgggccttctcggaagcatatttattgcataaaggaatacataagaatttgtaatgattatcgcttaaattaagtgaggccattatttggcctttgaaatctttttgttatatggaatggagttagttaattgtctaaatcattctggcttgtaataatgctggccacgttagctctggcctacaactgcttgcagaagaaagctagtattactttttgaaaataaatcagactttatagattttgaacaattctaaggatgagactatccaccccatataggtaaaatgttttatttccagctactgtatttgactaacccagggatccagaaagttatttctagtaaataatggcgactgatgccactttaacctaagaatctgcaataagatttcctagtgagcctattggtgagaaggacctgggctctaggcccaactgtaactcggtttactacctctgttaagtttttttttttccactgtaaattatgggtttggacagggtaattttgagagccagttcttatacgtttatggttttctttctaggcctcaatatctagtatgaatgtgaatgattgctactagaatgaagtgcaacagttgttagaaattcaatcatctagtcatcatgttaaagaaaaaaagatcctgtaaggatatatgaatatagatgcattatgttttacattttaacaacccaaaattaagaagctaagactctgtccaaaacttcaagaattccatcatcctaagagatcacctgctttcattttttctagttcctttcaagtcctggttcctgtactaacatgagttttagataattggagccacagatatatacaatgttgcttttcaataagagcccacccaagacttaactttgtgaacccatgtggaggaactaagtcagaatctgaccgaggacacatgaagactcccatatattttgtttctcaaatgccaggagaggctaatggatataataagtaatccctaaacactctctgtgattcaggagttgttcatgtatctagcaaggctgttaatttaattcctttgacctcctgttatccctcccccattcttgttaacaacaacaacaacaaaactagggtccactgtttactttgtgtaaatcattggcaatgatttttaagtcactgtatggtgaaatcccatcaagtgagtataaatttgagtggaatatgaaatctccagaatgagaaaggagaagcaggaaagcacaaatatacttgttttgtagcatggaaaataatatgtttaaattagactaaaagatagcaaagaaactaaggattttagacagttaaataaaagacaagaagtgcagcagcagaatggcccacacataatgggttcttcatctgaggtcttcaccatgtagtcaaatttcatagttctttaattttcctttgataacaaaggtgtggtatacatgtgatctctaagatttgatggattagccaggcatggtagctcacacctgtaatcccagcgatttgggaggcagaggcgggcggatcacctaaggtcaggagttcaagaccagcctgaccaacatggtgaaacccctgtctctactaaaaatacagaattacctgggtatggtggcgcatgcctgtaatcccagctactcaggaaactgaggaataaattgcttgaacctgggaggcggaggttgcagtaagccaagatcacgccattgcactccagcctgggcaacaagagcaaaactccgtctcaaaaaaaaaaaaaaaagatttgatggattcattcctggaaaccagtggctcatcataaattagattaaatttctctaactggaatagaaagtgtggtatgggtttttagtatttagaaagtagcaaatgaggaacaggaacttttttttttttgtaatatatgatcctggagaaaatgcaaatgggtgtatttgccaatgtttcctaaggcaattcttgaaaatctactcttttaagtctgtgggcttgccttgacatttgtaaaggcactttcactcttgccctaactccatgaaatatcattagcctgtgtgacttgaagccaggatctggttttctctgcccagcccctctctgtcttaccatgtgaccaagggtaaatgaattagctgctctaagcttcagttacccttctgggaagcaaggatattaataatcacagaggtgtttcggcatgcttcatattgggcacatgctttgaggtcattggatgaaaggtgtttgcatgatggcagagcaggcttattatagggtcttgagcaggtgttcctttttaatgagctttgctctcttataacatacagtgccctttggtgccccattgccttactgactgtaattaccattaacccaacatttgtattattggccctctcggctttttggaaaaaaaattaaacagttttgtactgtgtggtaagttgaggtacaaataagaggactctagcatcttacagggtggtgaaaaatagcttcaaaaagaaacgttagttgaaaagggctatagagatcagtgagttattcaaagctcctccaaaagatgaaaaagaataaagcaaacttctgtgtgtgtgcgcatgcacgttttaagggagaaagttttcagtaatatttgcttgtgacacatactgatgatagccagtaactgaaacccagccattgtagtgttttatacacagctggattttattaatgatggaatatttatgcttgctgtacaattcgtggctcatttccatgtgtatgtcagaacttaaatacccccaaaagaaacattaagataacatgaaatataaatgtggccaagctagaaagggtggatttggtggagagtctcccttcttcttattggtgtcacatcagatcacaataactgtgccgcccccctatcaaccttaggcattgatactgatctttttttccccttatatataccccatagcaaacttcacatttcaatctttttgatatggacaaacgatctgctctcctctttataatgcagataaaactgatgtatgtgttttttaagagcatattttccctgcacatgcttctcattatccgagaggcctggactcaatcagtaaaggagcagagaaaccacataattgaaaggagaatgacggtggtgcatacttggaatatttgtgggaaggggattgctgacatcagaaaatgtagtggcctgagtgttaacagcattgaagagaaatcagctttctgtgtttctgtgtattgaaaattatttttaagggaataaaaatatgggccaggtttgacatccttttatgaagttgccctggaaactttgatgaagattgttaaagaatagctcaattaaaaccttccccattaggaagctaattagtacatcccttactcattttggttgttttcaaggggcatgtatttgcattgaattagtgacatttgttccatgtgatagcaaactaagataaaaatcacagatggggaaaattatttagattgcctgttttgaagaaacctaattcctctttattacatttagattttcagttcagagttttgttttactatgtttatatacaatgatcacattttagtgtggtagccagttttgctttctggatcatgggctataaaccaaagcttatttgaatttcccgtatgaattagggaaatagaacaaatgacaacaaaccattttattaaggtaagatttcatttttttcttctacaattagtttctctttggtctatgtgtgtgtgcctgagagagagagtaggggaggcagattgtttttttaaaaagcaaacagtttttgaagctaagaaaattttgatgaccccccccccccctttactcccaggaacattctgtctgcctcaggctgggaccagttgggctttggttaggggaacatgatgaattttctgacctggtgctttctgtgaccaggctaagtggttctcccttggaagcctgaaggaaagaggttatggtgagaacaggagtgcaagatttctagcaggttctttttactgtactccacctttttttaggggggtgagtacttgcttctgagattttagggccatttgcagtagagtcaatgctttatagccaaatgtaaaatatgggccagttgtggccctcctttccccgcatcactttaggtgacggtcattctgtacctaggttcccatatgctgtgcccacggtgtaggtgtatgcctgcagtagtttgtgcaaataagaaagttagctgggttatatgatttgtggtttaatctcaccttagtccttcttgggaaggcagggtttagattcagttctgcagtggcacctcaggcaaggcaggttccctgtgcttgcaaggcaacagcaggaggaggaggggctgccttctgccttcagagagtgactcaggccctttggtatgaagatatgaaatgctggctcctgtccatacacctgctggatgccacacctgcagtcagcacctgagccccactcagacacaaaaaccagactgaaggcagatggggctcccttgaaaaggggcacagcgaaacagggagctctcaattatgttagtagagccccactgggaactgggtttagtcatcccagtgttggcgtggggaaacagattactttcttttagatgcagctcactcacttgctcaagatactgttagagtgtttcaggagtttgctttcctaatgaatttctcttgtgaactgtcctcttaaaaactggaggggcaattctgtggagggttatgtcttagaaccaagcacagggcaggaagtcgcaagacctgggttccaatgctggccctaccaatgggcaacagtgaaattctggtccaattagttatgattagctatctgttctggacttgagcttccctctccagttctaaaatggaattaatcacatctgcctttatttccccacagagctgctaagaaggacaaataagatagcagagtgaaagagcttttgtctccttagaaggaaggctgagaaactaaaggtaataataacattattattattgttattccatgtctttctttgttttcttctcctgctgtggcctctagcaaagttttggggaagttatcattcactcagtatgcaactattaagcacattttatgtaccagttaatgttttaggtattgggatgcatacaatgaaaaatcacgcaccccgcccatgccctctaagatcttacagtctagcaacttccctttccatttctggctcaacccgtaatagtgattgctaccagggcactcagaagcttaaaaggtgagagttaacttctttttttctctccacactacagctggggatttctgtccctggagctgtgtattgcaaggtctagcttggagatatatgggaggaaaggccatcgggataaataaaggaatttctttccctcccacatttgcaaagtacctaacccttgaatgatctttttttttttttccccagaagtccatgtttagtttcatcctgggttctgttctgttcctagtcaatatggtccagccctctcttatgaccttagctgtcatccatatgctaatgactcccaaagatatatctcaacctatctttgatgtcaaattggtcatcacactccatgtcttctactcagcttataggtttttgatattttcctcctcttgggagctttttcaggtagcccagggttttttgcagagccctatgtgttgccggagctattagctcatacctctgttttcccgttgaattgggcctcctctgcctgactgggagctcctcaagtactgggctctctttttatttatttatttatttatttatttatttatttatttatttattgccaccctaggccttacctagcacaatgtctggctacagtaagtgctcagtaaaagtttatggaaaatttgctgtgataagtgtcatcatagagaattcattttccatgttgagcagagttgaggtcaggaatagatggagagggattagggaaaaatcttcaaagagaagatggacagcagaactgccttattttgagagttctggctaagaagtcacggaaggaatgcctgttgtgtccactgttgttaaaccaggggcatctctgacctattgcctcccctgctttaggaccggatgatttttatggtcaggtctgcaaatcaacctctgtctataatacattgaccatttaagacaggtgtcacttagtcatctagtattaaacagggctgaccttaaatgtgccaccttaactgaggctgaaaatagagctacacacacaggctcattgatcatgcctgcttagttctatacagcaaaatgtcccttaagatatattgaagattgggatctaaaaactgacaaattcaattctcagaatgtaagcaggttgggtcacaagaactgaatgtcttcaagctgactgtcagatctttccaagggcaaaaatgaaagatgatataagctattacaggccatgaacctgttttcacccacctgatgcttttactaattagcttcttggctgggtggcaatttggggcaagtgcatgcaagctggattcacaggggagcccgcattccactctgccatttcgcaagccactgggatactacactgcttctcttggcttctttccctcccaggagccctgctctgccctggtggaaaaatgagagcgggagaatttttcattaaatgagggagggatttcatgggactctggtgttttgctaattttattttttagtgggttgtctaaaaacatttatgcttcttgacccatcagtttcacttctgggattctatcatgaagaaacaatctacaatattgaaaaaggttaaatcacaaagatgtttttgtaacattatttagattagcataaaattggaagcaatttacatgtcttaataattgaagaatgggtaagtgaatgctgatacacttgtttaatgcactattatgcagccattacgatgttatgaagttatgccacaacatggaaaaagtatttatggtgaggtgaaatgcaggatccaaaattacatcttattaataattcattgcttgtaaaaacccaaatacacataggaaaactaaaggaaatataatgttaacagtgcttaagttgaggtgcttggattataagtgatttttttctttattaaaaataaatgcatgctgtgcttatattacttgtaaaataaaatataagtagatatgaaaatgggtggtctggcattggcggttaaagattggtcaagcaggcagcttctaggtatattcttaaacttttctcattttaggctccatctaattacagggactctttatacttttctcgagataataaagaaggggatgtgatggtgtggtctactcctcttttggaatggatgtgtgtgctgggagatagagggaggtggcaacaggattctccttgctacccagtatgtcactgctcacatccacttcagggttgatcacctttgttgcctataaacatgtttaaggtaattgcttcagagcaaagcaaagtcaaactgggaccaaaaacgaccaagaccttgagttaccatcccagaaacggatctctcacactgatcctcagtaagatttggaaatgccaaggccttgctgtggttcttaaaataatttttcaacctaatctaatagggtgttcaaaaataattgtgatgtttgcaatagagtgtattaagctgtccttgcattgctataaagaagtaccggagacagggtaatttataaagaaaagagttttaatgggctcacagttctgcaggctttatgggaagcatggtgcgaacatctacttggctttggggcgggggcctcaggaagcttgcaatcatggcagaaggcgatgggggagcaggcacatcacatggcaaaagcgagagcaagagacaacgggggaagatgccacacatttttaaacaaccagatctcatgagaactcactatcagaacagcaccaagaagatctgcccccatgatccaatcacctcccaccaaacctcacaattcaacatgagatttgggcagggacacacatccaaactatatcatagaggtagagataggaacaaagaagagttggggctgactcttctcttaagccttttcttgaactagtgctagagttaggtaagagcaaatgccaagctggtatgatattgaacagacctggaacagggggcctggaaacatccatctgtggaggttcatgttgctgttcaatccacctcacatcttagcctaaaaagcgaatttgcaaagcctttctatagtagtacttctagctaaacacttcccccttactgccttgaattttccttccttccattaacattttacttccaatggaactggaaaatcagtggtagcgttaaagcaggtttatagtcttttaaaatcagggtcaattctatgtaataaatagttattaagcatctcctttgtacaagcaaataatgctagataatatgttgtagtggaagggctcttgccctaggcgttataaaaactttcattttggtcctggctctctcttaccctttgaggccctggcatcttcatctatacaagaagagggtgggaccactaggtggtctccctttccagttctggctttcaatgatctaaggacccctgtgtagtagactgagttgcaaataaagtttttttgtttttgtttttcaaaaaaacaacctttcttcataaaattgctgtacacttctaaaaaaaaaaaaggctactttgaaataacaattatagtaatagcttacttttattgaggccttactatgtgccaggctccatgcttagcactttacatggattaattcccttaatctttataacaaccctatctagtatgaacaccattatccctattttgcagatgatgaaattgagacttgggagatcaagagacatgtacaaggtctgttagtaagccatacatccaggatttaaacttgggcagtgtgactctaggcccagactctgtgccacggtgtttatgatgcctatccattgagataacctgcaaaaggaccattgtttttcacatcctaaatgaagtgaattggtatcttgggttgcaagactgttgggaaagttattctctagggtactttggctacaatatggaccaacctgagagaacataagaatttactggggcctcactttttgtgagaggttatgtgtgtgtgtgtgtttgcacaaatacatacacataggtacagggaaaactttgaactggcccccttccatttatctgggagtcaaattggatgaaacaagttgaccaagatttagcagagaaacagctttcttagacttagattctttatcctggttggtagaatgagaggtaggggcagaatgtgggagggtttagaagaggggatagaaagaagatcttataggcatattgcaaaatttatttgaagggtgggagtttggtctgtcctgaccaccttgtaatgttgattttctgggacttgtcttgggaaacattaatgtgttttggctcaacctcacaggtgtattgggagaggccaatgactgcaaatggagtaagaatttagcttggccttgcttccctgttgttgttacagaagagttgattatatagattcaaattgcatttttaaagacagaaccgcaattattctttttttcctatcaaatattctcagagacagtctgtgtgcccaggacaaacaaggttattttattgattgaagatgatgtcagacccctggcagtggcatgattaaagctacagggagattaaaggttatagtgttcatactgttttagttcttgtgcatgaaacaaggagtcttttcctttcctttctcaaataaatggagtagtgttttcctcattatgtgactcttgacatgtagatgaacataagttctttaagaaaaaaatagtaaactggagaggactctgcaaagcttttttcttaggctgatttcttttttaaacaagagacaaagatggcaggaggagggtgagagggtaggggaacgatctgtgtccagttaacataaagtgatttgggttttgaaaaggatatggaggggcctagcgtggtggctcacgcctgtaatcccaacaccttgggagaccgaggcaggcagatccctgaggtcaggagttcaagaccagcctggccaacatggcaaaaccctgtctctactaaaaatatgaaaatcagccaggcatggtgacacgtgcctgtaatcctggctacatgggaggctgaggcaggagaatcacttgaacctgggaggcagaggttgcagtgagccgagatcccaccactgcactccagcctgggtgacagagcaagactccatctcaaaaatagataaataaataagaaaaggatacagaggacagaattgagagaagagagtaagaccttgcacgagaaaagttttctcaatgaagagctgagtatcaggagaaagtcagtaatatcagcatgaagaatctaagtagtactggaaaaaaatcatatggtagtttctctccagggactcgcgtttaaaagccttgggctgttttctggtgtttcagttggaaaaaaaaggatgagtgttttgttcagaattggacaatagaagcacggtggttatgtaccatagctctgttaacagtccagctttgattccaattagaagttgttcctctgcttcaaaattaggggagataccctaaaataattaccttgcagatttgagatgattttgcttttgatcatgattatatgttgtgccaaaacaagatggaaagacacatttccgtgtttgttcactctatatctgttcactttatttttggcaacattgcaaggaaataatgttaaattaatcactttgtggttttgtggagtttttaaaaacttgaatgttttgaacatgctctcaaaatacagagatgtttgtgtacttcttttgcattgctttcctcctctcatggagtcactggtgtggattaagcctttcctttaagtgatatgaatgaatcatacataggccaggatagaagataggaatgtggttcatgtgcatgtcacttaaactcctgagtcttagaatcattttgattaggctgacaaggctttgcagagagtccaggcagaaattagacataaggactatctcaaatccaggtctattattcatttgcatccagtctatataatgtaagtctatgagttttttttactgagacactggggcagtggaagtgccaagaaagcaagtggaggcatcttctgcttggagaagggttgcgctctgtgttgggaagggcagtctactttcctactccaagaatggatggaccattgatcagatgatcagagtgtaagctccatgagggcaggaattatattttatgtgtctttgtagcccttattgtgtctagtatgaggctgacaaatgtgtggaatagttgatacacaataaatacttaatgacttggttgaaaagaaggttcttcccctcccctccacctatctgagcttgaggcactcaaattgggagcctcactgagtgttctttttttgaccaaaaacctaccttatgatgactgccctcccttctgggatgtgggacagtgagcctcactaacctcccctgctactaatagcagtttaaagtttgcaccctaaaggtgacagtggttttggcttttgtcatcatccaccattccaacttggaatggaagtggtagctttctagggctgtgaggtcagaacagagcaagtctcagacctgaacatttccatcactggagactggcctggccttccggacacagctactggacactgaggtttcttttctgccctagtggagatggactctgctactcatttaaaagccaagcaccataggaggacaagtcattctcttggaagaactggtttgattaactgctggccattggtggcaaaatagaaacgacgtttttatttctccctccctccctctcctgaacatttcagagtgaccagtggttggactcttggcggcgcttaccctgaacctgagtgttaggggagagggaatctgccgttgcggtttctggagctgctcataagcaagaattccctatcctgatcaaggctttaagcctaaaagaaagcagaaataggtatggaatatttctgtgtgtgtgtgtgtgtgtgtgcacacgctcgtgcatgtgtgtatgcatgtgtgcctgtgtgcatgctgggtggggtgggtgtgacgtgggagggggtggtatacttttcagggtccagggcagctcagtgtctgcatttccctgccttacagggagggtttgtaaatcacttttgctttaacaccatacttgttcctgtttccagtttgtgagcagggaaaagtaatttggtagtcatctctctagttttgggcaccaaaaaggatttatatattatgcttgtcagcctatcagaatatcccaatttgacagttcaagtacaggagtcctggaggcacattgggaggaatggaaaagggactgggttgcttaacccactggtgtgcacttcccaagagaatatgatgagagggactttggagggtcccttcgtgttgtcagactgcccagcgcaacagttggaagccaggtagcagtaaccaacaagacgtgaagaaagagagaagatgaactttcttcatatactatatgtacattctgggtcactctctctctgcatgaccaaaagaaaggggttcgtgtttccagagagattgcaggccacttaatatcatagaaataagagcctgggagccagggatccagagttgccatctagaaacctgatgctggttaaactgacctttattgtgacttttcgtgtgacattatgttcattctccaccaattactgaagatccttagagtgaaagtttcattattgaacattattacttaattccaatacttaacattgacagattctgcccaaagaatttttgaatctctaatgaattagtgtgtactatacagtgctgagagagagaaatcacctaccagccattttttgttgagaaaatagacatcaagaaaagaggaatcagttgtataccctgtaaaccaatagtatgattagaatttgaatattaaattgtgttactaaaatcagtttcagtcaacccatagtacctgttcagaagaattgatggtgagggaggggatatgctaatcgtataccctttccagaaggatgatctttatatttttcaatttctaaattttgtcagaggcacacttcaaataaaagaggcttcccctttaagcttctacccaataacaataacagcaaatctaaatgactgtttctggagagctgaaaggcaactttgtcagtaataagtattccaagtccttctcttattaagccaaggagcatccaaaatggagactatgaaaatgattttttaaaaagatgtttcagagccttatgagatcagagaaaaagatttgcatcgaggcagggatcattactgtctggtgcaagccaagctctcttcaccttttatttatttgagtctttattttgcattttgtagctgccttcatatgctgagctgctttacaaatcctgttatggggtaactttccccactgtcctgcccccacctccacagccataagatttgggtttttgctttaaatagaatacagagagatgaagcctgtgaatatggaccttgaaaagttaccccctttgattaccctagttgactgttccaggtttctcaagcattcttaggagttaagtccagattgaatatttaactcatgctaaaagtgaaagagaaaacctagagctcttatgcctccatgttcttcatcatatcagtgctagggcctggaatccccaacaatctattaattttagagtcaattctctactttgtttctgcaatcgaatcctcaccctccaatatccattttctttccctttagaggactgatttatccatcaactgggtgttaagcttcctgtttccccttcccaggtcaagggcagcccaggtgcccaatttctctctctcttcacaaggcaccac

SEQ ID NO: 4932 - DNA, 46561 bp, human
taagcaagaattccctatcctgatcaaggctttaagcctaaaagaaagcagaaataggtatggaatatttctgtgtgtgtgtgtgtgtgtgtgcacacgctcgtgcatgtgtgtatgcatgtgtgcctgtgtgcatgctgggtggggtgggtgtgacgtgggagggggtggtatacttttcagggtccagggcagctcagtgtctgcatttccctgccttacagggagggtttgtaaatcacttttgctttaacaccatacttgttcctgtttccagtttgtgagcagggaaaagtaatttggtagtcatctctctagttttgggcaccaaaaaggatttatatattatgcttgtcagcctatcagaatatcccaatttgacagttcaagtacaggagtcctggaggcacattgggaggaatggaaaagggactgggttgcttaacccactggtgtgcacttcccaagagaatatgatgagagggactttggagggtcccttcgtgttgtcagactgcccagcgcaacagttggaagccaggtagcagtaaccaacaagacgtgaagaaagagagaagatgaactttcttcatatactatatgtacattctgggtcactctctctctgcatgaccaaaagaaaggggttcgtgtttccagagagattgcaggccacttaatatcatagaaataagagcctgggagccagggatccagagttgccatctagaaacctgatgctggttaaactgacctttattgtgacttttcgtgtgacattatgttcattctccaccaattactgaagatccttagagtgaaagtttcattattgaacattattacttaattccaatacttaacattgacagattctgcccaaagaatttttgaatctctaatgaattagtgtgtactatacagtgctgagagagagaaatcacctaccagccattttttgttgagaaaatagacatcaagaaaagaggaatcagttgtataccctgtaaaccaatagtatgattagaatttgaatattaaattgtgttactaaaatcagtttcagtcaacccatagtacctgttcagaagaattgatggtgagggaggggatatgctaatcgtataccctttccagaaggatgatctttatatttttcaatttctaaattttgtcagaggcacacttcaaataaaagaggcttcccctttaagcttctacccaataacaataacagcaaatctaaatgactgtttctggagagctgaaaggcaactttgtcagtaataagtattccaagtccttctcttattaagccaaggagcatccaaaatggagactatgaaaatgattttttaaaaagatgtttcagagccttatgagatcagagaaaaagatttgcatcgaggcagggatcattactgtctggtgcaagccaagctctcttcaccttttatttatttgagtctttattttgcattttgtagctgccttcatatgctgagctgctttacaaatcctgttatggggtaactttccccactgtcctgcccccacctccacagccataagatttgggtttttgctttaaatagaatacagagagatgaagcctgtgaatatggaccttgaaaagttaccccctttgattaccctagttgactgttccaggtttctcaagcattcttaggagttaagtccagattgaatatttaactcatgctaaaagtgaaagagaaaacctagagctcttatgcctccatgttcttcatcatatcagtgctagggcctggaatccccaacaatctattaattttagagtcaattctctactttgtttctgcaatcgaatcctcaccctccaatatccattttctttccctttagaggactgatttatccatcaactgggtgttaagcttcctgtttccccttcccaggtcaagggcagcccaggtgcccaatttctctctctcttcacaaggcaccaccagcaatagagatgagaaattctgaagaacagccaagtggagggaccacggtattgcagcgtttgctacaagagcagcttcgctatggcaatcctagtgagaatcgcagcctgcttgccatacaccagcaagccacagggaatggccctcctttccccagtggcagtgggaacccgggccctcagagtgatgtgttgagtccccaagaccaccaccaacagcttgtggctcatgctgctcgacaagaaccccaggggcaggaaatccagtcagaaaacctcatcatggagaagcagctgtctcctcgaatgcaaaataatgaagaactcccgacctatgaagaagccaaggtccagtcccagtactttcggggccaacagcatgccagtgttggagctgccttctatgtcactggagtcaccaaccagaagatgaggactgagggacgcccatcagttcagcggctcaatcctggaaagatgcaccaagatgagggactcagagaccttaagcaagggcatgtccgttccttgagtgaacgactaatgcagatgtcactggccaccagtggagttaaggcccatccacctgttaccagtgctcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggtaagagagttctgtttctgtcatttcctgacctcatccccaaccagcttctgctgtgtgttgggaatcttagggaaggaacgggcaggtgtttgatataacaaactctgcaatgcatgacaggcctctggcttcgtgaattgcctgccaacccgaatttgtatcctctttagccataattagcactgtattaacaatcccttagctttgtaggttgagcatggcctcaactgcctagtggacgaacaggagcaaaagtcttgttttcagcagctatttgctgtcctctctcctaggatgttgaaggggtctgtgtttctcataagccctccttgagaggtagaagcaaattaccttgcactttaattagtctggaacatcctatcacttgcacatattcccctccatgaagctttcatcatttatttttgcaaacaaatctgtgtatttcttgtcagttaccatttttccatagaattaccattattcttttggactaaacaaacacccagatgttatggtgggggagctatgtatgtatgtaggttcagaatgttacttgccttatgcttgcagtttatgaaatctggactgttgtatcttttttttgtagagaatttattagttgcctgtcacatttttaaacctctgagttaaattcccatcacatcatatagaaattttggtcagatgctaaaatacagaaggaaaaatattaccatttctgtcttatatatttagttgttcctatatatacttcttaattattcagaggtccattgtcccactgctatattcactagaccttatgattctatgattctgttcattgttcctgttgttagtatttgggccatgtctctgatcagtagtatttccacatatagggcaggagaaaaggtttaaaccatggggaccgatggtggcatttaagtgtggtatcctgcctcatggccatgagtaatgatgggtgaccatcaggtttgaagtgcttggtcctaggctggccttcatttatatgcggctcacagactaggtctgtgatgtcctttgatgtctacctctttgtctcctgtaccctacttgctcattttggaaaaaaccttctggcttgaagttcattgagtgactcaggagagaaggcagtcatggggtggagtagggtgaaagtgagagaaggcacctagcatttcctggtatttcttttttttcccctgcaggtcctgtttttgtagccagaggcaattcactttggactccacctctaactttgccagtttaggatttttttttttttttccctcttaacccaggttgatttcctaacccttttcaacctcctctgtgcagctttcaaagggcaggagcctatgttctgatcagtgtcttggaacaggaaatggggtaaccaacaaggctactcaggtttaaaagagatcaagaaccagattcccatctgaccaatgaaacagaagacccagggaggggttggtctgttcaagactgcctcacttagtggaaacccattcaagccagcaaaatatcaatgaagctgggggtttttattttgcttttcccatcagtatggaagagtctgttgatgggctgatgtctgttgccttgtgggaggggagtgtgttggctggggtgtggagcagaagccacagccccactcagcacacagcccgccttcccaggaaagctattttcagaactcattcaccagtattgtttgtgatctgaaatgactcccacagtgtttgaagctagatggaaaattatctgccctttgatctgcctaaataaataatgaggagcccaaagaggttttctttttttttccttttcttcccatcctgattaaaccaccggagaaatttagctgcatgtattttacaggaagatacatattttttatcctcccacctaagttatctgtggatttctctttctttctgtcctcaaaagcaacagagcccatgatgatctacccttgttgagcagcattttaatacacagttttgctgtaacaggtttttctctatgggaaaggagcagagtgcttgataatgcttgatgaataagcaaacctaaaatggccctagtgggaggatgctccatatgaaatttgggtctgcatcaggcaaatactggccgtaaaattgttgcagggccctacatgagggagtggcacctattgacaaattactggcaaaaggaggtagttgaactgctttccagaagtgtactgctttaaggtggtgacacattttccctcctttatttcctttaaccaactagctatacagtttgtgagtacctttccaagtaactgctgctagcagcaaccaattagaagactacattctgagcccttaatccacaaattacaagtcaggatgcaaagcaaactctttgaacaaattgctgttaagaaaacatttgcttgcttttcgaggtgcagtgaactgctggagatttgctgttaaaatgaacaaaattataaacaatccttttattacttcatctttcttatgccctcctccccttaaaaaataaataccttgaatgcccagaaccccagatgagaaacaaggcaaaggctatctgaataattttaaaatttcagaatctttgtctttctaagtgctgaaccttttctgcatcctgggtttatacatttatcaactgcttttaaaaattaaatcatttctgtttataaagcagccacctcctttcaattgttgaaatcatgcccagatctgaggtttcttgaaatccttgtttagtggaatctaagggtgacctaactctgtagttcagagcagagctggttgtgcaagagaaaccatcaggaatttgcagcctgctccaggattcacagattcaccgattcaccattgcagagcctgggaaaggcagtttctgtggtgaggatcaatcaagttccaggctattgggtggcacctgctctggtgagagtgtgtgtgcaggattgcacatgtgtgtgccaggagtgtggagtgtgtgtgtgcatgcacatgtgtgcatgtgtgtgtggctggggagggtgagggctcccagtcatcgaggtggcagggtggaaggtgctgtgtcagctgggtagagtggcttttactttccctttgagtccttactactgtctctgggaggagtgtaccccccaccctaccccacttcccagctttggggaggatcctgattttagtcactggcctttgtcctgcatgtatgctatgtccccttttctgcagagccccagtggcccaggtagccttaggaaggagcaggatgaggggacggaagtggcaggaggcaggtcagggcttgcatggaatcatgtgattctgttgtctgcaggcggcttgttgttcctggttaacgtgtcagtggggagcgattcaggctgctgtgtgctggaaggacctggagagtgtgctgctcacatggctgccacctttattattactgtcattacttttactgttattatttaacttggggtgtattttggcttcctctgacatccgccccctccaactctcccttaccccgtcattccttaatctctttttctcacggggagcttcaccccagtgttcattccgtcctgctttcccctggtgggtggatgctggagcccagattgagttcttcactgaagggctttctctccctttgtgactgcccaagccattgctggtttgcaaaccagccagtgacgggctgccttggttttcccaacatcacggtgcactgagatctgcttccttttccagcctggggaattgaggggcagctgccttgtctctgcttatcttcatcctcagcttatctgaccccagagacctccttctggagacctcatggtctcctccttcccaaggtccctggaaggccatgtgctgttgtccagggaatgcaggggcctttcagtctccaggcaggagggaggccagtggctgagtttgtttgagagagaggcctgggttgcttgatgaggcccaggggagctgtggagagaaagcccatttcagaactgggcgttcagtctttaaaagagaatacctcccaggccttggactgcaaatcctgggaacaaaaatgaaggttaatatagtgatttttttcccttaaaatttgagagctgcattggagaacatgaaacttaagcccctcttttctgcccacaaagcagaaaagagacacacaagccccaacaaatctcaggacattatattttaactctgtaggcatgtagaaattgtaatagctctcattcaaagagaaaaaagagcacttagtcttttacctgtgaggaaactgaagatccatagaatggaaaataggagctcttcaccaaataaatgtataaataactcccaggcttttgattgaatgagtgctttgagctctggggaaaaatattatgtatggcagcaactttccagttgtacttatgagtaccatgtcaattcttctttgcccaaatagttcgcatgccctcttcaatattcagcaattatttataatgacagatgtatgtgattggaagaatgtgggtacaccagaggcatagatgggcctgagcgacagaatccagggtttgtacaggtttgaggactcttggggaagatgtaggttattgggtatccatgagaaagtgtttggaatgattttgtagctgtaaaaagcccttatagttaagatctcttgtaaagatggatacatgaacagtaatggtaactggagtgtgtgtctgaggaatgtgctttagcatctggaatgccagttaaaagttaattgctcctggtgatttgtcccagttccaccatgaattttatgcaatttattgcaaagattaaatggatatcctttaagtaacaagctaacaaggtcagcttatctcactgggaggtagagaagtgactgtaattcctattccgccaaaaatgagaagaccccagtatttttgcaatttatttgtgacctcaagaataaaatgggctcatgcagattaagtaacttgcaccaagttacacagctcgtgagcagtagaagaggtctccagactccctctgttgggatccagatcccatgcacttagccatctgtcttccctggattgagaaatatcaactgtagaacaagtgtccacaggacatgggagcatatgaggttaattgggcatgagctagggcatgaacaagctttttgtcttcagtgcacactgacagatactattcctggtagtggtgatggtggaagtgatccatccacatactaattgtttcccttaatggctaatagtcattaggtatgaattatttatacttaggtgttagcattttgtacctggtaattaggtacaaaaatgggagagccacattaaacaatgtaccaaaggtctctttctggaactttctatgagcaataggttggaaatctaagtatcagtgcacagaaatcaatgcattatggcagtagaaaaagccagaaaatgggaattgggaaagaaggattctatcttggcaccaccactctaatatttggcagatgacttcccctttctggacctcattccccatctgtccagtgatagagttgaactaaataattttcttttaaggcctttccagttcttacattttgcgattcattacatcaaaaatagtatgttagcattgcttgtaaccctcttcaagtctttttatggttactgctaatgggaatcattaaatcgttaacaactggaagcaacaataatcatttagtgtctctaatataagtatctaccaatccttgaatagttttttttctttttttttgtgaatgtatgaattactaaagggagttgcagatagcaagatgggggtggtttttatggctgtttgttgtttccatcctggcaaatggaacatagtttctaaactaggatctttatgtgtgctggaccacgtgtataatgtcagaaaaggtttaatttaaaataatgagatgaaaattaccttgtagaagaatcgtttgaaatgtttagacttgagcaaacgggtgtacaggtgtgtatcactacgattttcacaaagtgaccatggaagttgtctggttctgaccctcatgggatcacacctctgtttgtcaggcagaggcacagaaggtcaggctggaaaagggctgtggtctttgcagagatagagcaggcagggttagacttccccatagtcagaccctgcctgctcttcattttgcaggtgtcctgggggcatcagaagcctcctcatctcacttttgtgtgcccttctcccccagtgccttaggagagaaattaacccgcacctgcccttcatgttttacaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtgaggcttccgttttgggatattagggtctctaagtctttatttgtgagacttgtttaatatccacattaaagtctccagttgtgaatcccagcattacttgtggcaggtcttcaggatttttatatctgaaggttagatatgagtcaaactttggaaaaagccttctacctgtctacctaggagaagtaacgtcttacatttacacaaggagaaaaaaatttatgcagtttttccagacgctatagccctaaagaaaacgtgattaattcttttagaattccaaaaggcagtgatacttcttgataagaatactggtgatgcctttataggtaaaggatctgacggcaccttaaggctcattgtcttggtcacattttcccaaatatgaatttgaatcttaaatataaaaataaatgtagttcctagaaaaatctcaccagctaaagtttgagcagtcctgccttgttctggaaaaggctcagaatactttttcctagtgggagttctcatagtaactctctttcaacaatccctccaccccaccctttgatttggtccctccctgcagctcaaattcaacatctgctctctttctctgttgtatgtggggggcaggaggggcttaacaccacagctgggtgacaggtgacagccctaggctgaggaaatagaaaaaggagtgtatctccagttcacattcttctctgcccacccccattgggactttacctctggagtaccccaagcgaggaaccttagctcttggcttccaggggctgctggtgaatagggttatgcctttggccgcttctttgcagcttttgtcattgtggagctattgtggtttggtctccctacaatgtgaactgttcagagaggtgagggtgaaggtgggggagggacaggaggatgccttgtattgtccagcaactctgtccttaggaaacaccaggagtgaaaatttcagaggcctgaatgaagctgagtatttgtaaacagacaccaaatctgggggcctcaaggagacaggggcttattatcagcagatgattttttttctttctttctttttttttttttttgagacggagtctcgctcttgttacctagcctgcagtgcaatggcacgatctccactcactgcaacttccgcctcctgggttcaagcagttctcctgcctcagcctcctgagtagctgggattacaggcatgtgtcaccacgcctggctaattttgtatttttagtagagacggggtttctccatgttggccaggctggtctcgaactcccgacctcaggtgatccgcccgccttggtctcccaaagtgctgggattataggcgtgagccactgcgcctggcaaacagaggatttttatataggaaaatggcttccctgtcccttagttttcctaaatctggatgagggttgttggagtgctctgagaattgtttcttcccggcttttccctgattttgtattttcacccgcaaattttaactatatccctatccccatcgctttggtgaaataaattaattatatccatacactagaaacccagtctggctgattaggctaacagttgacaccccctctccaaactctctcttcatggtgatcccagcccatctttgatacaatcactgaaggatgaacccagctctaatacgggccctttttgccagaggatccatggtgattttttgtgtgtgtgggagtgggttcagccagtgacagggaagagggacagagaataggattgctgttgtttgttccccaagatgggaaaagatgcctcaaataagtgtaactggaacagcttgaatgttgggaaagtagaggctgacccagtgtcgaggtagagtagaggggaaggtggaccaggagaggaaaaggaaagtggggaaaattaaggtagatcccaggtagtgctggaggaaatgaaaaggcctgaggctcatgaggggaataagtagacagagtaagtctggaaaacccactgccaccctcctctctgcccccaccatcacccagcccaaaccagtggatatatccttctgtgatggcttttcctggaaggccctattgagagctgtgggacttgcccttttgaaggatggagtatctacacagggggtaggggaaggattagtacaagatcttgaaatagcagtctgcacaccttgaggaaagggactaccttctaggtgttgcattctgtgcacaaccggacagccttgaactataaatgctgcccagagcagaccaacaccaagcctgctctttcagatggaaatgtttattttctctccccagcgcttgagtttcatgcaaaagcttcatcaggcgcaggccttgcagatcttgtctctaaatgccattcaccagttttcaccttctgtgctgctatcttggtgccatctgtgaagagaaaaacacttttgagtctgctcttttctgtggcataagccttatttgtttgcaggcagtcctgtctctggcagaattttggagatggaggcgggttgaatctgactggtttggcaaccttacctttcccctagtgtcccattaggggcctgatatttcttccctgaaagtaccctgagctttgttaaacaggatagtggaaaacacagaagcaatgcagaatggttgcagagtccaatttaatctgaaaattgcttaatagaccgtgggtttatttgtcttatacaaattatatgcaaatatctgtgtggctattatatgtgcaatggagctatactagttacagaaaaactctggagtctaatttctcattttcggcctgattgtggctgattcaggggaagaccctttctctctgagtttattttccccattttatgagatttgcaggggtgtcataaaacacaactctgattatgattttgtgttcaaaaacctatactggtttcccattgactatgggataaagtccaaatgcctggcattaaaagcattttatgatctgactccaatctatcttagcagccatatctcgccaggttccctctgcgtaccccacagtgtccagccaaattaaacgactggtcattctgggaatgcatttgcttactcagaatagaatacccttcccctcacctctgctcattgaaatctgacccagctttcaggatctgactgtaaatgccacctcttctcagaaattgttctcctccccacttccccaaccaggaataacttcttccttgtctgtactttatggcactacttctacttttcttaaagatgtatcttgccctatagtctttcattcgattggattgaaacctccctgagggcagtgagaatgttctcattcatatttacacacccccaatagtactttaaagagttcgtgtaaatatttggcccttggtaaatgtttgttaaattgaactgaactacttcatgaagcttggggtttttagggttggtctctgctgctgacagttgatcttcagaggcaatttgacttttctctctactaaaatgagaagaggtatcctgtctaggcagataatcagtgcagactggaaccaacatgtgaaagccctttgaatgctttggaatatctacatactatatatattattactaatattttcaaaattaagagttttcttcagaaattaaaatcctttataactatttataaaatttattctatcttaccatctcctctgaaggcagaaattgtctatttttttaacccgaggaaagaccatgacaccatgagttaattactaagcttatggttgaaggtggagatcctttcttgaaacttgtgtcatctgactgtgttatgcttgcctcctggccatctgtgagccctgggagaagctgtcagcgaggatttgcctgtttgttttcagaccattttccccatcaccctcctaccatcaccaccattgtctttttttgttgttaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagaggtgagggaaccaacagacttgtctttgtacttctgaagcagctgcagggtggtgaagggaagggctgagcaggatccaactaggctctttggggttgtccaacccaccggtatgggcagtaaatggctgggcatgtgccaggctaattttttgtgactgcaatagtcctcagtcccaagcttgattgatcaaagtgtggatgtacctcactggtcttctgagcaatgagctgatgtgttaatcaggcaggatccctgctgggactcctggacccacctggcccacccccacaataggtgctgcctcttctttttaacaggttttacagaggcgtgccctttgactgcaagcttgaagtataatgtcctctcttatttccaggactgactgactccttttatttttgactttcacctgataatattgaagactttgggaaatatttctactttaaagtgccttcagcaccttcaaaactgctaaccttggggatggtactttcttttttttttcctttttcttttcttttttttttctttgagttggagtcttgcactgtcgcccaggctggagagcactggcataatctcggctcactgcaacctccacctcccaggttcaagtgattctcctgcctcagcctcctgagtagctggctgggattaccagcgtgcgccaccatgcctggctaatttttgtatttgtagagatggggttttgccacgttggccatgctggtcttaaactcctgacctcaggtgatccacccaccgtggcctcccaaagtgctgggattacaggcatgagtcactgtgcccggccagggatgttactatctttgaattttggttattttatctttaaagtcagggggcccaaatacatgctgctagttgtccctttcaactttgacattacatgagtttaaatactttataataactgtgatactcttttttttctggttaatgaaagatatctttatatatttggggatggataatttcattgaaatttagaattctgcacttaacttaggttttggcagtgaggagtgaaagcattaaatacttacctcctcctccccggccatggtctagtattattttgggattcacatttgcaaactcatgttagtcacccattcctgtttaacaagaagaaacaggcttgttttaccaaaggtcagtatttagagggccaatagtatgtgcatgaaagtttacatttgagaccctgttgattgtctccaaatttcacagagcgtctagagactgccaacaagcagcttgcagagaaggaatatgaggggtcagaggacaccagaaaaaccatctcgcagctctttgcaaaaagtaagtctgcaagctgcagaaacaggtattaacgtgtggatgggagcaaggtgcgtgaaaagattacactgttctctttagccttttagaacagccagggcagagtcaatatcacctaaggattgtttttcctattcaggcatgaagttggaagattctgttcttttcctcctaagccaagaaggctgcttgccacaacatctcgtcacatcacattggtccttcagcattaaactagagaagccccttgaaatccctgctagtgtcattgctatctaaataaagaggcttactgaacatgaggtcccttcatgttgaagggattttcttagaagaaactgtgtgttggctctggtagagatgggattaatatgcaggatcgatgatagtgtttggaatacttcacctgtacctggggctccctagtatttattgttacacagcagcagattgcaaggggagctaatcctatggcctgaactagtgactctggctgcagagttggaggatgtgggggagggcagagctgtgtcttcctcataatagtgtttcctttgtctggaaatactcctaggaccatgacaatgaattaatccttttctttatcagtgtctaatggaccccacccagctagacaatgtctaattatttccaattgccttaataaaaccagcaataaaaacttcatagtggattgagtccacagggagaattagtcggggggaaacatgaactgctctcatttctgcagatgccggtagctagtttcctctacccccagtctccctcagtgtagctctggctgtagttgtgctcagtagggatttgccattctcttccatctttgctaggtctccaaatgaccctttcagctcattccatgcagcttctagccagcttttacaagttcgtttgatcttcacttacaatactgccctcccttcctgggttgttctgttgtgctctggtttcagaacaggttttttctttttcttttccctgtacctcctgttcctttgtcagcatatcttagagtaaggaatgtagtttttctggtgtcatcagtgcctagtataaatttttgtgaaattgcttttgtggtatcacagttgctctcagagctagttcactggcagaaagagggtggcagactctcagatcaaaacaaaacaaaatgtatagattctttgttctggatcagctagatcatactcctttctgtgtggagatggtatttcaggtgtcctaggagctctttacaggtttataaaatgtggtaacttagtaaatcagacggtattaccggcagggcaaaagactgtcaaatggctctaggaaggaaaagtgaagttcatcaactagccagggaagagggcatgactcttgtccctcctaatttctttcgtcttgggacactgacagggtcctgtatggttggaactgtggcaggagaaaggaaagccctctcaaaaagcgtctctggggaatgtactgcaggaatcctagagaaaccaaaccaactcaaccctagaagaaggcagcccggtatagtagaaccaatctgggtgtaaataagggctccactacttatttaccaactgtgggaccttgtacaagttagtcaagctgtctgggtctctgttttctcatatgcaaattggagaggagaatagtaccttccttgtatggttgttctgaggattaagctagtacaatacctggtatgcaatacgtattcaacgaatgttcctttctttccaaatgcaaagtcagagtgggaaagaaggtgagactgccctattgaagtttctcctataacttaaggtttaagtctccagatgaagagcacttaacctccaaaaaatcgaaactacttgtttgagtttctggtgtgaggtctgtcttagttaagaggagaggaaagacaagggacataactacatgtgtcatggtcccctgtagttataatgatttgattcagaaacatggaattgctgattttataggtcaggtgactctcaactttctcatactaaaaattagtgtacagaatctgttgtatcacaatgaaaggttttgaagctacagattctcattactaatcgtggtgatgatgatcatcatctgctttatgtagtaagttcctttggtgtttggttatgctttctaacatttctttcacttaaataaatcttctatctcatttgatccttacaaatattgtgaggttaaataagatggtattgttacctctgttttaccatctagcattgttgattctttcttaacatgtctttctttctgcttatattattgatctgatcttgcatgctgtctactttttttattagagccgttagcatatgaatcatatttgttttaaattcccagtctgttaattccagcatccctgccttatctcggggtctggttctgattcttgccctgtcttttcaaactgtatattttaccttttagtgtgacttgtaggttttttcgtgtgtgtgtgtgaaatggcagacctgatgtatggggtaaaaggcaactgtggtaaataggcctttcaggatgtgatagtaaaatctgggggaaagggaagtgctctagacctatgattaggtctcagtcttttagtgagcctgtgcctctggactgaacttcacaagtgcatctcagttttttttcacccctttaggtggtgcaggatcactagaaagggcttcagctggttatttccttctctcgtgtggaaggccagagcagactggagttggatgtttcctttcccgtgggtcggttaggctctggaaacaaacaagcaagcaaacaaaatcccaaaaactcatagattaggttctggttaaatagtttctcttgagggcaggccttgttaagaacagaatgctctggcatatttcataatggttcctttttccctctccctgctggagtcacaaggggtccatttcacaaatagacatctacaactaggaccaagcaatgaaatctttaagtgattatttgggaagagtgagaattacttcgttggaattcagtgatatcacttcaggtgtaatattctgatattctcattagctgtgggtactggaacaaggtacagccagccactagaagagggcagattgagataagaatagtgtatggaccaaagtgtaaaatctgtttagggattacttataaatctgtattaacttatgcaaatgctagcttgtgatcatgttccttcattctcctaaaaattatagttttggctactgtctcatactggtgctttcttcctctatttttcttatatccatccacagatgtttattaaacgctcattatataggtgctgctaaactgagctctctttaaaacccaagccagaaagaccattatctgcccactaagctcttccattctaaggtcatagagtatatttgtatacacatatgcacacacatgcaagtatttatatacacacatacgtttttgtatatatgcaagtatatatatatatatatacacacacgttttatacatatgtatatatacatatgtataaaacgtgtgtgtgtaagcacacaagcatattggattacttttttttaattttaatttttttgagatggagtcttgctctgtcaccaggctggagtgcagtggtgctatctcggcttactgcaacctctgcctcccgggttcagcctcagcctcctgcctcagtctcccgaatagctgggattacagtcgtgtgccaccacgcccagctaatttttgtgtttttagtagagacagcgtttcaccatgttggccaggatggtctctatctcttgacctcgtgatccgcccaccgcagcctcccaaagtactgggattacaggcatgagccaccgtgcccagccatattggattactttatttaaaaaaaactgaactttcaaactctaataggcttaaagggagaaaaggagattcacaaatagaggatgttttcttcaggtgaaatggctgcctttcttcctctgatcctgatgttttccatctaactttgccctgttctttacagtgttccctccacgcctagcctatcctactggagaaggagtaggataaaagcataacatggcttccagttttagtgtattatcttttaaaagacattggattcccaagagaagcagatgctgagataaagtgggttgggttagggggtggtgttgggttaggttttccgtggagaggacatgttgtcgagtagacttgatctcagttacaaagtgatgttagtgtgtgaagggtgggcatgagcttttatccagtttatgaaatgtcatttttagcactatttaatgtactgtcatgaggaaacaattggaaaaatgttttgagctcaattgctttttgccaatgtaagacaatttggaagaaataaaattgaggagatgagcctaccttttcttctgagggctctgtgtgtgtgtgtgtgtgtgtgtgtgtgtgtgtgtgtgtgtgtgtgtattctttgtataatgcctaataatttttggaacacgttacaactattttctcattgcttctgctcaacaaccattaagttgttaagtgacttttctgaatttctacaacaagttagtgagagagccagtgatagagtccagatcttgggtatactggttcttcagctgtgcactagagcagtaggctatctagtaaagggtatgatgtgtcaattttgctcaggtaaggctttgagctagctccaggctggcagtgttgatgtttaatgtcctgacagataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagaggtatggtttcctcaggtagcatatgagcctgggggtgggagggctgggaaatcggggacactgggctccacattgtggtgaattggcagctgcataatccccagaagggaggtgccatctgctgctcctagtttccactgtgctgatgtgagtggactttgctttcttttctcttcttggtaaattcttttcttttgctccaaaataggaaatcaccagggtcaagaaacagtttccatttgttcattcatataataagctcactgcccccatattccaagctcttactatatacctagccgtaccataagcctatgacagatatataaatatatatatggacatagatgtatagatatgtatatgtatagatgtatattttaatttctgcccttacaggtattttaaaactttataaaactagaaaatacttctaggtagcttaaagtactctaaggattttgaaatctgaacagcccttgtctacccaggcttagtgggaagtcagtcccctctcaggtcagaaatgattcttgctggccatatcttttactgttggacttacttggcagattggtttttgaatagaagcaatcttgggaggtctgagacaggatgggacccagggacagtttacagcttatttcagaaaaaatgctctggccaaaagctgtgctgtggttctcagtggctacttctagaaaatagttacgtggaggaatggacttgtcatttatgtgtgtgcagagatgaagccttcccttgacaaatgcaagggcccccaaactattaagcatatgattaatatgtatctgattaggcttgacatagatgctatttgattgcaacactaaactgtactcatgtgaaatagagggaaatttgctgctggcttgtcattaatttatcttggatgtcagttgttattgcactggactactaactcttagatgttttgcccttcaggggatgggtgtgttccagcaaaaattgatgctagagtgtatcttggtaaagaaaatttcatatctcacagacttctgctctgaaatttgaattgttttaaggggaaaaatagccttcatcataaaaagttgagaaatttgtagatttgaaacaaaagaaatttattagcatttaaaaagcattctggctattgtatatgaggtatctttactgccttcattcattgcttgcttcctttccctcaataagaataggtctagttcctggagatttcccaacttatcaatttcctctgctttcttttttggatattaaaatgcttgttggagttgggctgtaaattcacactttaccagtgggtagtgccatctaattcatgatatcccttagcctgacttgctagaatatcaactccaggtagtataaaatcaggttaatatctagcttcatcagttgtctatattagaactatgctaagttgctcaacagaaaatgaggaagacttgtacttacctgatgtctaggtttaaggagcttattgcatccttttgctacaccccatatattcccttccctcacatttttgtgaggacattccagagaaaattacaggatggggtaagactgaattcttttagagaaggacaagctaagagacctgctgcgaagaagtagcttgctggtggtcacatggccagtcttgggtagagccagaaataaaactggtatctcatgactcttcattccctaaaccctgctgcctttctccctgtctgaatcatcctttggttcacctcccaaaaagaaaatgtgggtgcttgttcagatttagtaacctctgcatcttttaagttttttaaaaatttcttcactcgtcgggcctttcttttcaaaagactatgagaaacttgtccagactgctttgagattggggtgtacagagagtcctgctgcccctccaggaagggtgctcagccagttggagataaatggggacagactgtctgcaaccatttttctttgcaacatccgagggcacagtggtaactggttgtttgaaaatattgaaaataatatatgtgttgggagaaaatgttcatttctagttcccactgggcagccctcgctgaaaaggttgcctgaaatatatttctggcttcagacttctgaggcttttctgggcattagtcctggagatttttagtagttttccaggggccctccccaaaatatgtatgtagctttacaatataaagaagttctaagtattgagctgggattgaatgatggcatttatttcaaatgaggtcatcaattattgttaagttcttagtcctcatccaatttgtgctttcacatggagtctaattgttaggaaattctgagttgctcttgctaaaggaggtgaaacctttgactgggagagcaggcttaccaccctctacccagcggaatctcagaggccatgtgatgtcttccagactttcaagcccgctcacttctagcacatataaacgcttggaagaccacatctcagagaaaatcaactggttcttatttccctttttgttttagcagtctctcagagctggatttgctcctgggcgctgtttgtcgtgtctcctctatattgttcaaaggaaaacatcccttttgcttatcctcagatataggaaattgctaattaaagttttgctttgctgctgtgactcagtcttcattaggctttgctctttcagggctgaaatttcaaagtttggaacatcatcagggaggtatttgaggtaaacaggtagttctggaacagatctaggaaggaaccttcattgtgattgcttcacaaaatcattgaacattgctaaaccgagaaaggtattcatgaatagaagagttatccttctgtctgttggaaatggctcaagtaaggctgtttttgaaggcacatggatatgttagataacctgcctgtgtcccatataaacagataatttagtgatggcttacaaatggcatcatgaactttcctcttttctcgaaccttagaagttcttccaaggaaaacctttctagcctacttagcaaatcaaaattagggaaactttctcaaattagaccttttgtcaggagactatttttctcagccttctaactacaaggtcacttaggtaactacttctcattgcattaaggtggtcagggaaaggttatgactactttaatggtcagaggacccttgcatttatttatgtctttctctttacaaagacctcatttagatgcttttcctgaaattcattccttcttgctaatctcattaactctcttgcctgaggttctctacaatcactgtgctctaaactctacatagaaatgttgcctcaggcttacaaagaactttctcctgcaatcacagcttccatttgctcccaagttcaatgcattctttcatggacctggctctgctgacatccaggaaggaggtatcttgctggggaggggatagcactgtaattataaatcagacctgttttcttggtgagtcactctgatccaggccttgaaccagcgtgtaccctgtgcccctattgcagtagcagccgaacgaggtaaatggtgcctttccgtccttgcccttatctttctttcgggacacgtaggtcctattgaagtggaggctcattaaactccaagtcaaaagagctctgtgtcctacagcaaccacggtattctcccattcaaagacagcctccccaccccctaccaatttgacctcgctggagattttcgatggatgtctggcatatcctctcacaaggctcagggcagcccaggcttctggctggctgctgtcttatgatgatccggagtggaagcggcttgggtaattgtttcagggatggtgggaaaaaggccttggcaagatcaaagagggaagatgctgcgggtgggctgcttactgaactgagtgcacaggaagggagagtgtggaatgtgagagggctggcagagagagccagtgagccttgttctttggctttaggctagaatgaaagccatggagattcaacaagaaggggcccaaatgttaaccttttctgaactgcagtggctagtgatgatgtagatgtcacattgatagctcgtattggagtagccagtgcattttctggagtcccattgcaattctactcaattctctaaggctaaattcataccgttttactccatttccaccattgttcttaagggctaatattttcccttctttctggatctcttactaatttgatttgtctttttggttttaaagatacataattttctgctatgacacctatccacaaagcatcataaccaatttcctgcttccctgatattagaggaagatgtcataggcatagatatttatatgtctaatactccaaaataattttcaaacagcaataggatttcattggtgaaggtaaatcttacccagtgttttgatggattatagatttggatggaagatccaaggatgtgaattatgtgtgcatttagagtattgataggatacagataaaatacatatccacccaggaatcttccaaagtgttctgctggtgcattattgatttatttgaagggcatttcatctaaggatgacattctccatatttatctcagtctattttatctctttctttcttttcttttctttctttcttttgttctctttttattttttatttatttatttatttattcattgagatgcagtctcgctttgtcacccaggctggacagcagtggcctgatcttggctcactgcaacctctgcctcccgggttcaagctattctcctgcctcagcctcccaagtagctgggactacaggcatgtgccaccacgtccagctaattttttgtatttagtaagacggagtttcaccatgttggccaggctgttctcgaactcctgacttcaagtgatccacccgcctcggcctcccaaagtgctgggattacaggagtgagccaccgtgcctggccgtatttacttttaggtaggtgtttttccacccaatgtgttacaagaaagaaattatgtctacccccaaatagagatggagtgatctctctgagctcaattctttcagtctttcctatgattttggcttttggaattcctaaattggaaaccttgtgggtttctctttagtcgcctttacaacatgagccctattcctgaggtagcaagtttttagaggtggttttttttactcttcaattcttttaatatctaccagtggaccacagcctactggcaatggacagaggcagcttgctaataccagggtagtgttaccaaattgcttcagcatgaacccttacttggatccagtggctcctgggtaagactaaatcagatcaaactaaaatcaggctcttggagcaacatataaccagtggtatgaaggagaataacaataaaaatacacttcagttgtgacatttgtataagagtgtttggagttgtggacaatacaggggaagaggaaaattagacaatgaaggcactggacttagttttatatttttaaccttaatgtcctttagccaatggagtgtttgtatatgttggtggtcatccagctggtattaatagtctgtcctttctgcctactgatctgtattttcttgtttgtattttttaaacattaaaaatatttacagatatattagtatatccccaaagaaccttgcaagtgttatcctcatttgacagattaagaaattaaagtacagacagattaggtgatacagtcagtgataaatttaggagaaaacccagatctcttaaatctaaaacattttaaccctgttctttgtccactagtgaataaatgggaagctaaatgattaagtcgcttccttgcaaatggctaagacaaatggggctctagaagtaattttgtatatagccatcctttaaaaaataagtttgaaagacacccacagttgttggaaggagggaagagatgccatcacgtggtattcatttgcagggatcagattttcctgagtcagaagggggttaagagatctgccaaatacttgggaactggttcaaaatattacagaagtgtaatggaaaatcatatgattgattgagctcaagagtatttgccttatgcttcaatagattgccttcccactgttcttcctctcaattttatgattttcctttaaaaacttatctctgaataggaatgatatgaaattcttatcttgactgggccaaagtgaatacatttatgaggtgtgtgtttgttgtttgtatatttgcagtgttgtagataagctatactatgctcatttttgttcttgaatgtaatcgttatttaatattaactgttcaccaagaatatagtgaccagtaaactagaactagaacttaagagagacaccaaggaaaatagaagggctctacccttaagtggcctatggatattgccttccaattgaggcagaaactttgtcttgtttcccgctacatccctcctgctctcatttgtagaatagggcctgatgcataataagcattcagtaaatatctgttgaatgaatgagtgaatccacacatgaataaaatctttaaaaaatgactgcttaatagagtacacatgatgagaagctataaagaaaagcagcaatcaggatcagataagattattcaaggaagaactcttggagagtttagtgatttagtaaggagggataagaaatgatcagaccaatatgaagtttgagtatttgcatagtagacctggaagaattttaagacagttggagcctagattgataaggcatttttaagagccatatctaggctgaacaggggagaatgacagtagactggtgaacgtaaaagcatcaagtagtttgaggtatggatgaaagagagcagctctggtctaaagaagagaggaggtaggtttaaaagtgccttggatataataggtacctaataaacactaattgaatgggtgtgctagcagtagtttaagagtttgctttttctttctttctttctttctttctctctttctctctctctctttctttctatttcttttctttttttctcttcttcctcttctccttctccttcttcttcctctctctttcttgtctttctttcttatcttcctttctttttttgacagagtctctctctgtcgcccaggctggagtgcagtggcgcgatcgcggctcactttaacctccgcctcctgggttcaagtgattctcctgcctccgccacccaggtagctgggattataggcgtgcaccaccacacccagctaatttttgtatttttagtagagacggcgtttcaccatgttgggcaggctggtcccgaatgcctgacctcaagtaatccacccgcctcagcctcccaaagtgctgggattacaggtgtgagccactacatccagccagttgctttttttcttaaatgactatttcaggaagtctgttatagcagctgtctataggatggactcatgggtgggtgtgtgtgtgtctgtgtgtctgtgtgtgtatgtgcatgcatgtgtgtatagatcgggagagcaactgaaagtaagatctgttaggtgttattatagcttaaactgtgttggctatgaacatacaaagaaatgaaagaatatgagagatgttagaattaagacatagtagtagattggatatgatagacaaaggaaagagggaagaatgataattccaagattctgagactggaaaaattaggtaagtgatgatgatgatgactgaactatcaaaaggatgacattttgaggaaagatgaaagccatctggggcatgctaagtttcagagtgagaaatcttatagtcacctagaggtctgtgactgaggataacatgataacattaaaatattagtgtggcacaaaggagatctccagtagtgctgcaatgttgagcaaagtttctgaacctcagcgttcctgacatttggagctggataactctttagtggcggtggtaggatgctgtcctgtgtattgtgggctatttagcagcacccctggcttttagtcaccaaatgccagtagcaccccacctccagttgtgacaaccaaagatgtctccacacattgctaaaatgtcccctggatagttgggcatggtagggggtggggggattgcccccagttgagaaccattgatataaaggcaaaaaaggaaactaccatagattggaccttggagtactgtaggaggcgggagtcagggtagggttagggagaaagtggatctaaagatcaagccagggagtaaaagcagtttagggatctacattaagaaaacacagaattggagaaagcaaggaaaggatttgacaacttcttgaaagttggcatttggtaagaaaactttaatagatgaaggatttactccattcactgaatgttcaagagggatttggcttaaatgatagatttacttggaatcttgagggctcatgggtactggtctctagattagaaactagagtgactaatctgtggtcctcacaactcattttatgcacaaacactcgaaccactatcttggctttggaaattctttaagtgaaccttcagttctttgaacactgaaaacagaaaaataaatcatctagggtcttatgacaagaacacacattatatagtatgtctcttgcatgtacatacacacaaactaaagcaaaacttttgtttttacgcctaagaatgtgacagtacagaatcttaggaccccgtttggctgagccctcttggatattggtcagtgttgaaggtgaaaaggggattctgattcacaaccaatttgggagttaaagactcttagagatcttctgagatcatgtatctagccctgttttttttttttttaaacttctgaaatcctggtggggcagggcattcctaagagagagaagatcatgtgcaaaggcagtgaggggtgaaatattatgggctattcaggaaccttaagctatgtaaccatactgaagcatcaagtatgaaaagatgatggaacaaaataaggtgggaggcccattctctagggaagacaggtaacagacaacaaaaatgaacatgaatacaacacacacaaagctctggcaattgttttttcaggtgaaattttaaatagaaccctaatacgtaaaacacataaaagaggagccatctgatacaacccacccaccatagtggcccctcaagcacctccaccaaacactgggactctgcatcaccatttgaagacctctccaggggtttgccaacttttctctaaaggaccatattgtaaatattttggagtttgtgggccatgcagtttcagttgcaacttcagctgttcgactctgccattgtagctgtaaggcagctatagacaaaatcaatggacatggctggatttgggctgctgctgaccattttggtttgctgactcctgaaacccccctcatttttttaaacaaatgaggtctctgtagctgagaatagagaagcaagttgctattaatagcagagctaggactagaacccaagtctcctaattgtcaccttgttcctttacctttcattgtgctgtcagatagaaatttctgatatgtatatctgtgtgtatgtgacatacacatacacacacacacacacacacacacacagagagagagacagagaaagagggaagagagagagaatgaaagagagagaaagagaatttgttttgcctaggggtctttagttaaatagtactttttatattaggtaaaatatttctttctcctaaagcagaggtaccttgcaaatcatgtcatttggaaagaaatgcagtatccttgcagctactcagtggttgcttctaactgtatttccaatgaacaacttgctatccaaagatatctacagcataaagtgtttgaggcctaatgttatatgtcctcctgtgggaaaatggctatatttgcattgtctaattagacaatgatgtgatcattagagttactgagagaatgatagccatgtcaaggatatctggagtgagtgttcaaagttgagaggactggaatgtgtatggcttggtattaatttttctctaaaaaagaacaaaccacctggagtactttctgtactatacactctactaagcacttaatgcatcatctcatttgatccatataaagatacatcatgatttgtcatgactaaggtaaaagtgaagcacataatgttcaagatagtagtggagttaataaagcgtataggtctttgttcctttttacacgtagataagatctagaaaatgtagagagtgtaacttagaagatggttggctttgttgattgcatctctaggatcttggactggtcacatgcaagagttgtctttttctaccctatctagagagtaggcatttactaggtgattatgatgtttatgggtgagttgcactttttctccttttaaatgaggtgggaaaactatgccagccacagtggtcttgctaccttgtggaaaatcatcccagtggcaaatcaaaatgagatattttttggcttgctttgtggaatttatctgacctgcatgcctatctttagccaactcggagaactccccaggcctttattgcatttcccttccagagagttggctcagtgacttctattgcgggatgcttttgctaggatatttaggtttcctttctgaagaaatccacgtggccctggattgcttatttttcagttttgtgagcttgcattgcagtagtttaccaccaaggcaagaactgcatgctatctaagtttaattgcctttaagtataactgctgcaagccttagtaattatagttcacattctctgcgttaacattgccttgctcccttaggactttcagagcgattcacaaataaatgcattcagctttaaattgctcataaggattataagacccaaaaggtgaaggatagaggttgtttccttctctccaattattcaaagcttagcaaataggaaggcagaggcaaaagttttggttgccctagtcagtgttgttataaacagccacaaatcccggggaagaaaggtttaaacttactgaggtaaagagtttgatggtgttttgtttgttttatttcctaggaaaagttctaatggataaaaacatataggcttcgaactcacctcaactggttttcaaggctagattgaactagacttggaatgaaaggaaatgtcaaagaagtacaacaaaagtcgaaaaaggttttgtttgccagttacctaggcaaggcatactacaggtctggtaggaaaatacaagatagggttccttcgacttagagaaagttcagcaattctaatttgaggagggggccattataagacaaagagggtttttctatcactacatgctagtgctgtctgactggaaattctaccaagtagtgatttggactcattaccatgaaggtttctgcaatgagggagtcaggttggttctgccagctgggccccagctaagtggctgttaggcaatgctggtagggtgggtaacttcttatgttgcagttatctacctaggtaactcaagagcttgggaatttgttgaaaagtcagaatcggatgcctgaatttctttttgactagattatcaagaatattttcatattttaatctgaagagtgaaggtgtctctaacatcaagttgatgttgatccctaacatcaacttccatcagaagaataatgacagatgtgacccacttggaagaatttctgctttggaaacagctatgagttgatttattagcattgaggaggccccacaagtattacgagaagcataatctgcttatttattaacaagttgggaagcctgcagtttccccatatcttctttaaagaagaagatatatatcttctttaaagaagaagatatatatcttctttaaagagctctgagatctttctcattattttatctgcatagtcaagcttttgcttataagctacaaggttgcaaagaactcacactcttattccctacttgcttctacatttgcttttggatatggcttataggcttgcaaagaggaataataatgtttgactcatttagtttcacttttgagtcattaatttgaggctttcgggatcttttatggttccagaataaaagttgagagactatagcccagggtctccaattcaggctcatgaagtagcaatcacaaataacctaaagaactagcaaggcagtgctaggcgatgtggagactaaaggcttttgacccatcacgtgacgcctttacttttgagaagcagaaactttccaggagagcagtgatggattatatggggtgattaccaggaccaaagacttcaaaaagacaattctgactttcttgtaccttcagcagttgatcaccctttttctcccacttggagaagagacagctacataaaaggggtgggctttctttccataccaaagcaaacctttcttcctggagatccacccttttaaagcatttgcctaatgcaataaccaaaataagatatgccttcccaagaataatccatatgagaatgaaaaaggccagagataaggatgtgcataattgggaatctgaaaaacttggccatctaacatagatggtactgataagagtagactttgggaaggtatagagatagggaagaaggaagaggtttaaaaggtattctcgattccttcacattctctttatgagcaatacaaggcagcctgctactcattgtgaaggaccttctcgccatccattcctttttgcagctggactctaaaacaagaagagatctaaacacaaggctggatttaggggatacataattgaccctgttgcttgctgtttttcctttcaccttgcaaattacccaacatggatttccagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcaggtatggagaacttaaaggaagaaagggaaaaaaaagtaagaaaatgacattattcctggttgcttatttttcagttagcatttgacatgaacactgaaagcacacacttgctcatttttacatttttctcccacctaatcttactccagagtgcctcccaattgtgaatacaaagtctgtttccttagcttcctatcccagaaatatcctttaagccttttatcttgcaccttttattttcacatgaactccaggaacagtagacgctgtaagaattagcgctgctacacaaatacacatcttgatattgtagaactagaaatggtcttcagaaatcatctggctgtaccacttttcagttttagatgaatgaaaatcaagactaggaaaagttggcatgagtcactaatgataactacaacaagttatgggcaagataggatctaaatcctagattttttttttcttgagactgagtgcagtggcgtgatccaagctcactgcaacctccaccttccatgttcaagcaattctcctgcgtcagcctcccgagtagttgggattacaggtgtgcaccaccacgcccagctaattttttttttttttgtatttttagtagagatggggattcaccatgttgactaggctggtgttgaactcctgacctcaggtgatccacctgcctcagactcccaaagtgctgggattacaggtgtgagccaccatgcccggccagatttttaaattcccatttctgttgtgtgttatgctggcaggcagggatggcaatttttaggccattaattcactttctgagtagcatgacagtttgatatgacaggcccctttcctggccaagggaacctcacattcaagcccatgataggaagtcctgtggccctgggaggagatctgaattccccctgcttctttctgaatcagagtcgaaacagaagtaggctgggcagtaatcctctccaagaataggggctcagacaccatggttcttctctcactaacttgagggttctctgcatctgccccaacagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagaggtaagtaggtagctggtagggcatgagtgggaagaacagaaaggtcactgattcatagatttttccagtgttttattttctttaatattctgggtttcccccccaatttctgcctaagtgtgttttctttcatctgattatgcagggaatgaacggctgtagagacagagggtcagggatttgaacatcaaagttgttttataaacttcttagaatcatagttcagctttccccagaagccagaatgattgcagatgggatcagctgaaaatttgcacccctccttccccagagccacagattctttcagccacatatgcaggttgtttagccccaggaccggagtgaaagcccctccagagaaactaccactcagaaactaaatgtcactgaggagttgctgctgtcatttgatagctctggcttgtccaaggtatgtcaaaggctgtgctgaacttgaacccatccctgccctttgggaaggtcaatatttgaaggccacattctctatgtgcataacctcatcgtgcgtgagcggtcacatttcatctggtaagggagagaaagtggctggaggatttttactttttgctccttatttgttccccttttcaaattataaaagtcaattattggcctttggaggaaatagttgctcttacctcatgtgtcttaccttgctgctgctcaaaatcatcagttggggtaaaaagaaaggaagaaagagaaagagaaaaagaaacaacaacaaaaactgaattaaagtcaggtgatgacttgggttgtggcgataacagagccttggtctggaattgggtatgaaaggcaggctacagtatattgcacccagataggtctctacccagaaagttattaaaaaccacagtgttgtttttaacattctcctaaacgtggtaagccagcagagtctggaagtgcttgccagactttgggttgggatatgtatgtggagtgggcagtggatacatttatttttgagtccttccatgccaaatcagaggtggggaggttcagtgctaagagctgaaccggtgctttataagcccacttcggttctttaggaagacatgtctctctaatgtcatctgcttgtcttcattagatatcatctatgcctcaaatggatggaagctgcctgtggcttgattttgagcttaagctcatggacttaagcttcctggccttgtttcctaagcaaggcatactcaatacatgccagtgtggcaatagagtgcacagaagccccagctctgccagaagatggtctcgaaggttgtaggcaggttagaagcagaattaaatgtaattttacctgctagctcccaaggaaacacctgtgtccagcacttgttcagaggttatataagaaaccctgatgctgaaaaaacattgttattattgacaggtggaaagatacagggtaattttgtcacgtttaggcagaagcttagaaacatacaggtcacgagagtgtgcagtgtgagaaaatactagaaagctacggttcatggtgcctacttcagaatagactccaggtcaaaatgcaggagagcttcaggggttgtcacttgggggccttgtataaagaaactaccctccttccttcgtcctttgaaagctttgtgtattcggggaaacccctttcagatggattttcagaatctgttggctcccacaaggtagatttaatttaaattgaattcattttaatcatcacgtagaaacttttcatctaatcactgtttttggcaaaatgtgcatgcctatcatttaacaggctaaaacacagcctggttcccacctagaaagaacactttccaatagttccacaggtgaacattccagatcacgactgtgtgtctttctggcatgctactaatccaatccacaggagatgctgacagagagattgtattgaaatttctgtaaaatatgggaattggactaggtgattccttcagaccttcctatttctaggattatattacttttccagtgatagtgcctcttacgttctaccatggaggttggttttcttttcctctttcctttcaaatgagattctatatttgagaggtaacatttagaaaactttattttaaaacctgtgggctcttctgcctttctttccaacatttctttttattccttttgtctacttgttttcctcttctttctctcaatcttaaatgtagctattgaccaaggttctgctctttgcccctttccatggtaaaagttttatattttcttttctttcaaaataatttttttttttttttgagaaggagtctcgctctgttgcccaggctggagtgcagtggtgctatctcggctcactgcagcctccgcctcccgggttcatgccattctcctacttcagcctcccaagcagctgggactataggcgtgtgccaccacgcctggctaattttttgtatttttagtagagacagggtttcattgtgttagccaggatggtcttgatctcctgaccttgtgatccacctgtctcggcctcccaaaatgctgggattacaggtgtgagccaccacgcccgccctcaaaataattttcaagtgtctaggatattggctacaattggaaagtgctcaagtgtatttgaggaaggaaggaaagtagaaaagaaagaagaaaaatggaaggaaggagaaaggaagatgtgaaagcaagaaggaaacaatttctaaatgtataaattatatccctaaatctggtgccacatttcaatgatctgcttggtttctgtgtattctaccaggatctcaaacttaatatattccaaacctaatagctcatttggtaaatgacagatttcacaattaggatatcttgcttggatggtatcaatggtagttgggtaagacaatttttttcaattatgatattggttacatattaaaaaatcacctgttgtaagcgtacggtttgatgaatgttggtaattgtatacaatagtgtaaccaccaccacaattaacacagaggacctgttctaaagtgttcttgtgcccttgaatttgatcgcttcctcccatgcctgaccccaggcaatgactaatctgttattttgtcataaaattataattttcttttccagaatgtcatataaaaggaatcatattgcatttactcttcttgtttgacatattgcactcaacacaatgattttgaaacccattcaagttgatgctgagtagtgttccatggtgtggatgtatcacagtttatgtatgcatatttggatatatgcatattggggtcgtttccagtttttggccattgtgaataataaaatatagattataatataagaacaggcaagtgtcttttctcaggtgataagtcgtattaggtggtctatttataccccttccaacactttgatattatgatacacctcttgtcaaagggaaagctgttgatgttaacgatttcagacaagatcagagcgtgaaaacctaggtttttagccttaaagagtccaggaggaggcattttgatgcatatggaaagtgctggcattgccctttatcctgagatgcatcttaaacatcagatacagcaactctgtgagattggtcagctgtatgtttaggtgaattttccttgatgaaaggttaagagggccaagagataaagagaaagagagagaaaattgaagatattttggcatatctaaaatgagtatttgatacttaaaatatttgttttgttcaaagtgataacaggaaatttatttctttcattttatttagataatttgcccaagatcacacacagctactaaatggcagaagaactaggatttaaatctgtatttttgtctccttagctgctataattctgctgcttcttagaaatggtgtagctcaaagatggtaaaataggaattattagctgttcagtaagatactaattgaggctaattatttagttacctggaaatattataaataatcacaataatatggcctgaattaaggctccatattattttgtccctagggagtcctctctagatgcttaatatagatgaggggaaattactactgagtaggattccttgttcattcgcagaagaaccaatttggcaatgcagatttttagtttcagctcataaacaatgaatttatttctgaagagcagcaaaaggatgacaagataacccacccagtcaactatgtaatttttatcagcttgcatttactgaattaggttgctacctttctcagaatgtgtaatgtttcatgtttattttgagcaaaagtaaattctggaaaggaggaagtaaagaaaagggaagcagaaggtagaagctgttcacacacataatgcatgtctacctattccctctttgtaggcatttctcaatttccttcctctgctttcttctcatcctaccttctgtcttagttatattgttctctgctctagcttctcagtaataatagcaatgataataaccgtaatagtaactctgatatctctaaaattaaagttagaactttgaacaacttgttagatactggcatatggcaattcttaagtcactttcactccagtgtacctaaaatcaaaacccattgcagtgctttccaaaagagcctttcctcagtttccttttacagcaaacagtatttcatctttcctaggcatttgagttcgaaagaacaaagttgttattcattcttccatctccctaactcccacattgatattgtctccaaattctatcagttctacttcctatagcctatttccatttccgttgccacttcgctggtgcatagtttcatgatctgttgctgggattattacaatcaccttgctgactggtctgcctgattccagtgtttcacttctcttatctttctgtcacatttctacgagagataaggccgtcttcctaaggcatggcttagatcattttattcccttggaaagctctaataattttcagcgcctattggaataaagtccaaactcactgctgtactagttaattattgacttttttctcttcccttgtaagtttcctacagttaaggactagtcttatccatgcctttcccctctccagcctcccaggaacttcaaacacagtgctccacttacgtagagttcacatattaaataaacaaaacgatgatgctgataggaaaagataggcttgaagtttgaaaggccactaggtgttttaggagtttattggtgacatgctagaaagcagtttgagcaatgtgatgggataacttcgtcaaaaaaaagaaggagaaagaagatgacaaactgtttacttaagaatttgagatggaggttgtcaacatcaggaatatgcagtttggggtttgcaggttttattttcagatcgtagcccagcatctctctctcctgatgttcttaaagaacgtcttggagtattggaaggtagcaggtcaagttgctcgttcaaatactgtgcttgcttgcttttgcctaagccattggcctggtagccctagtcttctagaaggaagattgatgctgagggctgccctggcagccctgtcggaattcactaagtgccccacattttcaggctccattcctgaggagttaacagtgtccatatcaattagctggcagggctctgagtccccaaaatggtcttttatgcaatgaaagtggcagcaggccagcactagttcccccagtgacaaaccgtatgctcagttccccagtgtccgtagacaccatgcacttttcaacagtcctggctctaaggccccaaccttcacattggaattctgcagtacaggaattgcttccaggattttaccaagagctggaattctttcaagtcagaatctcttgtaatctctgtatgttagtctccttccatctttccacctatgtgattcattctctctcgctctcgctctcctccacctctctctttccctccttctctttttctttgagagacaggggtcttgctgtgtcacccaagatggaatgcagtgacacagtcgtaactgactgcagccttgaactcttggccttaagcaatccctttgcctcagcctcctgagttatgtggttctctcttaataatagctttgttgagtgttttgaccatgcctgacactgtttttacatgcataattttatcctctatgagatgaagttacaaatattgttcccacttggcatatgaagcggcatgcttagagcaggtaatttgactttcagaggtcataaagcttgttaggggcagagtgtacttggagaagctgggacctgctgagttgtctgtattcagagcctgtgctctcaagcactatgcaaatgctgcttcttcttgggtacccagtaggactacaagccagtgaattgcactagagaaagtatagaatgctgagatggtaaaatattttgagtttggcaaatgatgaaagccattgtattctttccccttcttgttctccaattatttcatcattccataaatggtttcaaccttgcatataaggtacacgtatattttggggaacagtaattttatagaggctcaccaaaatccccaatcttaatagcaactttctgcctctttttcttgccgcttcatccccatctgcactagacataatcttgaagctaagagaacatagttagctcccaacagaaaacatgcctggagttctcttgcagatccccattctcttaggaagtataatgaagcagtgccagttcattgttttctcggtctattgtctgatttccttgaagaccaatataattgcatcagtattctccctaatcctaataacctccctcacccgcccaccacacacacacacacacacacacacacacatgtttttccttattaattggtctttgagttaatggcctgagacactttcaaatggaacatgatggtcctttatgcagttagaactctggcaagagaacagtcactttgttggggtagacccattgatttggtgctagaatgtttcagatgtagattagataggaatcgagtgggactgactcaaaggcactatttattagctcacatgccctacctaatcttagctgatgtgtctgttgtttgcttctagtactcaggtgtatttaccaatgttcatctgtagccataagttacttagtataccctctgactttcttgaaagtctgacctttccccctctatgacttctaggagaataaaatggaaatatatacatattccttttttttttttttttgagacagagtctccctctgttgcctaggctggagtgtagtggctcgatctcacctcacaacaaccttcacctcccgggttcaagtgattctcctgcctcaacctcccagatagcggggattacaggcgtgcaccaccatgcctggctaatttttgtatttttagtagagacagggtttctccatgttggccaggctggtctcaaactcctgacctcagatgatccacctgcctcagccttccaaagcgttaggattacaggcatgagccaccatgcctggcccaatatatacatattcctgttgcttggccatgatctaaaaacttgaaggggctatctgccagaaggttttgggatgatatctgttcagttctgaaggcaagtctgtgcatatctcatccctcactgacttttgcagccacttctatactaataacgttgccttctaccctgaacgctgaactgtcctattttggaggctcttacgggttagttccccagaaaccatctgttccaaatgtgcttgatttcagcttaggactttccagaaaagccttccttgacttagaagaaagataacattcattgatcttgctatgctcccatctcatcacttccattttcctccccagggacacaacagtcatcagtcactctcctaacaccagctatgacacagctctagaagctcgcatccagaaagaggaggaagaaatcttgatggccaataagcgttgccttgacatggagggcaggtaaaatgttgttctggaccctgaggaatctgagacattgatatagagaccacataggatctttattcacagctaggaaatctgatcatgcagcctccccgctccaccatcacccctgccagcctgtcacttaaaggtgtgagatgcaatgacctttaccttgataatctccactaaacatggaattccaggtagggtttctgtccctttggccttcctaattgcttttcctcttccctctgcctgagctgaattgttggcatttgcactctggagtattctttctagcactgcaccacaaccctgtgatacagcagattgcttaataaaagagtaaaagaacatctgctcggccgggcacaatggctcacacctgtaatcccagcactttggaaggccaaggcgggcggatcacctgaggtcaggagttcaagaccagcctggccaatatggtgaaaccctgtctctactaaaaatacaaaaattagccaggtgtggtggcgggcacctgtagtcccagctactcaggaggccgaggcaggagaattgcttgagcttgggaggcagaggttgcaatgagtcaagatcatgccattgcactccagcctgagcgacagagctagagtccgtctcaacaacaacaacaaaaagaacatctactcaaagtggaggtaggatacctgattccttttataaacacatgatcatttacttactacctgcaggttgtcgctcattcatagatctcatcttctcactgagtaaattgtttccattgactgagattcttcactacagcacctagtacatcagttcattctctcatattcagccttttttttcactggtactttattgtgacttactaagatttaagcaacagctcctggatgctctgctgtatccatttgggtgtgcagaaaaaagaaaaaacatgttttaaaaactgtagcacaccatcccttgttttccaactcagaactaactagatcagcctttagtcgaaaagataatgggagctccacgtagtcatgtagtcaattagaccaaaatgtggaggtagcaagaaggtttttttttttttttttttttttttgagatggagtcagtcttgctctgtcacccaggctggagtgcagtggcactatcttggctcactgcaacctccgcctcccaagttaaagtgattctcctgcctcggcctcccgagtagctgggactataggcgcctgccaccacacccagctaatttttgtgtttttagtagagacagggtttcaccatgttggccaggctggtctcgaactcctgactttgcaatccgcccacctcggcctcccaaaatgctgggattacaggcgtaagccaccgcgcccagcccacaacaaggtctttatatgttctttgcctttggctcctaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggtaatgacagtaaataaggaagattatagtcacgtgttcaaagagagccctgagataagcacccatgcttaaggaaaagggatgatggtccaggttctagagaggaaggtgtaccagggttttggagtttttttttcctcctgagaccctagttccacattctggagctcctccacactttgaagtctcccggtgagaataccgattgaggccaaggcttagaggacaagaatcttgagtttcatttgggtgtcaaggaagataactctaatttcctctaaactattctcagatttggcctttgccatgtggcacctttatctttctccaaagcccatgtggcctttgtgtcgttccaaatgtcaaaattccggcatttctgtgttccttcctcctctataataggagaacccagagttttagttacactaaatcgtttgggtagcaggttttgttcccacagtgttgtgagatgagaacagaatgtactttttcattccgttcctgtccattccctcccctctaatcaaaaccccagacatattgtggataccacgaggcacatttttagagcccgaggaaggaagcttatatatatttttattttaaccctttttgttgctgttaattcctttcttggtcctctgatacttgtaatatcttttggttagaataagcattttggggactatggtcatggtgagaacctcagatcacacaattattaccacactcaatctgtgtcaacagacttcttccccagatcctttcttgctccctggtaacgtgtggtaatggtttataagtggagccgagtaggagcattctgacaacttggtggaacccaatcaccattggaaaaataaatcaaaacagatacccaggtcacttacaggcttaatatgttgtgccaggtgatggatgaggaccagaagggatcctcgaagtctgtaggaaacttttagccatggttggaggagcctcacacactgatttctgggttccctggaggcaaaaataaataacttagactattctaaattatttaatatttaaaaataataatattttaaatatttaaataatatttacttatttaaaaataaataaatttcttctgaaatttgaatgggagaacaggtaattagatgtctggatttgaatcacctattgttttctaacatctgttcctctttcatttgtaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacaggtaattattccctttagcaggtaggttttggtttagttctgctctcaaatacagatttatttcttgttgtctgatgtctgggcagagttatcatttggactgagtttttcacgttctaaaggagagagaagagagtctgtaaatgacttctcatccaccaagatgggaacaggcatgagtagaggccattatcttagcagaagtaaatgagggaggtggcaggcaagtctcactttgccattggcttcatgagggctctgatggtgtctggttctagaaatatgggttttttcttcatccctaagtgttttctaacccttatttccatttagatgggcctgtgttccactccaatactctggaaagaaaaactcccattcagatcctgggacaagagcctgatgcagagatggtggaatatctcatcta

SEQ ID NO: 4933 - DNA, 66312 bp, human
ccaggagctgccttggcagtcacgccccttccttccgaggagctttctggctgcctaaactggtagaccccctgaattactcctccatctccgctctctttcgcctcctcttctcttagttctctccgcctccccctcaactaccaccacctccagtcagtctcgcctccggctatccgctgctccaccctctggcccggtatcctgcctgtccgctgccaccaaggagagcccggacggagcagcgaggaggggagcagccgggagttggggcttcccccctgcccatccctggccgctggcccgggaccgaagccacttgagcgagcagagagtcgtcaccttgtcttctttgccttcaggggtaggagacgcgtggttacttttcgcggggaactggggcaggaatccatggtggcatgaacttggtcgtgccctcggcgtgagtgaatcgatctaggcgcgtgtgggaatgcccgtgtgttctactttctttgcagctcgccatgagtttttttggatgtgcagcaagttaaatcggttagagtgtgcgctgctttcccgtcctacttcggtgaggagatgctagtgggtaccactactagatggtacttttacttctttacctcctggggttcttgtgggtctctaggtaattaatcacattgaggagctaaagacccgagggaagctgaaatctacatttagcccagcatgcatgtcagtgcttatctcagataactagataggtttctgctaagtgcttaggcttggggtggggactcacactccctgaggcgggagcaggaggggtaggaccgtgaattcttgaagttttaaagtctgtgtaatctaaaacaaggctactctttgagatgtgtggtggtggtggtagtgcttgtggtggtagtgatagtggtggtgaggagggagttgcccctatctgctttagaagatccaaagatgttagtaaatagttttgggggatcttgagggtgtcttgagggtccaagcctgggccactgcacattggtgcttcaacagtaagatgggcttcatgggtttgtgaaaatgaagagaaagaaaagggggagggaaaataacagtctttaatagactgtgagcagttcctggtagattgccactaataataatataataatttgcataaagggactaagtagaattaaatgagcaaggaaagagaaagttggtgagaaacagcattttcaatctctagtgtatgttttagaacgaacttttcaacaacctgggatgtttagtgcatgaagttctcctccctccccgccatgaagagtggacgttgggaggcagtttaaaacttttatgaatataaccctcttctcccattcagagaagaagataattagtcaccataatcttcaatgatgaagggctaaggatatttaagtctccttgagctaggctttgtgaaaagttctttctcaggccagcctttgtgaagccttctcagttagacctttcagcaccctcatttagtagctaagaatagtttgaaatgccattttggatgtggtatacattttcatccatctcccacctatcttcaattggacaagtgcgtcaagcctgtaagtgatggtgttcaaagacttattactgagatgtccttaacccattgcttatttgggaacacattattaacatacattttaaaataactttggttgattttaatgagtgaaaggaaagtaggaaggtagagaagggcgacaattttaaaggctatcctgtttcagatcagctgggagggaaaagctggcctgaccaaactacattttataactggcctgggacattttaacagccaggtggttgtagagtagttgcctctatttacagatgataactaaggttccaactattctgtatgggtttatccggcgtcattgacagacactttctggcactacatcatacttcattttaaattacttctttccttggaaaagttcgtggctttgtaaaattgtaagtgctttttctaccttcacagtctagatgtgaagtaaacctctgaccacaattgtatgtggagtcacttttacatgaaatttgtggatctgtttacctatttaaaagattttagaaagggaattttaataattcatagtcaatgcagttttggatttggaaattaaaatttcatttctggtttatgaagtttgatttattagactaattcccaacaaggacatttgtagagttgctttttctttctgaggttttgtaaagactgcatcagactctagaatgctttaagaatagcctaatcagaaggcagggggatggatactatgaccttgaggtcccattgagtgccagaattctaagtgggtacatctgcttctgtgcctctcccaagagccctctcccagggcctgcgccttctttaaaagggtgtctttgtaattaagcggcccttcttccccatccccctttcttcctttgatccagctttttaaggcctttttttccatttggagacaagaggggtttctcacactttcctgttcccctcttaacgcttcttttcctttaccccagaaaagtcccctgaagttctcaggatggttagaagttgttttgttttgtttggggcgtgggggtggagtgggggagttgttaccaatgaggaggaatagaggatatattccctcttgggaaatgcttgtgaccaggtagcctcctccatggagactgagcatttggaatgcatgagaacagtctattcttggggactgtctggtagaaattgtcctttgcacccattaagcccagcttaaacactgaaaggggtggggagaggtgtgtgtggtcgtactggagccttttaggatggtaaatgggtaaatgtttccaaatctcctattacatcatctctttctcccatggattcagtaggtttagtgatctgcttgacaagttaattagctggggactaaaccaatttgtttagaattgtgatccattgatttcctgtccccaggaatttttgttggtgttttactatgatgtgttgtctttagtcttacttacttttccctccttgctgccttttgtggactttggtccaaattctagggttccacccccaagtcaaaggttagaattttgtcccaggaactaagggggtattaaacaggctggccatactgcattactctcctccatggtgggcttctgaccccttttaacccagagaaaggagggaagtcgccccttccacacacaacacacacaatctgaacaaaaaaaaagaaaaagaaaaagaaagaaagaaaataggaggtcatttgctttataaaagaatccacaacaggttttctttgtaagtactagctttcctagttagtgcctttaaactatgacttgatatataaaaattcactctaactgggccttctcggaagcatatttattgcataaaggaatacataagaatttgtaatgattatcgcttaaattaagtgaggccattatttggcctttgaaatctttttgttatatggaatggagttagttaattgtctaaatcattctggcttgtaataatgctggccacgttagctctggcctacaactgcttgcagaagaaagctagtattactttttgaaaataaatcagactttatagattttgaacaattctaaggatgagactatccaccccatataggtaaaatgttttatttccagctactgtatttgactaacccagggatccagaaagttatttctagtaaataatggcgactgatgccactttaacctaagaatctgcaataagatttcctagtgagcctattggtgagaaggacctgggctctaggcccaactgtaactcggtttactacctctgttaagtttttttttttccactgtaaattatgggtttggacagggtaattttgagagccagttcttatacgtttatggttttctttctaggcctcaatatctagtatgaatgtgaatgattgctactagaatgaagtgcaacagttgttagaaattcaatcatctagtcatcatgttaaagaaaaaaagatcctgtaaggatatatgaatatagatgcattatgttttacattttaacaacccaaaattaagaagctaagactctgtccaaaacttcaagaattccatcatcctaagagatcacctgctttcattttttctagttcctttcaagtcctggttcctgtactaacatgagttttagataattggagccacagatatatacaatgttgcttttcaataagagcccacccaagacttaactttgtgaacccatgtggaggaactaagtcagaatctgaccgaggacacatgaagactcccatatattttgtttctcaaatgccaggagaggctaatggatataataagtaatccctaaacactctctgtgattcaggagttgttcatgtatctagcaaggctgttaatttaattcctttgacctcctgttatccctcccccattcttgttaacaacaacaacaacaaaactagggtccactgtttactttgtgtaaatcattggcaatgatttttaagtcactgtatggtgaaatcccatcaagtgagtataaatttgagtggaatatgaaatctccagaatgagaaaggagaagcaggaaagcacaaatatacttgttttgtagcatggaaaataatatgtttaaattagactaaaagatagcaaagaaactaaggattttagacagttaaataaaagacaagaagtgcagcagcagaatggcccacacataatgggttcttcatctgaggtcttcaccatgtagtcaaatttcatagttctttaattttcctttgataacaaaggtgtggtatacatgtgatctctaagatttgatggattagccaggcatggtagctcacacctgtaatcccagcgatttgggaggcagaggcgggcggatcacctaaggtcaggagttcaagaccagcctgaccaacatggtgaaacccctgtctctactaaaaatacagaattacctgggtatggtggcgcatgcctgtaatcccagctactcaggaaactgaggaataaattgcttgaacctgggaggcggaggttgcagtaagccaagatcacgccattgcactccagcctgggcaacaagagcaaaactccgtctcaaaaaaaaaaaaaaaagatttgatggattcattcctggaaaccagtggctcatcataaattagattaaatttctctaactggaatagaaagtgtggtatgggtttttagtatttagaaagtagcaaatgaggaacaggaacttttttttttttgtaatatatgatcctggagaaaatgcaaatgggtgtatttgccaatgtttcctaaggcaattcttgaaaatctactcttttaagtctgtgggcttgccttgacatttgtaaaggcactttcactcttgccctaactccatgaaatatcattagcctgtgtgacttgaagccaggatctggttttctctgcccagcccctctctgtcttaccatgtgaccaagggtaaatgaattagctgctctaagcttcagttacccttctgggaagcaaggatattaataatcacagaggtgtttcggcatgcttcatattgggcacatgctttgaggtcattggatgaaaggtgtttgcatgatggcagagcaggcttattatagggtcttgagcaggtgttcctttttaatgagctttgctctcttataacatacagtgccctttggtgccccattgccttactgactgtaattaccattaacccaacatttgtattattggccctctcggctttttggaaaaaaaattaaacagttttgtactgtgtggtaagttgaggtacaaataagaggactctagcatcttacagggtggtgaaaaatagcttcaaaaagaaacgttagttgaaaagggctatagagatcagtgagttattcaaagctcctccaaaagatgaaaaagaataaagcaaacttctgtgtgtgtgcgcatgcacgttttaagggagaaagttttcagtaatatttgcttgtgacacatactgatgatagccagtaactgaaacccagccattgtagtgttttatacacagctggattttattaatgatggaatatttatgcttgctgtacaattcgtggctcatttccatgtgtatgtcagaacttaaatacccccaaaagaaacattaagataacatgaaatataaatgtggccaagctagaaagggtggatttggtggagagtctcccttcttcttattggtgtcacatcagatcacaataactgtgccgcccccctatcaaccttaggcattgatactgatctttttttccccttatatataccccatagcaaacttcacatttcaatctttttgatatggacaaacgatctgctctcctctttataatgcagataaaactgatgtatgtgttttttaagagcatattttccctgcacatgcttctcattatccgagaggcctggactcaatcagtaaaggagcagagaaaccacataattgaaaggagaatgacggtggtgcatacttggaatatttgtgggaaggggattgctgacatcagaaaatgtagtggcctgagtgttaacagcattgaagagaaatcagctttctgtgtttctgtgtattgaaaattatttttaagggaataaaaatatgggccaggtttgacatccttttatgaagttgccctggaaactttgatgaagattgttaaagaatagctcaattaaaaccttccccattaggaagctaattagtacatcccttactcattttggttgttttcaaggggcatgtatttgcattgaattagtgacatttgttccatgtgatagcaaactaagataaaaatcacagatggggaaaattatttagattgcctgttttgaagaaacctaattcctctttattacatttagattttcagttcagagttttgttttactatgtttatatacaatgatcacattttagtgtggtagccagttttgctttctggatcatgggctataaaccaaagcttatttgaatttcccgtatgaattagggaaatagaacaaatgacaacaaaccattttattaaggtaagatttcatttttttcttctacaattagtttctctttggtctatgtgtgtgtgcctgagagagagagtaggggaggcagattgtttttttaaaaagcaaacagtttttgaagctaagaaaattttgatgaccccccccccccctttactcccaggaacattctgtctgcctcaggctgggaccagttgggctttggttaggggaacatgatgaattttctgacctggtgctttctgtgaccaggctaagtggttctcccttggaagcctgaaggaaagaggttatggtgagaacaggagtgcaagatttctagcaggttctttttactgtactccacctttttttaggggggtgagtacttgcttctgagattttagggccatttgcagtagagtcaatgctttatagccaaatgtaaaatatgggccagttgtggccctcctttccccgcatcactttaggtgacggtcattctgtacctaggttcccatatgctgtgcccacggtgtaggtgtatgcctgcagtagtttgtgcaaataagaaagttagctgggttatatgatttgtggtttaatctcaccttagtccttcttgggaaggcagggtttagattcagttctgcagtggcacctcaggcaaggcaggttccctgtgcttgcaaggcaacagcaggaggaggaggggctgccttctgccttcagagagtgactcaggccctttggtatgaagatatgaaatgctggctcctgtccatacacctgctggatgccacacctgcagtcagcacctgagccccactcagacacaaaaaccagactgaaggcagatggggctcccttgaaaaggggcacagcgaaacagggagctctcaattatgttagtagagccccactgggaactgggtttagtcatcccagtgttggcgtggggaaacagattactttcttttagatgcagctcactcacttgctcaagatactgttagagtgtttcaggagtttgctttcctaatgaatttctcttgtgaactgtcctcttaaaaactggaggggcaattctgtggagggttatgtcttagaaccaagcacagggcaggaagtcgcaagacctgggttccaatgctggccctaccaatgggcaacagtgaaattctggtccaattagttatgattagctatctgttctggacttgagcttccctctccagttctaaaatggaattaatcacatctgcctttatttccccacagagctgctaagaaggacaaataagatagcagagtgaaagagcttttgtctccttagaaggaaggctgagaaactaaaggtaataataacattattattattgttattccatgtctttctttgttttcttctcctgctgtggcctctagcaaagttttggggaagttatcattcactcagtatgcaactattaagcacattttatgtaccagttaatgttttaggtattgggatgcatacaatgaaaaatcacgcaccccgcccatgccctctaagatcttacagtctagcaacttccctttccatttctggctcaacccgtaatagtgattgctaccagggcactcagaagcttaaaaggtgagagttaacttctttttttctctccacactacagctggggatttctgtccctggagctgtgtattgcaaggtctagcttggagatatatgggaggaaaggccatcgggataaataaaggaatttctttccctcccacatttgcaaagtacctaacccttgaatgatctttttttttttttccccagaagtccatgtttagtttcatcctgggttctgttctgttcctagtcaatatggtccagccctctcttatgaccttagctgtcatccatatgctaatgactcccaaagatatatctcaacctatctttgatgtcaaattggtcatcacactccatgtcttctactcagcttataggtttttgatattttcctcctcttgggagctttttcaggtagcccagggttttttgcagagccctatgtgttgccggagctattagctcatacctctgttttcccgttgaattgggcctcctctgcctgactgggagctcctcaagtactgggctctctttttatttatttatttatttatttatttatttatttatttatttattgccaccctaggccttacctagcacaatgtctggctacagtaagtgctcagtaaaagtttatggaaaatttgctgtgataagtgtcatcatagagaattcattttccatgttgagcagagttgaggtcaggaatagatggagagggattagggaaaaatcttcaaagagaagatggacagcagaactgccttattttgagagttctggctaagaagtcacggaaggaatgcctgttgtgtccactgttgttaaaccaggggcatctctgacctattgcctcccctgctttaggaccggatgatttttatggtcaggtctgcaaatcaacctctgtctataatacattgaccatttaagacaggtgtcacttagtcatctagtattaaacagggctgaccttaaatgtgccaccttaactgaggctgaaaatagagctacacacacaggctcattgatcatgcctgcttagttctatacagcaaaatgtcccttaagatatattgaagattgggatctaaaaactgacaaattcaattctcagaatgtaagcaggttgggtcacaagaactgaatgtcttcaagctgactgtcagatctttccaagggcaaaaatgaaagatgatataagctattacaggccatgaacctgttttcacccacctgatgcttttactaattagcttcttggctgggtggcaatttggggcaagtgcatgcaagctggattcacaggggagcccgcattccactctgccatttcgcaagccactgggatactacactgcttctcttggcttctttccctcccaggagccctgctctgccctggtggaaaaatgagagcgggagaatttttcattaaatgagggagggatttcatgggactctggtgttttgctaattttattttttagtgggttgtctaaaaacatttatgcttcttgacccatcagtttcacttctgggattctatcatgaagaaacaatctacaatattgaaaaaggttaaatcacaaagatgtttttgtaacattatttagattagcataaaattggaagcaatttacatgtcttaataattgaagaatgggtaagtgaatgctgatacacttgtttaatgcactattatgcagccattacgatgttatgaagttatgccacaacatggaaaaagtatttatggtgaggtgaaatgcaggatccaaaattacatcttattaataattcattgcttgtaaaaacccaaatacacataggaaaactaaaggaaatataatgttaacagtgcttaagttgaggtgcttggattataagtgatttttttctttattaaaaataaatgcatgctgtgcttatattacttgtaaaataaaatataagtagatatgaaaatgggtggtctggcattggcggttaaagattggtcaagcaggcagcttctaggtatattcttaaacttttctcattttaggctccatctaattacagggactctttatacttttctcgagataataaagaaggggatgtgatggtgtggtctactcctcttttggaatggatgtgtgtgctgggagatagagggaggtggcaacaggattctccttgctacccagtatgtcactgctcacatccacttcagggttgatcacctttgttgcctataaacatgtttaaggtaattgcttcagagcaaagcaaagtcaaactgggaccaaaaacgaccaagaccttgagttaccatcccagaaacggatctctcacactgatcctcagtaagatttggaaatgccaaggccttgctgtggttcttaaaataatttttcaacctaatctaatagggtgttcaaaaataattgtgatgtttgcaatagagtgtattaagctgtccttgcattgctataaagaagtaccggagacagggtaatttataaagaaaagagttttaatgggctcacagttctgcaggctttatgggaagcatggtgcgaacatctacttggctttggggcgggggcctcaggaagcttgcaatcatggcagaaggcgatgggggagcaggcacatcacatggcaaaagcgagagcaagagacaacgggggaagatgccacacatttttaaacaaccagatctcatgagaactcactatcagaacagcaccaagaagatctgcccccatgatccaatcacctcccaccaaacctcacaattcaacatgagatttgggcagggacacacatccaaactatatcatagaggtagagataggaacaaagaagagttggggctgactcttctcttaagccttttcttgaactagtgctagagttaggtaagagcaaatgccaagctggtatgatattgaacagacctggaacagggggcctggaaacatccatctgtggaggttcatgttgctgttcaatccacctcacatcttagcctaaaaagcgaatttgcaaagcctttctatagtagtacttctagctaaacacttcccccttactgccttgaattttccttccttccattaacattttacttccaatggaactggaaaatcagtggtagcgttaaagcaggtttatagtcttttaaaatcagggtcaattctatgtaataaatagttattaagcatctcctttgtacaagcaaataatgctagataatatgttgtagtggaagggctcttgccctaggcgttataaaaactttcattttggtcctggctctctcttaccctttgaggccctggcatcttcatctatacaagaagagggtgggaccactaggtggtctccctttccagttctggctttcaatgatctaaggacccctgtgtagtagactgagttgcaaataaagtttttttgtttttgtttttcaaaaaaacaacctttcttcataaaattgctgtacacttctaaaaaaaaaaaaggctactttgaaataacaattatagtaatagcttacttttattgaggccttactatgtgccaggctccatgcttagcactttacatggattaattcccttaatctttataacaaccctatctagtatgaacaccattatccctattttgcagatgatgaaattgagacttgggagatcaagagacatgtacaaggtctgttagtaagccatacatccaggatttaaacttgggcagtgtgactctaggcccagactctgtgccacggtgtttatgatgcctatccattgagataacctgcaaaaggaccattgtttttcacatcctaaatgaagtgaattggtatcttgggttgcaagactgttgggaaagttattctctagggtactttggctacaatatggaccaacctgagagaacataagaatttactggggcctcactttttgtgagaggttatgtgtgtgtgtgtgtttgcacaaatacatacacataggtacagggaaaactttgaactggcccccttccatttatctgggagtcaaattggatgaaacaagttgaccaagatttagcagagaaacagctttcttagacttagattctttatcctggttggtagaatgagaggtaggggcagaatgtgggagggtttagaagaggggatagaaagaagatcttataggcatattgcaaaatttatttgaagggtgggagtttggtctgtcctgaccaccttgtaatgttgattttctgggacttgtcttgggaaacattaatgtgttttggctcaacctcacaggtgtattgggagaggccaatgactgcaaatggagtaagaatttagcttggccttgcttccctgttgttgttacagaagagttgattatatagattcaaattgcatttttaaagacagaaccgcaattattctttttttcctatcaaatattctcagagacagtctgtgtgcccaggacaaacaaggttattttattgattgaagatgatgtcagacccctggcagtggcatgattaaagctacagggagattaaaggttatagtgttcatactgttttagttcttgtgcatgaaacaaggagtcttttcctttcctttctcaaataaatggagtagtgttttcctcattatgtgactcttgacatgtagatgaacataagttctttaagaaaaaaatagtaaactggagaggactctgcaaagcttttttcttaggctgatttcttttttaaacaagagacaaagatggcaggaggagggtgagagggtaggggaacgatctgtgtccagttaacataaagtgatttgggttttgaaaaggatatggaggggcctagcgtggtggctcacgcctgtaatcccaacaccttgggagaccgaggcaggcagatccctgaggtcaggagttcaagaccagcctggccaacatggcaaaaccctgtctctactaaaaatatgaaaatcagccaggcatggtgacacgtgcctgtaatcctggctacatgggaggctgaggcaggagaatcacttgaacctgggaggcagaggttgcagtgagccgagatcccaccactgcactccagcctgggtgacagagcaagactccatctcaaaaatagataaataaataagaaaaggatacagaggacagaattgagagaagagagtaagaccttgcacgagaaaagttttctcaatgaagagctgagtatcaggagaaagtcagtaatatcagcatgaagaatctaagtagtactggaaaaaaatcatatggtagtttctctccagggactcgcgtttaaaagccttgggctgttttctggtgtttcagttggaaaaaaaaggatgagtgttttgttcagaattggacaatagaagcacggtggttatgtaccatagctctgttaacagtccagctttgattccaattagaagttgttcctctgcttcaaaattaggggagataccctaaaataattaccttgcagatttgagatgattttgcttttgatcatgattatatgttgtgccaaaacaagatggaaagacacatttccgtgtttgttcactctatatctgttcactttatttttggcaacattgcaaggaaataatgttaaattaatcactttgtggttttgtggagtttttaaaaacttgaatgttttgaacatgctctcaaaatacagagatgtttgtgtacttcttttgcattgctttcctcctctcatggagtcactggtgtggattaagcctttcctttaagtgatatgaatgaatcatacataggccaggatagaagataggaatgtggttcatgtgcatgtcacttaaactcctgagtcttagaatcattttgattaggctgacaaggctttgcagagagtccaggcagaaattagacataaggactatctcaaatccaggtctattattcatttgcatccagtctatataatgtaagtctatgagttttttttactgagacactggggcagtggaagtgccaagaaagcaagtggaggcatcttctgcttggagaagggttgcgctctgtgttgggaagggcagtctactttcctactccaagaatggatggaccattgatcagatgatcagagtgtaagctccatgagggcaggaattatattttatgtgtctttgtagcccttattgtgtctagtatgaggctgacaaatgtgtggaatagttgatacacaataaatacttaatgacttggttgaaaagaaggttcttcccctcccctccacctatctgagcttgaggcactcaaattgggagcctcactgagtgttctttttttgaccaaaaacctaccttatgatgactgccctcccttctgggatgtgggacagtgagcctcactaacctcccctgctactaatagcagtttaaagtttgcaccctaaaggtgacagtggttttggcttttgtcatcatccaccattccaacttggaatggaagtggtagctttctagggctgtgaggtcagaacagagcaagtctcagacctgaacatttccatcactggagactggcctggccttccggacacagctactggacactgaggtttcttttctgccctagtggagatggactctgctactcatttaaaagccaagcaccataggaggacaagtcattctcttggaagaactggtttgattaactgctggccattggtggcaaaatagaaacgacgtttttatttctccctccctccctctcctgaacatttcagagtgaccagtggttggactcttggcggcgcttaccctgaacctgagtgttaggggagagggaatctgccgttgcggtttctggagctgctcataagcaagaattccctatcctgatcaaggctttaagcctaaaagaaagcagaaataggtatggaatatttctgtgtgtgtgtgtgtgtgtgtgcacacgctcgtgcatgtgtgtatgcatgtgtgcctgtgtgcatgctgggtggggtgggtgtgacgtgggagggggtggtatacttttcagggtccagggcagctcagtgtctgcatttccctgccttacagggagggtttgtaaatcacttttgctttaacaccatacttgttcctgtttccagtttgtgagcagggaaaagtaatttggtagtcatctctctagttttgggcaccaaaaaggatttatatattatgcttgtcagcctatcagaatatcccaatttgacagttcaagtacaggagtcctggaggcacattgggaggaatggaaaagggactgggttgcttaacccactggtgtgcacttcccaagagaatatgatgagagggactttggagggtcccttcgtgttgtcagactgcccagcgcaacagttggaagccaggtagcagtaaccaacaagacgtgaagaaagagagaagatgaactttcttcatatactatatgtacattctgggtcactctctctctgcatgaccaaaagaaaggggttcgtgtttccagagagattgcaggccacttaatatcatagaaataagagcctgggagccagggatccagagttgccatctagaaacctgatgctggttaaactgacctttattgtgacttttcgtgtgacattatgttcattctccaccaattactgaagatccttagagtgaaagtttcattattgaacattattacttaattccaatacttaacattgacagattctgcccaaagaatttttgaatctctaatgaattagtgtgtactatacagtgctgagagagagaaatcacctaccagccattttttgttgagaaaatagacatcaagaaaagaggaatcagttgtataccctgtaaaccaatagtatgattagaatttgaatattaaattgtgttactaaaatcagtttcagtcaacccatagtacctgttcagaagaattgatggtgagggaggggatatgctaatcgtataccctttccagaaggatgatctttatatttttcaatttctaaattttgtcagaggcacacttcaaataaaagaggcttcccctttaagcttctacccaataacaataacagcaaatctaaatgactgtttctggagagctgaaaggcaactttgtcagtaataagtattccaagtccttctcttattaagccaaggagcatccaaaatggagactatgaaaatgattttttaaaaagatgtttcagagccttatgagatcagagaaaaagatttgcatcgaggcagggatcattactgtctggtgcaagccaagctctcttcaccttttatttatttgagtctttattttgcattttgtagctgccttcatatgctgagctgctttacaaatcctgttatggggtaactttccccactgtcctgcccccacctccacagccataagatttgggtttttgctttaaatagaatacagagagatgaagcctgtgaatatggaccttgaaaagttaccccctttgattaccctagttgactgttccaggtttctcaagcattcttaggagttaagtccagattgaatatttaactcatgctaaaagtgaaagagaaaacctagagctcttatgcctccatgttcttcatcatatcagtgctagggcctggaatccccaacaatctattaattttagagtcaattctctactttgtttctgcaatcgaatcctcaccctccaatatccattttctttccctttagaggactgatttatccatcaactgggtgttaagcttcctgtttccccttcccaggtcaagggcagcccaggtgcccaatttctctctctcttcacaaggcaccaccagcaatagagatgagaaattctgaagaacagccaagtggagggaccacggtattgcagcgtttgctacaagagcagcttcgctatggcaatcctagtgagaatcgcagcctgcttgccatacaccagcaagccacagggaatggccctcctttccccagtggcagtgggaacccgggccctcagagtgatgtgttgagtccccaagaccaccaccaacagcttgtggctcatgctgctcgacaagaaccccaggggcaggaaatccagtcagaaaacctcatcatggagaagcagctgtctcctcgaatgcaaaataatgaagaactcccgacctatgaagaagccaaggtccagtcccagtactttcggggccaacagcatgccagtgttggagctgccttctatgtcactggagtcaccaaccagaagatgaggactgagggacgcccatcagttcagcggctcaatcctggaaagatgcaccaagatgagggactcagagaccttaagcaagggcatgtccgttccttgagtgaacgactaatgcagatgtcactggccaccagtggagttaaggcccatccacctgttaccagtgctcccctctccccaccacaacccaatgacctctacaagaatcccacaagttccagtgaattctacaaggcccaagggccacttcctaaccagcatagcctgaagggcatggaacaccgaggccccccaccagaatatcccttcaagggcatgccaccccaatctgtagtgtgcaagccccaagagccagggcacttctatagtgagcatcgcctgaaccagccagggagaacagaggggcaactgatgaggtatcagcatccccctgagtatggagcagccaggtaagagagttctgtttctgtcatttcctgacctcatccccaaccagcttctgctgtgtgttgggaatcttagggaaggaacgggcaggtgtttgatataacaaactctgcaatgcatgacaggcctctggcttcgtgaattgcctgccaacccgaatttgtatcctctttagccataattagcactgtattaacaatcccttagctttgtaggttgagcatggcctcaactgcctagtggacgaacaggagcaaaagtcttgttttcagcagctatttgctgtcctctctcctaggatgttgaaggggtctgtgtttctcataagccctccttgagaggtagaagcaaattaccttgcactttaattagtctggaacatcctatcacttgcacatattcccctccatgaagctttcatcatttatttttgcaaacaaatctgtgtatttcttgtcagttaccatttttccatagaattaccattattcttttggactaaacaaacacccagatgttatggtgggggagctatgtatgtatgtaggttcagaatgttacttgccttatgcttgcagtttatgaaatctggactgttgtatcttttttttgtagagaatttattagttgcctgtcacatttttaaacctctgagttaaattcccatcacatcatatagaaattttggtcagatgctaaaatacagaaggaaaaatattaccatttctgtcttatatatttagttgttcctatatatacttcttaattattcagaggtccattgtcccactgctatattcactagaccttatgattctatgattctgttcattgttcctgttgttagtatttgggccatgtctctgatcagtagtatttccacatatagggcaggagaaaaggtttaaaccatggggaccgatggtggcatttaagtgtggtatcctgcctcatggccatgagtaatgatgggtgaccatcaggtttgaagtgcttggtcctaggctggccttcatttatatgcggctcacagactaggtctgtgatgtcctttgatgtctacctctttgtctcctgtaccctacttgctcattttggaaaaaaccttctggcttgaagttcattgagtgactcaggagagaaggcagtcatggggtggagtagggtgaaagtgagagaaggcacctagcatttcctggtatttcttttttttcccctgcaggtcctgtttttgtagccagaggcaattcactttggactccacctctaactttgccagtttaggatttttttttttttttccctcttaacccaggttgatttcctaacccttttcaacctcctctgtgcagctttcaaagggcaggagcctatgttctgatcagtgtcttggaacaggaaatggggtaaccaacaaggctactcaggtttaaaagagatcaagaaccagattcccatctgaccaatgaaacagaagacccagggaggggttggtctgttcaagactgcctcacttagtggaaacccattcaagccagcaaaatatcaatgaagctgggggtttttattttgcttttcccatcagtatggaagagtctgttgatgggctgatgtctgttgccttgtgggaggggagtgtgttggctggggtgtggagcagaagccacagccccactcagcacacagcccgccttcccaggaaagctattttcagaactcattcaccagtattgtttgtgatctgaaatgactcccacagtgtttgaagctagatggaaaattatctgccctttgatctgcctaaataaataatgaggagcccaaagaggttttctttttttttccttttcttcccatcctgattaaaccaccggagaaatttagctgcatgtattttacaggaagatacatattttttatcctcccacctaagttatctgtggatttctctttctttctgtcctcaaaagcaacagagcccatgatgatctacccttgttgagcagcattttaatacacagttttgctgtaacaggtttttctctatgggaaaggagcagagtgcttgataatgcttgatgaataagcaaacctaaaatggccctagtgggaggatgctccatatgaaatttgggtctgcatcaggcaaatactggccgtaaaattgttgcagggccctacatgagggagtggcacctattgacaaattactggcaaaaggaggtagttgaactgctttccagaagtgtactgctttaaggtggtgacacattttccctcctttatttcctttaaccaactagctatacagtttgtgagtacctttccaagtaactgctgctagcagcaaccaattagaagactacattctgagcccttaatccacaaattacaagtcaggatgcaaagcaaactctttgaacaaattgctgttaagaaaacatttgcttgcttttcgaggtgcagtgaactgctggagatttgctgttaaaatgaacaaaattataaacaatccttttattacttcatctttcttatgccctcctccccttaaaaaataaataccttgaatgcccagaaccccagatgagaaacaaggcaaaggctatctgaataattttaaaatttcagaatctttgtctttctaagtgctgaaccttttctgcatcctgggtttatacatttatcaactgcttttaaaaattaaatcatttctgtttataaagcagccacctcctttcaattgttgaaatcatgcccagatctgaggtttcttgaaatccttgtttagtggaatctaagggtgacctaactctgtagttcagagcagagctggttgtgcaagagaaaccatcaggaatttgcagcctgctccaggattcacagattcaccgattcaccattgcagagcctgggaaaggcagtttctgtggtgaggatcaatcaagttccaggctattgggtggcacctgctctggtgagagtgtgtgtgcaggattgcacatgtgtgtgccaggagtgtggagtgtgtgtgtgcatgcacatgtgtgcatgtgtgtgtggctggggagggtgagggctcccagtcatcgaggtggcagggtggaaggtgctgtgtcagctgggtagagtggcttttactttccctttgagtccttactactgtctctgggaggagtgtaccccccaccctaccccacttcccagctttggggaggatcctgattttagtcactggcctttgtcctgcatgtatgctatgtccccttttctgcagagccccagtggcccaggtagccttaggaaggagcaggatgaggggacggaagtggcaggaggcaggtcagggcttgcatggaatcatgtgattctgttgtctgcaggcggcttgttgttcctggttaacgtgtcagtggggagcgattcaggctgctgtgtgctggaaggacctggagagtgtgctgctcacatggctgccacctttattattactgtcattacttttactgttattatttaacttggggtgtattttggcttcctctgacatccgccccctccaactctcccttaccccgtcattccttaatctctttttctcacggggagcttcaccccagtgttcattccgtcctgctttcccctggtgggtggatgctggagcccagattgagttcttcactgaagggctttctctccctttgtgactgcccaagccattgctggtttgcaaaccagccagtgacgggctgccttggttttcccaacatcacggtgcactgagatctgcttccttttccagcctggggaattgaggggcagctgccttgtctctgcttatcttcatcctcagcttatctgaccccagagacctccttctggagacctcatggtctcctccttcccaaggtccctggaaggccatgtgctgttgtccagggaatgcaggggcctttcagtctccaggcaggagggaggccagtggctgagtttgtttgagagagaggcctgggttgcttgatgaggcccaggggagctgtggagagaaagcccatttcagaactgggcgttcagtctttaaaagagaatacctcccaggccttggactgcaaatcctgggaacaaaaatgaaggttaatatagtgatttttttcccttaaaatttgagagctgcattggagaacatgaaacttaagcccctcttttctgcccacaaagcagaaaagagacacacaagccccaacaaatctcaggacattatattttaactctgtaggcatgtagaaattgtaatagctctcattcaaagagaaaaaagagcacttagtcttttacctgtgaggaaactgaagatccatagaatggaaaataggagctcttcaccaaataaatgtataaataactcccaggcttttgattgaatgagtgctttgagctctggggaaaaatattatgtatggcagcaactttccagttgtacttatgagtaccatgtcaattcttctttgcccaaatagttcgcatgccctcttcaatattcagcaattatttataatgacagatgtatgtgattggaagaatgtgggtacaccagaggcatagatgggcctgagcgacagaatccagggtttgtacaggtttgaggactcttggggaagatgtaggttattgggtatccatgagaaagtgtttggaatgattttgtagctgtaaaaagcccttatagttaagatctcttgtaaagatggatacatgaacagtaatggtaactggagtgtgtgtctgaggaatgtgctttagcatctggaatgccagttaaaagttaattgctcctggtgatttgtcccagttccaccatgaattttatgcaatttattgcaaagattaaatggatatcctttaagtaacaagctaacaaggtcagcttatctcactgggaggtagagaagtgactgtaattcctattccgccaaaaatgagaagaccccagtatttttgcaatttatttgtgacctcaagaataaaatgggctcatgcagattaagtaacttgcaccaagttacacagctcgtgagcagtagaagaggtctccagactccctctgttgggatccagatcccatgcacttagccatctgtcttccctggattgagaaatatcaactgtagaacaagtgtccacaggacatgggagcatatgaggttaattgggcatgagctagggcatgaacaagctttttgtcttcagtgcacactgacagatactattcctggtagtggtgatggtggaagtgatccatccacatactaattgtttcccttaatggctaatagtcattaggtatgaattatttatacttaggtgttagcattttgtacctggtaattaggtacaaaaatgggagagccacattaaacaatgtaccaaaggtctctttctggaactttctatgagcaataggttggaaatctaagtatcagtgcacagaaatcaatgcattatggcagtagaaaaagccagaaaatgggaattgggaaagaaggattctatcttggcaccaccactctaatatttggcagatgacttcccctttctggacctcattccccatctgtccagtgatagagttgaactaaataattttcttttaaggcctttccagttcttacattttgcgattcattacatcaaaaatagtatgttagcattgcttgtaaccctcttcaagtctttttatggttactgctaatgggaatcattaaatcgttaacaactggaagcaacaataatcatttagtgtctctaatataagtatctaccaatccttgaatagttttttttctttttttttgtgaatgtatgaattactaaagggagttgcagatagcaagatgggggtggtttttatggctgtttgttgtttccatcctggcaaatggaacatagtttctaaactaggatctttatgtgtgctggaccacgtgtataatgtcagaaaaggtttaatttaaaataatgagatgaaaattaccttgtagaagaatcgtttgaaatgtttagacttgagcaaacgggtgtacaggtgtgtatcactacgattttcacaaagtgaccatggaagttgtctggttctgaccctcatgggatcacacctctgtttgtcaggcagaggcacagaaggtcaggctggaaaagggctgtggtctttgcagagatagagcaggcagggttagacttccccatagtcagaccctgcctgctcttcattttgcaggtgtcctgggggcatcagaagcctcctcatctcacttttgtgtgcccttctcccccagtgccttaggagagaaattaacccgcacctgcccttcatgttttacaggccagcgcaggacatctcattgccattgtcagccaggaactcgcagcctcacagccctacttcttctctgacctctggggggtccttgcccttgctacaatctccaccatccactagattgtctcctgcccgacaccccttggtcccaaaccagggagaccattcagctcacctgcctaggccgcagcagcatttccttcctaatcaggctcaccagggggatcattaccgtctctcccaacctggcctgagtcagcagcagcagcaacagcagcagcagcaccatcatcaccatcaccaccaacaacagcagcagcagcagccacagcagcagccaggagaagcctattcagctatgcctcgggctcagccatcctctgcttcttatcagccagtgccagcagacccttttgccattgtttccagagcccagcagatggttgagatcctctcagacgagaaccggaacttgaggcaagagttggaaggatgctatgagaaggtggcaagactgcagaaggtgaggcttccgttttgggatattagggtctctaagtctttatttgtgagacttgtttaatatccacattaaagtctccagttgtgaatcccagcattacttgtggcaggtcttcaggatttttatatctgaaggttagatatgagtcaaactttggaaaaagccttctacctgtctacctaggagaagtaacgtcttacatttacacaaggagaaaaaaatttatgcagtttttccagacgctatagccctaaagaaaacgtgattaattcttttagaattccaaaaggcagtgatacttcttgataagaatactggtgatgcctttataggtaaaggatctgacggcaccttaaggctcattgtcttggtcacattttcccaaatatgaatttgaatcttaaatataaaaataaatgtagttcctagaaaaatctcaccagctaaagtttgagcagtcctgccttgttctggaaaaggctcagaatactttttcctagtgggagttctcatagtaactctctttcaacaatccctccaccccaccctttgatttggtccctccctgcagctcaaattcaacatctgctctctttctctgttgtatgtggggggcaggaggggcttaacaccacagctgggtgacaggtgacagccctaggctgaggaaatagaaaaaggagtgtatctccagttcacattcttctctgcccacccccattgggactttacctctggagtaccccaagcgaggaaccttagctcttggcttccaggggctgctggtgaatagggttatgcctttggccgcttctttgcagcttttgtcattgtggagctattgtggtttggtctccctacaatgtgaactgttcagagaggtgagggtgaaggtgggggagggacaggaggatgccttgtattgtccagcaactctgtccttaggaaacaccaggagtgaaaatttcagaggcctgaatgaagctgagtatttgtaaacagacaccaaatctgggggcctcaaggagacaggggcttattatcagcagatgattttttttctttctttctttttttttttttttgagacggagtctcgctcttgttacctagcctgcagtgcaatggcacgatctccactcactgcaacttccgcctcctgggttcaagcagttctcctgcctcagcctcctgagtagctgggattacaggcatgtgtcaccacgcctggctaattttgtatttttagtagagacggggtttctccatgttggccaggctggtctcgaactcccgacctcaggtgatccgcccgccttggtctcccaaagtgctgggattataggcgtgagccactgcgcctggcaaacagaggatttttatataggaaaatggcttccctgtcccttagttttcctaaatctggatgagggttgttggagtgctctgagaattgtttcttcccggcttttccctgattttgtattttcacccgcaaattttaactatatccctatccccatcgctttggtgaaataaattaattatatccatacactagaaacccagtctggctgattaggctaacagttgacaccccctctccaaactctctcttcatggtgatcccagcccatctttgatacaatcactgaaggatgaacccagctctaatacgggccctttttgccagaggatccatggtgattttttgtgtgtgtgggagtgggttcagccagtgacagggaagagggacagagaataggattgctgttgtttgttccccaagatgggaaaagatgcctcaaataagtgtaactggaacagcttgaatgttgggaaagtagaggctgacccagtgtcgaggtagagtagaggggaaggtggaccaggagaggaaaaggaaagtggggaaaattaaggtagatcccaggtagtgctggaggaaatgaaaaggcctgaggctcatgaggggaataagtagacagagtaagtctggaaaacccactgccaccctcctctctgcccccaccatcacccagcccaaaccagtggatatatccttctgtgatggcttttcctggaaggccctattgagagctgtgggacttgcccttttgaaggatggagtatctacacagggggtaggggaaggattagtacaagatcttgaaatagcagtctgcacaccttgaggaaagggactaccttctaggtgttgcattctgtgcacaaccggacagccttgaactataaatgctgcccagagcagaccaacaccaagcctgctctttcagatggaaatgtttattttctctccccagcgcttgagtttcatgcaaaagcttcatcaggcgcaggccttgcagatcttgtctctaaatgccattcaccagttttcaccttctgtgctgctatcttggtgccatctgtgaagagaaaaacacttttgagtctgctcttttctgtggcataagccttatttgtttgcaggcagtcctgtctctggcagaattttggagatggaggcgggttgaatctgactggtttggcaaccttacctttcccctagtgtcccattaggggcctgatatttcttccctgaaagtaccctgagctttgttaaacaggatagtggaaaacacagaagcaatgcagaatggttgcagagtccaatttaatctgaaaattgcttaatagaccgtgggtttatttgtcttatacaaattatatgcaaatatctgtgtggctattatatgtgcaatggagctatactagttacagaaaaactctggagtctaatttctcattttcggcctgattgtggctgattcaggggaagaccctttctctctgagtttattttccccattttatgagatttgcaggggtgtcataaaacacaactctgattatgattttgtgttcaaaaacctatactggtttcccattgactatgggataaagtccaaatgcctggcattaaaagcattttatgatctgactccaatctatcttagcagccatatctcgccaggttccctctgcgtaccccacagtgtccagccaaattaaacgactggtcattctgggaatgcatttgcttactcagaatagaatacccttcccctcacctctgctcattgaaatctgacccagctttcaggatctgactgtaaatgccacctcttctcagaaattgttctcctccccacttccccaaccaggaataacttcttccttgtctgtactttatggcactacttctacttttcttaaagatgtatcttgccctatagtctttcattcgattggattgaaacctccctgagggcagtgagaatgttctcattcatatttacacacccccaatagtactttaaagagttcgtgtaaatatttggcccttggtaaatgtttgttaaattgaactgaactacttcatgaagcttggggtttttagggttggtctctgctgctgacagttgatcttcagaggcaatttgacttttctctctactaaaatgagaagaggtatcctgtctaggcagataatcagtgcagactggaaccaacatgtgaaagccctttgaatgctttggaatatctacatactatatatattattactaatattttcaaaattaagagttttcttcagaaattaaaatcctttataactatttataaaatttattctatcttaccatctcctctgaaggcagaaattgtctatttttttaacccgaggaaagaccatgacaccatgagttaattactaagcttatggttgaaggtggagatcctttcttgaaacttgtgtcatctgactgtgttatgcttgcctcctggccatctgtgagccctgggagaagctgtcagcgaggatttgcctgtttgttttcagaccattttccccatcaccctcctaccatcaccaccattgtctttttttgttgttaaggtggagacagaaatccagcgcgtctcggaggcatatgagaacctcgtgaagtcatcctccaaaagagaggccctagagaaagccatgagaaacaagctagagggcgagattcggaggatgcatgatttcaacagggatctgagaggtgagggaaccaacagacttgtctttgtacttctgaagcagctgcagggtggtgaagggaagggctgagcaggatccaactaggctctttggggttgtccaacccaccggtatgggcagtaaatggctgggcatgtgccaggctaattttttgtgactgcaatagtcctcagtcccaagcttgattgatcaaagtgtggatgtacctcactggtcttctgagcaatgagctgatgtgttaatcaggcaggatccctgctgggactcctggacccacctggcccacccccacaataggtgctgcctcttctttttaacaggttttacagaggcgtgccctttgactgcaagcttgaagtataatgtcctctcttatttccaggactgactgactccttttatttttgactttcacctgataatattgaagactttgggaaatatttctactttaaagtgccttcagcaccttcaaaactgctaaccttggggatggtactttcttttttttttcctttttcttttcttttttttttctttgagttggagtcttgcactgtcgcccaggctggagagcactggcataatctcggctcactgcaacctccacctcccaggttcaagtgattctcctgcctcagcctcctgagtagctggctgggattaccagcgtgcgccaccatgcctggctaatttttgtatttgtagagatggggttttgccacgttggccatgctggtcttaaactcctgacctcaggtgatccacccaccgtggcctcccaaagtgctgggattacaggcatgagtcactgtgcccggccagggatgttactatctttgaattttggttattttatctttaaagtcagggggcccaaatacatgctgctagttgtccctttcaactttgacattacatgagtttaaatactttataataactgtgatactcttttttttctggttaatgaaagatatctttatatatttggggatggataatttcattgaaatttagaattctgcacttaacttaggttttggcagtgaggagtgaaagcattaaatacttacctcctcctccccggccatggtctagtattattttgggattcacatttgcaaactcatgttagtcacccattcctgtttaacaagaagaaacaggcttgttttaccaaaggtcagtatttagagggccaatagtatgtgcatgaaagtttacatttgagaccctgttgattgtctccaaatttcacagagcgtctagagactgccaacaagcagcttgcagagaaggaatatgaggggtcagaggacaccagaaaaaccatctcgcagctctttgcaaaaagtaagtctgcaagctgcagaaacaggtattaacgtgtggatgggagcaaggtgcgtgaaaagattacactgttctctttagccttttagaacagccagggcagagtcaatatcacctaaggattgtttttcctattcaggcatgaagttggaagattctgttcttttcctcctaagccaagaaggctgcttgccacaacatctcgtcacatcacattggtccttcagcattaaactagagaagccccttgaaatccctgctagtgtcattgctatctaaataaagaggcttactgaacatgaggtcccttcatgttgaagggattttcttagaagaaactgtgtgttggctctggtagagatgggattaatatgcaggatcgatgatagtgtttggaatacttcacctgtacctggggctccctagtatttattgttacacagcagcagattgcaaggggagctaatcctatggcctgaactagtgactctggctgcagagttggaggatgtgggggagggcagagctgtgtcttcctcataatagtgtttcctttgtctggaaatactcctaggaccatgacaatgaattaatccttttctttatcagtgtctaatggaccccacccagctagacaatgtctaattatttccaattgccttaataaaaccagcaataaaaacttcatagtggattgagtccacagggagaattagtcggggggaaacatgaactgctctcatttctgcagatgccggtagctagtttcctctacccccagtctccctcagtgtagctctggctgtagttgtgctcagtagggatttgccattctcttccatctttgctaggtctccaaatgaccctttcagctcattccatgcagcttctagccagcttttacaagttcgtttgatcttcacttacaatactgccctcccttcctgggttgttctgttgtgctctggtttcagaacaggttttttctttttcttttccctgtacctcctgttcctttgtcagcatatcttagagtaaggaatgtagtttttctggtgtcatcagtgcctagtataaatttttgtgaaattgcttttgtggtatcacagttgctctcagagctagttcactggcagaaagagggtggcagactctcagatcaaaacaaaacaaaatgtatagattctttgttctggatcagctagatcatactcctttctgtgtggagatggtatttcaggtgtcctaggagctctttacaggtttataaaatgtggtaacttagtaaatcagacggtattaccggcagggcaaaagactgtcaaatggctctaggaaggaaaagtgaagttcatcaactagccagggaagagggcatgactcttgtccctcctaatttctttcgtcttgggacactgacagggtcctgtatggttggaactgtggcaggagaaaggaaagccctctcaaaaagcgtctctggggaatgtactgcaggaatcctagagaaaccaaaccaactcaaccctagaagaaggcagcccggtatagtagaaccaatctgggtgtaaataagggctccactacttatttaccaactgtgggaccttgtacaagttagtcaagctgtctgggtctctgttttctcatatgcaaattggagaggagaatagtaccttccttgtatggttgttctgaggattaagctagtacaatacctggtatgcaatacgtattcaacgaatgttcctttctttccaaatgcaaagtcagagtgggaaagaaggtgagactgccctattgaagtttctcctataacttaaggtttaagtctccagatgaagagcacttaacctccaaaaaatcgaaactacttgtttgagtttctggtgtgaggtctgtcttagttaagaggagaggaaagacaagggacataactacatgtgtcatggtcccctgtagttataatgatttgattcagaaacatggaattgctgattttataggtcaggtgactctcaactttctcatactaaaaattagtgtacagaatctgttgtatcacaatgaaaggttttgaagctacagattctcattactaatcgtggtgatgatgatcatcatctgctttatgtagtaagttcctttggtgtttggttatgctttctaacatttctttcacttaaataaatcttctatctcatttgatccttacaaatattgtgaggttaaataagatggtattgttacctctgttttaccatctagcattgttgattctttcttaacatgtctttctttctgcttatattattgatctgatcttgcatgctgtctactttttttattagagccgttagcatatgaatcatatttgttttaaattcccagtctgttaattccagcatccctgccttatctcggggtctggttctgattcttgccctgtcttttcaaactgtatattttaccttttagtgtgacttgtaggttttttcgtgtgtgtgtgtgaaatggcagacctgatgtatggggtaaaaggcaactgtggtaaataggcctttcaggatgtgatagtaaaatctgggggaaagggaagtgctctagacctatgattaggtctcagtcttttagtgagcctgtgcctctggactgaacttcacaagtgcatctcagttttttttcacccctttaggtggtgcaggatcactagaaagggcttcagctggttatttccttctctcgtgtggaaggccagagcagactggagttggatgtttcctttcccgtgggtcggttaggctctggaaacaaacaagcaagcaaacaaaatcccaaaaactcatagattaggttctggttaaatagtttctcttgagggcaggccttgttaagaacagaatgctctggcatatttcataatggttcctttttccctctccctgctggagtcacaaggggtccatttcacaaatagacatctacaactaggaccaagcaatgaaatctttaagtgattatttgggaagagtgagaattacttcgttggaattcagtgatatcacttcaggtgtaatattctgatattctcattagctgtgggtactggaacaaggtacagccagccactagaagagggcagattgagataagaatagtgtatggaccaaagtgtaaaatctgtttagggattacttataaatctgtattaacttatgcaaatgctagcttgtgatcatgttccttcattctcctaaaaattatagttttggctactgtctcatactggtgctttcttcctctatttttcttatatccatccacagatgtttattaaacgctcattatataggtgctgctaaactgagctctctttaaaacccaagccagaaagaccattatctgcccactaagctcttccattctaaggtcatagagtatatttgtatacacatatgcacacacatgcaagtatttatatacacacatacgtttttgtatatatgcaagtatatatatatatatatacacacacgttttatacatatgtatatatacatatgtataaaacgtgtgtgtgtaagcacacaagcatattggattacttttttttaattttaatttttttgagatggagtcttgctctgtcaccaggctggagtgcagtggtgctatctcggcttactgcaacctctgcctcccgggttcagcctcagcctcctgcctcagtctcccgaatagctgggattacagtcgtgtgccaccacgcccagctaatttttgtgtttttagtagagacagcgtttcaccatgttggccaggatggtctctatctcttgacctcgtgatccgcccaccgcagcctcccaaagtactgggattacaggcatgagccaccgtgcccagccatattggattactttatttaaaaaaaactgaactttcaaactctaataggcttaaagggagaaaaggagattcacaaatagaggatgttttcttcaggtgaaatggctgcctttcttcctctgatcctgatgttttccatctaactttgccctgttctttacagtgttccctccacgcctagcctatcctactggagaaggagtaggataaaagcataacatggcttccagttttagtgtattatcttttaaaagacattggattcccaagagaagcagatgctgagataaagtgggttgggttagggggtggtgttgggttaggttttccgtggagaggacatgttgtcgagtagacttgatctcagttacaaagtgatgttagtgtgtgaagggtgggcatgagcttttatccagtttatgaaatgtcatttttagcactatttaatgtactgtcatgaggaaacaattggaaaaatgttttgagctcaattgctttttgccaatgtaagacaatttggaagaaataaaattgaggagatgagcctaccttttcttctgagggctctgtgtgtgtgtgtgtgtgtgtgtgtgtgtgtgtgtgtgtgtgtgtgtattctttgtataatgcctaataatttttggaacacgttacaactattttctcattgcttctgctcaacaaccattaagttgttaagtgacttttctgaatttctacaacaagttagtgagagagccagtgatagagtccagatcttgggtatactggttcttcagctgtgcactagagcagtaggctatctagtaaagggtatgatgtgtcaattttgctcaggtaaggctttgagctagctccaggctggcagtgttgatgtttaatgtcctgacagataaagaaagccagcgtgagaaggagaagctggaagcggagctggccactgcccgttctaccaatgaggaccaaagacgacacatcgaaatccgagatcaggccctgagtaatgcccaggccaaggtggtaaagctggaagaagaggtatggtttcctcaggtagcatatgagcctgggggtgggagggctgggaaatcggggacactgggctccacattgtggtgaattggcagctgcataatccccagaagggaggtgccatctgctgctcctagtttccactgtgctgatgtgagtggactttgctttcttttctcttcttggtaaattcttttcttttgctccaaaataggaaatcaccagggtcaagaaacagtttccatttgttcattcatataataagctcactgcccccatattccaagctcttactatatacctagccgtaccataagcctatgacagatatataaatatatatatggacatagatgtatagatatgtatatgtatagatgtatattttaatttctgcccttacaggtattttaaaactttataaaactagaaaatacttctaggtagcttaaagtactctaaggattttgaaatctgaacagcccttgtctacccaggcttagtgggaagtcagtcccctctcaggtcagaaatgattcttgctggccatatcttttactgttggacttacttggcagattggtttttgaatagaagcaatcttgggaggtctgagacaggatgggacccagggacagtttacagcttatttcagaaaaaatgctctggccaaaagctgtgctgtggttctcagtggctacttctagaaaatagttacgtggaggaatggacttgtcatttatgtgtgtgcagagatgaagccttcccttgacaaatgcaagggcccccaaactattaagcatatgattaatatgtatctgattaggcttgacatagatgctatttgattgcaacactaaactgtactcatgtgaaatagagggaaatttgctgctggcttgtcattaatttatcttggatgtcagttgttattgcactggactactaactcttagatgttttgcccttcaggggatgggtgtgttccagcaaaaattgatgctagagtgtatcttggtaaagaaaatttcatatctcacagacttctgctctgaaatttgaattgttttaaggggaaaaatagccttcatcataaaaagttgagaaatttgtagatttgaaacaaaagaaatttattagcatttaaaaagcattctggctattgtatatgaggtatctttactgccttcattcattgcttgcttcctttccctcaataagaataggtctagttcctggagatttcccaacttatcaatttcctctgctttcttttttggatattaaaatgcttgttggagttgggctgtaaattcacactttaccagtgggtagtgccatctaattcatgatatcccttagcctgacttgctagaatatcaactccaggtagtataaaatcaggttaatatctagcttcatcagttgtctatattagaactatgctaagttgctcaacagaaaatgaggaagacttgtacttacctgatgtctaggtttaaggagcttattgcatccttttgctacaccccatatattcccttccctcacatttttgtgaggacattccagagaaaattacaggatggggtaagactgaattcttttagagaaggacaagctaagagacctgctgcgaagaagtagcttgctggtggtcacatggccagtcttgggtagagccagaaataaaactggtatctcatgactcttcattccctaaaccctgctgcctttctccctgtctgaatcatcctttggttcacctcccaaaaagaaaatgtgggtgcttgttcagatttagtaacctctgcatcttttaagttttttaaaaatttcttcactcgtcgggcctttcttttcaaaagactatgagaaacttgtccagactgctttgagattggggtgtacagagagtcctgctgcccctccaggaagggtgctcagccagttggagataaatggggacagactgtctgcaaccatttttctttgcaacatccgagggcacagtggtaactggttgtttgaaaatattgaaaataatatatgtgttgggagaaaatgttcatttctagttcccactgggcagccctcgctgaaaaggttgcctgaaatatatttctggcttcagacttctgaggcttttctgggcattagtcctggagatttttagtagttttccaggggccctccccaaaatatgtatgtagctttacaatataaagaagttctaagtattgagctgggattgaatgatggcatttatttcaaatgaggtcatcaattattgttaagttcttagtcctcatccaatttgtgctttcacatggagtctaattgttaggaaattctgagttgctcttgctaaaggaggtgaaacctttgactgggagagcaggcttaccaccctctacccagcggaatctcagaggccatgtgatgtcttccagactttcaagcccgctcacttctagcacatataaacgcttggaagaccacatctcagagaaaatcaactggttcttatttccctttttgttttagcagtctctcagagctggatttgctcctgggcgctgtttgtcgtgtctcctctatattgttcaaaggaaaacatcccttttgcttatcctcagatataggaaattgctaattaaagttttgctttgctgctgtgactcagtcttcattaggctttgctctttcagggctgaaatttcaaagtttggaacatcatcagggaggtatttgaggtaaacaggtagttctggaacagatctaggaaggaaccttcattgtgattgcttcacaaaatcattgaacattgctaaaccgagaaaggtattcatgaatagaagagttatccttctgtctgttggaaatggctcaagtaaggctgtttttgaaggcacatggatatgttagataacctgcctgtgtcccatataaacagataatttagtgatggcttacaaatggcatcatgaactttcctcttttctcgaaccttagaagttcttccaaggaaaacctttctagcctacttagcaaatcaaaattagggaaactttctcaaattagaccttttgtcaggagactatttttctcagccttctaactacaaggtcacttaggtaactacttctcattgcattaaggtggtcagggaaaggttatgactactttaatggtcagaggacccttgcatttatttatgtctttctctttacaaagacctcatttagatgcttttcctgaaattcattccttcttgctaatctcattaactctcttgcctgaggttctctacaatcactgtgctctaaactctacatagaaatgttgcctcaggcttacaaagaactttctcctgcaatcacagcttccatttgctcccaagttcaatgcattctttcatggacctggctctgctgacatccaggaaggaggtatcttgctggggaggggatagcactgtaattataaatcagacctgttttcttggtgagtcactctgatccaggccttgaaccagcgtgtaccctgtgcccctattgcagtagcagccgaacgaggtaaatggtgcctttccgtccttgcccttatctttctttcgggacacgtaggtcctattgaagtggaggctcattaaactccaagtcaaaagagctctgtgtcctacagcaaccacggtattctcccattcaaagacagcctccccaccccctaccaatttgacctcgctggagattttcgatggatgtctggcatatcctctcacaaggctcagggcagcccaggcttctggctggctgctgtcttatgatgatccggagtggaagcggcttgggtaattgtttcagggatggtgggaaaaaggccttggcaagatcaaagagggaagatgctgcgggtgggctgcttactgaactgagtgcacaggaagggagagtgtggaatgtgagagggctggcagagagagccagtgagccttgttctttggctttaggctagaatgaaagccatggagattcaacaagaaggggcccaaatgttaaccttttctgaactgcagtggctagtgatgatgtagatgtcacattgatagctcgtattggagtagccagtgcattttctggagtcccattgcaattctactcaattctctaaggctaaattcataccgttttactccatttccaccattgttcttaagggctaatattttcccttctttctggatctcttactaatttgatttgtctttttggttttaaagatacataattttctgctatgacacctatccacaaagcatcataaccaatttcctgcttccctgatattagaggaagatgtcataggcatagatatttatatgtctaatactccaaaataattttcaaacagcaataggatttcattggtgaaggtaaatcttacccagtgttttgatggattatagatttggatggaagatccaaggatgtgaattatgtgtgcatttagagtattgataggatacagataaaatacatatccacccaggaatcttccaaagtgttctgctggtgcattattgatttatttgaagggcatttcatctaaggatgacattctccatatttatctcagtctattttatctctttctttcttttcttttctttctttcttttgttctctttttattttttatttatttatttatttattcattgagatgcagtctcgctttgtcacccaggctggacagcagtggcctgatcttggctcactgcaacctctgcctcccgggttcaagctattctcctgcctcagcctcccaagtagctgggactacaggcatgtgccaccacgtccagctaattttttgtatttagtaagacggagtttcaccatgttggccaggctgttctcgaactcctgacttcaagtgatccacccgcctcggcctcccaaagtgctgggattacaggagtgagccaccgtgcctggccgtatttacttttaggtaggtgtttttccacccaatgtgttacaagaaagaaattatgtctacccccaaatagagatggagtgatctctctgagctcaattctttcagtctttcctatgattttggcttttggaattcctaaattggaaaccttgtgggtttctctttagtcgcctttacaacatgagccctattcctgaggtagcaagtttttagaggtggttttttttactcttcaattcttttaatatctaccagtggaccacagcctactggcaatggacagaggcagcttgctaataccagggtagtgttaccaaattgcttcagcatgaacccttacttggatccagtggctcctgggtaagactaaatcagatcaaactaaaatcaggctcttggagcaacatataaccagtggtatgaaggagaataacaataaaaatacacttcagttgtgacatttgtataagagtgtttggagttgtggacaatacaggggaagaggaaaattagacaatgaaggcactggacttagttttatatttttaaccttaatgtcctttagccaatggagtgtttgtatatgttggtggtcatccagctggtattaatagtctgtcctttctgcctactgatctgtattttcttgtttgtattttttaaacattaaaaatatttacagatatattagtatatccccaaagaaccttgcaagtgttatcctcatttgacagattaagaaattaaagtacagacagattaggtgatacagtcagtgataaatttaggagaaaacccagatctcttaaatctaaaacattttaaccctgttctttgtccactagtgaataaatgggaagctaaatgattaagtcgcttccttgcaaatggctaagacaaatggggctctagaagtaattttgtatatagccatcctttaaaaaataagtttgaaagacacccacagttgttggaaggagggaagagatgccatcacgtggtattcatttgcagggatcagattttcctgagtcagaagggggttaagagatctgccaaatacttgggaactggttcaaaatattacagaagtgtaatggaaaatcatatgattgattgagctcaagagtatttgccttatgcttcaatagattgccttcccactgttcttcctctcaattttatgattttcctttaaaaacttatctctgaataggaatgatatgaaattcttatcttgactgggccaaagtgaatacatttatgaggtgtgtgtttgttgtttgtatatttgcagtgttgtagataagctatactatgctcatttttgttcttgaatgtaatcgttatttaatattaactgttcaccaagaatatagtgaccagtaaactagaactagaacttaagagagacaccaaggaaaatagaagggctctacccttaagtggcctatggatattgccttccaattgaggcagaaactttgtcttgtttcccgctacatccctcctgctctcatttgtagaatagggcctgatgcataataagcattcagtaaatatctgttgaatgaatgagtgaatccacacatgaataaaatctttaaaaaatgactgcttaatagagtacacatgatgagaagctataaagaaaagcagcaatcaggatcagataagattattcaaggaagaactcttggagagtttagtgatttagtaaggagggataagaaatgatcagaccaatatgaagtttgagtatttgcatagtagacctggaagaattttaagacagttggagcctagattgataaggcatttttaagagccatatctaggctgaacaggggagaatgacagtagactggtgaacgtaaaagcatcaagtagtttgaggtatggatgaaagagagcagctctggtctaaagaagagaggaggtaggtttaaaagtgccttggatataataggtacctaataaacactaattgaatgggtgtgctagcagtagtttaagagtttgctttttctttctttctttctttctttctctctttctctctctctctttctttctatttcttttctttttttctcttcttcctcttctccttctccttcttcttcctctctctttcttgtctttctttcttatcttcctttctttttttgacagagtctctctctgtcgcccaggctggagtgcagtggcgcgatcgcggctcactttaacctccgcctcctgggttcaagtgattctcctgcctccgccacccaggtagctgggattataggcgtgcaccaccacacccagctaatttttgtatttttagtagagacggcgtttcaccatgttgggcaggctggtcccgaatgcctgacctcaagtaatccacccgcctcagcctcccaaagtgctgggattacaggtgtgagccactacatccagccagttgctttttttcttaaatgactatttcaggaagtctgttatagcagctgtctataggatggactcatgggtgggtgtgtgtgtgtctgtgtgtctgtgtgtgtatgtgcatgcatgtgtgtatagatcgggagagcaactgaaagtaagatctgttaggtgttattatagcttaaactgtgttggctatgaacatacaaagaaatgaaagaatatgagagatgttagaattaagacatagtagtagattggatatgatagacaaaggaaagagggaagaatgataattccaagattctgagactggaaaaattaggtaagtgatgatgatgatgactgaactatcaaaaggatgacattttgaggaaagatgaaagccatctggggcatgctaagtttcagagtgagaaatcttatagtcacctagaggtctgtgactgaggataacatgataacattaaaatattagtgtggcacaaaggagatctccagtagtgctgcaatgttgagcaaagtttctgaacctcagcgttcctgacatttggagctggataactctttagtggcggtggtaggatgctgtcctgtgtattgtgggctatttagcagcacccctggcttttagtcaccaaatgccagtagcaccccacctccagttgtgacaaccaaagatgtctccacacattgctaaaatgtcccctggatagttgggcatggtagggggtggggggattgcccccagttgagaaccattgatataaaggcaaaaaaggaaactaccatagattggaccttggagtactgtaggaggcgggagtcagggtagggttagggagaaagtggatctaaagatcaagccagggagtaaaagcagtttagggatctacattaagaaaacacagaattggagaaagcaaggaaaggatttgacaacttcttgaaagttggcatttggtaagaaaactttaatagatgaaggatttactccattcactgaatgttcaagagggatttggcttaaatgatagatttacttggaatcttgagggctcatgggtactggtctctagattagaaactagagtgactaatctgtggtcctcacaactcattttatgcacaaacactcgaaccactatcttggctttggaaattctttaagtgaaccttcagttctttgaacactgaaaacagaaaaataaatcatctagggtcttatgacaagaacacacattatatagtatgtctcttgcatgtacatacacacaaactaaagcaaaacttttgtttttacgcctaagaatgtgacagtacagaatcttaggaccccgtttggctgagccctcttggatattggtcagtgttgaaggtgaaaaggggattctgattcacaaccaatttgggagttaaagactcttagagatcttctgagatcatgtatctagccctgttttttttttttttaaacttctgaaatcctggtggggcagggcattcctaagagagagaagatcatgtgcaaaggcagtgaggggtgaaatattatgggctattcaggaaccttaagctatgtaaccatactgaagcatcaagtatgaaaagatgatggaacaaaataaggtgggaggcccattctctagggaagacaggtaacagacaacaaaaatgaacatgaatacaacacacacaaagctctggcaattgttttttcaggtgaaattttaaatagaaccctaatacgtaaaacacataaaagaggagccatctgatacaacccacccaccatagtggcccctcaagcacctccaccaaacactgggactctgcatcaccatttgaagacctctccaggggtttgccaacttttctctaaaggaccatattgtaaatattttggagtttgtgggccatgcagtttcagttgcaacttcagctgttcgactctgccattgtagctgtaaggcagctatagacaaaatcaatggacatggctggatttgggctgctgctgaccattttggtttgctgactcctgaaacccccctcatttttttaaacaaatgaggtctctgtagctgagaatagagaagcaagttgctattaatagcagagctaggactagaacccaagtctcctaattgtcaccttgttcctttacctttcattgtgctgtcagatagaaatttctgatatgtatatctgtgtgtatgtgacatacacatacacacacacacacacacacacacacagagagagagacagagaaagagggaagagagagagaatgaaagagagagaaagagaatttgttttgcctaggggtctttagttaaatagtactttttatattaggtaaaatatttctttctcctaaagcagaggtaccttgcaaatcatgtcatttggaaagaaatgcagtatccttgcagctactcagtggttgcttctaactgtatttccaatgaacaacttgctatccaaagatatctacagcataaagtgtttgaggcctaatgttatatgtcctcctgtgggaaaatggctatatttgcattgtctaattagacaatgatgtgatcattagagttactgagagaatgatagccatgtcaaggatatctggagtgagtgttcaaagttgagaggactggaatgtgtatggcttggtattaatttttctctaaaaaagaacaaaccacctggagtactttctgtactatacactctactaagcacttaatgcatcatctcatttgatccatataaagatacatcatgatttgtcatgactaaggtaaaagtgaagcacataatgttcaagatagtagtggagttaataaagcgtataggtctttgttcctttttacacgtagataagatctagaaaatgtagagagtgtaacttagaagatggttggctttgttgattgcatctctaggatcttggactggtcacatgcaagagttgtctttttctaccctatctagagagtaggcatttactaggtgattatgatgtttatgggtgagttgcactttttctccttttaaatgaggtgggaaaactatgccagccacagtggtcttgctaccttgtggaaaatcatcccagtggcaaatcaaaatgagatattttttggcttgctttgtggaatttatctgacctgcatgcctatctttagccaactcggagaactccccaggcctttattgcatttcccttccagagagttggctcagtgacttctattgcgggatgcttttgctaggatatttaggtttcctttctgaagaaatccacgtggccctggattgcttatttttcagttttgtgagcttgcattgcagtagtttaccaccaaggcaagaactgcatgctatctaagtttaattgcctttaagtataactgctgcaagccttagtaattatagttcacattctctgcgttaacattgccttgctcccttaggactttcagagcgattcacaaataaatgcattcagctttaaattgctcataaggattataagacccaaaaggtgaaggatagaggttgtttccttctctccaattattcaaagcttagcaaataggaaggcagaggcaaaagttttggttgccctagtcagtgttgttataaacagccacaaatcccggggaagaaaggtttaaacttactgaggtaaagagtttgatggtgttttgtttgttttatttcctaggaaaagttctaatggataaaaacatataggcttcgaactcacctcaactggttttcaaggctagattgaactagacttggaatgaaaggaaatgtcaaagaagtacaacaaaagtcgaaaaaggttttgtttgccagttacctaggcaaggcatactacaggtctggtaggaaaatacaagatagggttccttcgacttagagaaagttcagcaattctaatttgaggagggggccattataagacaaagagggtttttctatcactacatgctagtgctgtctgactggaaattctaccaagtagtgatttggactcattaccatgaaggtttctgcaatgagggagtcaggttggttctgccagctgggccccagctaagtggctgttaggcaatgctggtagggtgggtaacttcttatgttgcagttatctacctaggtaactcaagagcttgggaatttgttgaaaagtcagaatcggatgcctgaatttctttttgactagattatcaagaatattttcatattttaatctgaagagtgaaggtgtctctaacatcaagttgatgttgatccctaacatcaacttccatcagaagaataatgacagatgtgacccacttggaagaatttctgctttggaaacagctatgagttgatttattagcattgaggaggccccacaagtattacgagaagcataatctgcttatttattaacaagttgggaagcctgcagtttccccatatcttctttaaagaagaagatatatatcttctttaaagaagaagatatatatcttctttaaagagctctgagatctttctcattattttatctgcatagtcaagcttttgcttataagctacaaggttgcaaagaactcacactcttattccctacttgcttctacatttgcttttggatatggcttataggcttgcaaagaggaataataatgtttgactcatttagtttcacttttgagtcattaatttgaggctttcgggatcttttatggttccagaataaaagttgagagactatagcccagggtctccaattcaggctcatgaagtagcaatcacaaataacctaaagaactagcaaggcagtgctaggcgatgtggagactaaaggcttttgacccatcacgtgacgcctttacttttgagaagcagaaactttccaggagagcagtgatggattatatggggtgattaccaggaccaaagacttcaaaaagacaattctgactttcttgtaccttcagcagttgatcaccctttttctcccacttggagaagagacagctacataaaaggggtgggctttctttccataccaaagcaaacctttcttcctggagatccacccttttaaagcatttgcctaatgcaataaccaaaataagatatgccttcccaagaataatccatatgagaatgaaaaaggccagagataaggatgtgcataattgggaatctgaaaaacttggccatctaacatagatggtactgataagagtagactttgggaaggtatagagatagggaagaaggaagaggtttaaaaggtattctcgattccttcacattctctttatgagcaatacaaggcagcctgctactcattgtgaaggaccttctcgccatccattcctttttgcagctggactctaaaacaagaagagatctaaacacaaggctggatttaggggatacataattgaccctgttgcttgctgtttttcctttcaccttgcaaattacccaacatggatttccagctgaaaaagaagcaagtgtacgttgacaaggtggagaagatgcagcaggcccttgtacagctccaggcagcatgtgaaaaacgtgagcagctagagcaccgtctccggacacgactggagagggaactggaatccctgagaatccagcaggtatggagaacttaaaggaagaaagggaaaaaaaagtaagaaaatgacattattcctggttgcttatttttcagttagcatttgacatgaacactgaaagcacacacttgctcatttttacatttttctcccacctaatcttactccagagtgcctcccaattgtgaatacaaagtctgtttccttagcttcctatcccagaaatatcctttaagccttttatcttgcaccttttattttcacatgaactccaggaacagtagacgctgtaagaattagcgctgctacacaaatacacatcttgatattgtagaactagaaatggtcttcagaaatcatctggctgtaccacttttcagttttagatgaatgaaaatcaagactaggaaaagttggcatgagtcactaatgataactacaacaagttatgggcaagataggatctaaatcctagattttttttttcttgagactgagtgcagtggcgtgatccaagctcactgcaacctccaccttccatgttcaagcaattctcctgcgtcagcctcccgagtagttgggattacaggtgtgcaccaccacgcccagctaattttttttttttttgtatttttagtagagatggggattcaccatgttgactaggctggtgttgaactcctgacctcaggtgatccacctgcctcagactcccaaagtgctgggattacaggtgtgagccaccatgcccggccagatttttaaattcccatttctgttgtgtgttatgctggcaggcagggatggcaatttttaggccattaattcactttctgagtagcatgacagtttgatatgacaggcccctttcctggccaagggaacctcacattcaagcccatgataggaagtcctgtggccctgggaggagatctgaattccccctgcttctttctgaatcagagtcgaaacagaagtaggctgggcagtaatcctctccaagaataggggctcagacaccatggttcttctctcactaacttgagggttctctgcatctgccccaacagcgtcagggcaactgtcagcccaccaacgtttcagaatacaatgctgctgcactgatggagctccttcgggagaaagaggagaggattctggctctggaagctgatatgacaaagtgggagcagaaatatttggaggagaatgtgatgagacattttgctctggatgctgctgcaactgtggctgctcagaggtaagtaggtagctggtagggcatgagtgggaagaacagaaaggtcactgattcatagatttttccagtgttttattttctttaatattctgggtttcccccccaatttctgcctaagtgtgttttctttcatctgattatgcagggaatgaacggctgtagagacagagggtcagggatttgaacatcaaagttgttttataaacttcttagaatcatagttcagctttccccagaagccagaatgattgcagatgggatcagctgaaaatttgcacccctccttccccagagccacagattctttcagccacatatgcaggttgtttagccccaggaccggagtgaaagcccctccagagaaactaccactcagaaactaaatgtcactgaggagttgctgctgtcatttgatagctctggcttgtccaaggtatgtcaaaggctgtgctgaacttgaacccatccctgccctttgggaaggtcaatatttgaaggccacattctctatgtgcataacctcatcgtgcgtgagcggtcacatttcatctggtaagggagagaaagtggctggaggatttttactttttgctccttatttgttccccttttcaaattataaaagtcaattattggcctttggaggaaatagttgctcttacctcatgtgtcttaccttgctgctgctcaaaatcatcagttggggtaaaaagaaaggaagaaagagaaagagaaaaagaaacaacaacaaaaactgaattaaagtcaggtgatgacttgggttgtggcgataacagagccttggtctggaattgggtatgaaaggcaggctacagtatattgcacccagataggtctctacccagaaagttattaaaaaccacagtgttgtttttaacattctcctaaacgtggtaagccagcagagtctggaagtgcttgccagactttgggttgggatatgtatgtggagtgggcagtggatacatttatttttgagtccttccatgccaaatcagaggtggggaggttcagtgctaagagctgaaccggtgctttataagcccacttcggttctttaggaagacatgtctctctaatgtcatctgcttgtcttcattagatatcatctatgcctcaaatggatggaagctgcctgtggcttgattttgagcttaagctcatggacttaagcttcctggccttgtttcctaagcaaggcatactcaatacatgccagtgtggcaatagagtgcacagaagccccagctctgccagaagatggtctcgaaggttgtaggcaggttagaagcagaattaaatgtaattttacctgctagctcccaaggaaacacctgtgtccagcacttgttcagaggttatataagaaaccctgatgctgaaaaaacattgttattattgacaggtggaaagatacagggtaattttgtcacgtttaggcagaagcttagaaacatacaggtcacgagagtgtgcagtgtgagaaaatactagaaagctacggttcatggtgcctacttcagaatagactccaggtcaaaatgcaggagagcttcaggggttgtcacttgggggccttgtataaagaaactaccctccttccttcgtcctttgaaagctttgtgtattcggggaaacccctttcagatggattttcagaatctgttggctcccacaaggtagatttaatttaaattgaattcattttaatcatcacgtagaaacttttcatctaatcactgtttttggcaaaatgtgcatgcctatcatttaacaggctaaaacacagcctggttcccacctagaaagaacactttccaatagttccacaggtgaacattccagatcacgactgtgtgtctttctggcatgctactaatccaatccacaggagatgctgacagagagattgtattgaaatttctgtaaaatatgggaattggactaggtgattccttcagaccttcctatttctaggattatattacttttccagtgatagtgcctcttacgttctaccatggaggttggttttcttttcctctttcctttcaaatgagattctatatttgagaggtaacatttagaaaactttattttaaaacctgtgggctcttctgcctttctttccaacatttctttttattccttttgtctacttgttttcctcttctttctctcaatcttaaatgtagctattgaccaaggttctgctctttgcccctttccatggtaaaagttttatattttcttttctttcaaaataatttttttttttttttgagaaggagtctcgctctgttgcccaggctggagtgcagtggtgctatctcggctcactgcagcctccgcctcccgggttcatgccattctcctacttcagcctcccaagcagctgggactataggcgtgtgccaccacgcctggctaattttttgtatttttagtagagacagggtttcattgtgttagccaggatggtcttgatctcctgaccttgtgatccacctgtctcggcctcccaaaatgctgggattacaggtgtgagccaccacgcccgccctcaaaataattttcaagtgtctaggatattggctacaattggaaagtgctcaagtgtatttgaggaaggaaggaaagtagaaaagaaagaagaaaaatggaaggaaggagaaaggaagatgtgaaagcaagaaggaaacaatttctaaatgtataaattatatccctaaatctggtgccacatttcaatgatctgcttggtttctgtgtattctaccaggatctcaaacttaatatattccaaacctaatagctcatttggtaaatgacagatttcacaattaggatatcttgcttggatggtatcaatggtagttgggtaagacaatttttttcaattatgatattggttacatattaaaaaatcacctgttgtaagcgtacggtttgatgaatgttggtaattgtatacaatagtgtaaccaccaccacaattaacacagaggacctgttctaaagtgttcttgtgcccttgaatttgatcgcttcctcccatgcctgaccccaggcaatgactaatctgttattttgtcataaaattataattttcttttccagaatgtcatataaaaggaatcatattgcatttactcttcttgtttgacatattgcactcaacacaatgattttgaaacccattcaagttgatgctgagtagtgttccatggtgtggatgtatcacagtttatgtatgcatatttggatatatgcatattggggtcgtttccagtttttggccattgtgaataataaaatatagattataatataagaacaggcaagtgtcttttctcaggtgataagtcgtattaggtggtctatttataccccttccaacactttgatattatgatacacctcttgtcaaagggaaagctgttgatgttaacgatttcagacaagatcagagcgtgaaaacctaggtttttagccttaaagagtccaggaggaggcattttgatgcatatggaaagtgctggcattgccctttatcctgagatgcatcttaaacatcagatacagcaactctgtgagattggtcagctgtatgtttaggtgaattttccttgatgaaaggttaagagggccaagagataaagagaaagagagagaaaattgaagatattttggcatatctaaaatgagtatttgatacttaaaatatttgttttgttcaaagtgataacaggaaatttatttctttcattttatttagataatttgcccaagatcacacacagctactaaatggcagaagaactaggatttaaatctgtatttttgtctccttagctgctataattctgctgcttcttagaaatggtgtagctcaaagatggtaaaataggaattattagctgttcagtaagatactaattgaggctaattatttagttacctggaaatattataaataatcacaataatatggcctgaattaaggctccatattattttgtccctagggagtcctctctagatgcttaatatagatgaggggaaattactactgagtaggattccttgttcattcgcagaagaaccaatttggcaatgcagatttttagtttcagctcataaacaatgaatttatttctgaagagcagcaaaaggatgacaagataacccacccagtcaactatgtaatttttatcagcttgcatttactgaattaggttgctacctttctcagaatgtgtaatgtttcatgtttattttgagcaaaagtaaattctggaaaggaggaagtaaagaaaagggaagcagaaggtagaagctgttcacacacataatgcatgtctacctattccctctttgtaggcatttctcaatttccttcctctgctttcttctcatcctaccttctgtcttagttatattgttctctgctctagcttctcagtaataatagcaatgataataaccgtaatagtaactctgatatctctaaaattaaagttagaactttgaacaacttgttagatactggcatatggcaattcttaagtcactttcactccagtgtacctaaaatcaaaacccattgcagtgctttccaaaagagcctttcctcagtttccttttacagcaaacagtatttcatctttcctaggcatttgagttcgaaagaacaaagttgttattcattcttccatctccctaactcccacattgatattgtctccaaattctatcagttctacttcctatagcctatttccatttccgttgccacttcgctggtgcatagtttcatgatctgttgctgggattattacaatcaccttgctgactggtctgcctgattccagtgtttcacttctcttatctttctgtcacatttctacgagagataaggccgtcttcctaaggcatggcttagatcattttattcccttggaaagctctaataattttcagcgcctattggaataaagtccaaactcactgctgtactagttaattattgacttttttctcttcccttgtaagtttcctacagttaaggactagtcttatccatgcctttcccctctccagcctcccaggaacttcaaacacagtgctccacttacgtagagttcacatattaaataaacaaaacgatgatgctgataggaaaagataggcttgaagtttgaaaggccactaggtgttttaggagtttattggtgacatgctagaaagcagtttgagcaatgtgatgggataacttcgtcaaaaaaaagaaggagaaagaagatgacaaactgtttacttaagaatttgagatggaggttgtcaacatcaggaatatgcagtttggggtttgcaggttttattttcagatcgtagcccagcatctctctctcctgatgttcttaaagaacgtcttggagtattggaaggtagcaggtcaagttgctcgttcaaatactgtgcttgcttgcttttgcctaagccattggcctggtagccctagtcttctagaaggaagattgatgctgagggctgccctggcagccctgtcggaattcactaagtgccccacattttcaggctccattcctgaggagttaacagtgtccatatcaattagctggcagggctctgagtccccaaaatggtcttttatgcaatgaaagtggcagcaggccagcactagttcccccagtgacaaaccgtatgctcagttccccagtgtccgtagacaccatgcacttttcaacagtcctggctctaaggccccaaccttcacattggaattctgcagtacaggaattgcttccaggattttaccaagagctggaattctttcaagtcagaatctcttgtaatctctgtatgttagtctccttccatctttccacctatgtgattcattctctctcgctctcgctctcctccacctctctctttccctccttctctttttctttgagagacaggggtcttgctgtgtcacccaagatggaatgcagtgacacagtcgtaactgactgcagccttgaactcttggccttaagcaatccctttgcctcagcctcctgagttatgtggttctctcttaataatagctttgttgagtgttttgaccatgcctgacactgtttttacatgcataattttatcctctatgagatgaagttacaaatattgttcccacttggcatatgaagcggcatgcttagagcaggtaatttgactttcagaggtcataaagcttgttaggggcagagtgtacttggagaagctgggacctgctgagttgtctgtattcagagcctgtgctctcaagcactatgcaaatgctgcttcttcttgggtacccagtaggactacaagccagtgaattgcactagagaaagtatagaatgctgagatggtaaaatattttgagtttggcaaatgatgaaagccattgtattctttccccttcttgttctccaattatttcatcattccataaatggtttcaaccttgcatataaggtacacgtatattttggggaacagtaattttatagaggctcaccaaaatccccaatcttaatagcaactttctgcctctttttcttgccgcttcatccccatctgcactagacataatcttgaagctaagagaacatagttagctcccaacagaaaacatgcctggagttctcttgcagatccccattctcttaggaagtataatgaagcagtgccagttcattgttttctcggtctattgtctgatttccttgaagaccaatataattgcatcagtattctccctaatcctaataacctccctcacccgcccaccacacacacacacacacacacacacacacatgtttttccttattaattggtctttgagttaatggcctgagacactttcaaatggaacatgatggtcctttatgcagttagaactctggcaagagaacagtcactttgttggggtagacccattgatttggtgctagaatgtttcagatgtagattagataggaatcgagtgggactgactcaaaggcactatttattagctcacatgccctacctaatcttagctgatgtgtctgttgtttgcttctagtactcaggtgtatttaccaatgttcatctgtagccataagttacttagtataccctctgactttcttgaaagtctgacctttccccctctatgacttctaggagaataaaatggaaatatatacatattccttttttttttttttttgagacagagtctccctctgttgcctaggctggagtgtagtggctcgatctcacctcacaacaaccttcacctcccgggttcaagtgattctcctgcctcaacctcccagatagcggggattacaggcgtgcaccaccatgcctggctaatttttgtatttttagtagagacagggtttctccatgttggccaggctggtctcaaactcctgacctcagatgatccacctgcctcagccttccaaagcgttaggattacaggcatgagccaccatgcctggcccaatatatacatattcctgttgcttggccatgatctaaaaacttgaaggggctatctgccagaaggttttgggatgatatctgttcagttctgaaggcaagtctgtgcatatctcatccctcactgacttttgcagccacttctatactaataacgttgccttctaccctgaacgctgaactgtcctattttggaggctcttacgggttagttccccagaaaccatctgttccaaatgtgcttgatttcagcttaggactttccagaaaagccttccttgacttagaagaaagataacattcattgatcttgctatgctcccatctcatcacttccattttcctccccagggacacaacagtcatcagtcactctcctaacaccagctatgacacagctctagaagctcgcatccagaaagaggaggaagaaatcttgatggccaataagcgttgccttgacatggagggcaggtaaaatgttgttctggaccctgaggaatctgagacattgatatagagaccacataggatctttattcacagctaggaaatctgatcatgcagcctccccgctccaccatcacccctgccagcctgtcacttaaaggtgtgagatgcaatgacctttaccttgataatctccactaaacatggaattccaggtagggtttctgtccctttggccttcctaattgcttttcctcttccctctgcctgagctgaattgttggcatttgcactctggagtattctttctagcactgcaccacaaccctgtgatacagcagattgcttaataaaagagtaaaagaacatctgctcggccgggcacaatggctcacacctgtaatcccagcactttggaaggccaaggcgggcggatcacctgaggtcaggagttcaagaccagcctggccaatatggtgaaaccctgtctctactaaaaatacaaaaattagccaggtgtggtggcgggcacctgtagtcccagctactcaggaggccgaggcaggagaattgcttgagcttgggaggcagaggttgcaatgagtcaagatcatgccattgcactccagcctgagcgacagagctagagtccgtctcaacaacaacaacaaaaagaacatctactcaaagtggaggtaggatacctgattccttttataaacacatgatcatttacttactacctgcaggttgtcgctcattcatagatctcatcttctcactgagtaaattgtttccattgactgagattcttcactacagcacctagtacatcagttcattctctcatattcagccttttttttcactggtactttattgtgacttactaagatttaagcaacagctcctggatgctctgctgtatccatttgggtgtgcagaaaaaagaaaaaacatgttttaaaaactgtagcacaccatcccttgttttccaactcagaactaactagatcagcctttagtcgaaaagataatgggagctccacgtagtcatgtagtcaattagaccaaaatgtggaggtagcaagaaggtttttttttttttttttttttttttgagatggagtcagtcttgctctgtcacccaggctggagtgcagtggcactatcttggctcactgcaacctccgcctcccaagttaaagtgattctcctgcctcggcctcccgagtagctgggactataggcgcctgccaccacacccagctaatttttgtgtttttagtagagacagggtttcaccatgttggccaggctggtctcgaactcctgactttgcaatccgcccacctcggcctcccaaaatgctgggattacaggcgtaagccaccgcgcccagcccacaacaaggtctttatatgttctttgcctttggctcctaggattaagaccctccatgcccagattattgagaaggatgccatgatcaaagtactccagcagcgttcccggaaggagccgagcaagacagagcagctgtcgtgcatgcggccagcgaagtctctgatgtccatttccaatgctggatcaggcttgctctcccactcatccaccctgactggctcccccatcatggaagaaaagcgagacgacaagagctggaaggggagcctaggtaatgacagtaaataaggaagattatagtcacgtgttcaaagagagccctgagataagcacccatgcttaaggaaaagggatgatggtccaggttctagagaggaaggtgtaccagggttttggagtttttttttcctcctgagaccctagttccacattctggagctcctccacactttgaagtctcccggtgagaataccgattgaggccaaggcttagaggacaagaatcttgagtttcatttgggtgtcaaggaagataactctaatttcctctaaactattctcagatttggcctttgccatgtggcacctttatctttctccaaagcccatgtggcctttgtgtcgttccaaatgtcaaaattccggcatttctgtgttccttcctcctctataataggagaacccagagttttagttacactaaatcgtttgggtagcaggttttgttcccacagtgttgtgagatgagaacagaatgtactttttcattccgttcctgtccattccctcccctctaatcaaaaccccagacatattgtggataccacgaggcacatttttagagcccgaggaaggaagcttatatatatttttattttaaccctttttgttgctgttaattcctttcttggtcctctgatacttgtaatatcttttggttagaataagcattttggggactatggtcatggtgagaacctcagatcacacaattattaccacactcaatctgtgtcaacagacttcttccccagatcctttcttgctccctggtaacgtgtggtaatggtttataagtggagccgagtaggagcattctgacaacttggtggaacccaatcaccattggaaaaataaatcaaaacagatacccaggtcacttacaggcttaatatgttgtgccaggtgatggatgaggaccagaagggatcctcgaagtctgtaggaaacttttagccatggttggaggagcctcacacactgatttctgggttccctggaggcaaaaataaataacttagactattctaaattatttaatatttaaaaataataatattttaaatatttaaataatatttacttatttaaaaataaataaatttcttctgaaatttgaatgggagaacaggtaattagatgtctggatttgaatcacctattgttttctaacatctgttcctctttcatttgtaggcattctcctgggtggagactaccgtgctgaatatgtcccttccacaccctcgcctgtgccaccctcgactcccctgctctcggctcactccaagacaggcagccgagactgcagtacccaaactgaacgtgggacggaatcgaacaaaactgcagctgttgctcccatctctgttcctgctccagttgctgctgccgccactgctgccgccatcactgccactgctgccaccatcaccaccaccatggtagctgctgctccagttgctgttgctgctgctgctgctccagctgctgctgctgccccgtctccagccactgccgctgctactgctgctgctgtttctccagctgctgctggtcagattccagctgctgcctctgttgcctcagctgctgccgttgctccttctgctgctgctgctgctgctgttcaggttgctccagctgctccggctccagttccagctccggctctggttccggttccagctccagcagcggctcaggcttctgctcctgctcagactcaggcaccaacttcagctccggctgtggctccaactccagctccaactccaactccagctgtggctcaggctgaggttcctgcaagtccagctaccggtcctggaccacatcgtttgtctataccaagtttgacctgcaatccagacaaaacaggtaattattccctttagcaggtaggttttggtttagttctgctctcaaatacagatttatttcttgttgtctgatgtctgggcagagttatcatttggactgagtttttcacgttctaaaggagagagaagagagtctgtaaatgacttctcatccaccaagatgggaacaggcatgagtagaggccattatcttagcagaagtaaatgagggaggtggcaggcaagtctcactttgccattggcttcatgagggctctgatggtgtctggttctagaaatatgggttttttcttcatccctaagtgttttctaacccttatttccatttagatgggcctgtgttccactccaatactctggaaagaaaaactcccattcagatcctgggacaagagcctgatgcagagatggtggaatatctcatctaaacggccaaatcaagagctgcagattatcagcaaaaatgcttttaatcattttcccccttttattggttcttgttttgagggtgaggacaagggttgtggggaggggatgttttttaacaggactttttattggaacaatgtactacttgagtaataccatgtgaacaccagtctattttggtatgcttagggagtacctctaaagacagattaatcagaatgtgctctaaagcttattgtttgaatttatacgaatactgggactgttaacaggtggctatacatcgacgttttcaatgtgcttaaatttgtttaaattttccatattctagatcattttttattgaagagcacagtatgtgtggaagacagtgtataacacgtagtttggaagtgggaagctagagagaattgagtgtgtgctgttttgtatagttactatcctgtgcagcagctggagaaagcactcacctcaggcttacaaaagggaatagtttcaggagctatgtaagctggaaaaaaggtagggagttttggggtgcagaagggtactggagctaattttttcttccagtttcccagctaccctgccccagggaattgtgtttgtcttcatttcagtggtgctttggaaatggattcttttggttccctcctggaggttcatacattcatatatatgctctggagtaatttatgcatttggataattaatatattgctttcagatgctgggagagtacattaactgagtgatgcgcaacttcctctctcttagggaattagaccatcagaggccttgatggagagttgcatggggtgctatatgcagacttccatggtttgtgtgtagccatgaacacagcttgcttgcatttagtaagaccaatcagcttagtgtttatttcttctacagcacagattcactggctgggtctccagtctcaaattgccaatcatttgcaaagtgaggaaggatctttgttgacaggttgaatgctttgaatttctggtgactactttgaaataacttgttttgtttgtcaaattctaagcatatgtcttaaaaggcatttttgactatcacctccaagggaatagcttgagaaacccaaagtactatgctgcagtcgggggagaggtggattgcagcagtatcctcaactacctcttctcactgtcagtgacaccatcttggaatacctttgggaagcagcaggaaatgtgcatgtgggtagagatcaaaggaggcaatggctccaagccttgccatagggctgcctccaaggacacagaaggatgccagttgccacaggtccctgccctgtgtcacctgtctgcccttcattaaggtgagaaatctgcagatagcatcattaagatcagttttaaggggtatagggagggtgagggaagtggggggtgttaggtaagggttgggggtagaggttttgggatgtcttagttagaaaccagattaatagaagagtaggcctgatatattacatcatgagccatagtggtgggaaagaactttagcaatatagccctacctcctcattttagtgatgaggaatctgagaactggagaggttcagtgactttttgaaagtcatacaacacagctaaccattatgccaatcaccatgcttattttgggaaactctttatcttttttaaattccattttatgaaaaggcatcttcatggtccagggaatatgtatcttgtaaaatgtacctggttggagtagcttgtccagtcttgacaaactactgaatttctgtcttgcctctccttcagtgccttttaaaaggttttcccttttctgatctgcatttcaacatagagtcacataaatgtccccctgagaaaccaatcccacttctttctaggagattgggtatcttagataatcttttggggttcctctgtgagtataggaatggtatccttcctaattatcttccaaaggaattattttgtgtgtgtgcctgtgtgtgtgtagagacataaaggagggtgatgtgattttcagctagtcctttcacattttcaataatgaggtaatcatgttacatacacattagtcctcagttataaagtgaatctcagatagaaattaaaagtgcagttgtgttaagactctttcatactaccctttagtcataaggagaaaaaaacactcaaatagtagaagcagcaagtagcaaacttcaggagagctactttctatccaaataatttaaaaaacacttttcacctactcctttcatggttataacacattggcagactttttgctggctctgggagccatgattttaatcacattctgcaaggtgacaaatgtcatacattccacattgtgtggtagccatctctttagactcatgtgttttggggaaaggaagaagttcttggctgagtactattttgaactttccagaaccctctcacaccagagacagttcttctctgttcagtttccaatccccgataatttgctaaaataacattgtacatccaagagagggaagaagagtatgtcagtatattatgcagaagatagatacagccttttcagaagatctccactagtttttgttccaaaaattcaagtttatgggagaaatctcaattagccaccttttcacagttgtgtggatataacatttgggggatctttctggactcctacctatctgtgcattttaccggcacctcaggaaaggagggtgaccaggttgtcttagcttgtactgcttggtgatctctgaggaccttctaattcagttgtaccccagtgttccatgtatagaaaaacttcattagaacaaactttacttgatatgaaactcctattaacagtctttttttgaaataaaaagtagcttgagctttcttttaaaatcatgtatcttgattgttgatttaatgaaggatttccttttaatgctgcttttgagcttcaaggtaataggacagcaggaacctaaaatatctgccatcatctgccataggaaagatacccagagacccatcatgttctctttttgttgttacactgttgggtgggtataacaattggaaaatgaacaaactgattgattgtgcaaactactttttatgacaagcctaaaccctcataatgcggcagcttaaagtgtatacatatgcactaactttgatcaattatattctcatatctgttagctacacagtctcctattatctcaattgcttatgtgcatatggaatatgttacttaaaacgtgtgcattcttactgaaaatgttttcaaaggaaggtatcagctgtgggctaattgccaccaatttcagcctgccacgattcttggaaatatgtcttccaagtgccatccatcatcagtaggacaagtgtcgggagtttgtttatttttttccagtagcaacgatgggttacatggagccatgaaacctccttctggcctcccttgtgattaatggcatgtgtttgtaaaatggatagctggggttggcagatggctagagaagaatcgcctttggtttaaaatgtatgtggtcccctaatgattgtgaccccattctgtaatcaactgagctagttccaataaagttaagcaggtttaaatccactttgtgcctatcttttcactgacaataaagttagctattttaaaatgcagtaccgtgtggaaaatgctttggtgtttacccgacagaggctttatttgtgctgtatcagtgattactttcaattcagtatgcagtgaaattgcctttcaagggcagcgtgcagcagaatttgcatttgcttgaagtatggaatgtgattatagattataaagtattaagacaacaccacaggccgcatgctctaatcggtctctttatatactcaggcagcatatattaaaagctttgcatctttttatcttctggtttctagggataaaatgatggccacccaaagcagagaatttatcctttggttagcattttggaaggccccttgatattccttttgtacccttgttctgatgccaattcatcagttt

SEQ ID NO: 4934 - DNA, 324519 bp, human
cccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtggtaagttggagccccgggcggcattgctagccgagaccccaacgatttaggcgggggatggggtggggagcggggacaggtcccggatggctgcagcctgcaggaccgcactggccctagcggaggttggggggagggactctgaacgcgcaaatcgcgaggagactgagtctctggaagaagagaggagcttaggttccacggaaggagcatagaagtctctaaggggattgggagcgggggctcgagatgaagacgctgggcggaggcgggggtctagagaacctggcgcgggggaagccgagacagaaacggaaggcgggggtggggtctcaagaagtgaggagtgggaggagagaaaggagggaaactgaacgcaatgtcgctgagtagagggtcgggctgcggaagatgcaactgagttgcaggaccgactacaattttaagaaatccgacagcaggcaagtgggagggggcgcaaggtttgggacagtgtgtgcagagggggaaccaaggatcctttattatgttctcattgaaaagcgaccctaatttttctggcgggtctcagcgaacatccgtaactctggggagataacacactgcggatctgtgtttggtctaacagctgttagctgaatttgaacagcgctgctggtgatcacgtaagcttaagaggagaggataaaggcatccagtgaacctttttttaaataattaattagcttatctaagtcatttggttactgttctatattttgaaaaggattgcgaaaaagtctccagcgctgcctcttattcctgtactcagttttacctgacaagcagtctttacagcgttcctcggaattgctaaacatgagaacaggttgccgttcctgatgtcacataaagttcgtcattgcaaaacgtgtctgtgtgtctgtttcttttctgcgccatgccctttgccttttgcttcctgttgggtagtatgcgacttgaggtgacaaacacttgcattgtgtttgagaaccctgtattttaagcaacagagctccccaactcataattcagcgagtgacattcggcagttaaaagatttggtctggaatcactgccagtaccgcgcagcttcttcattaatattaccagtataagtcccatccaaggaagcctctgattgctgagccactaagtgcatatgccccttacctcataccttttaggcaggctaaccgagggacgttcatatatggttgagctaagatgatttggggggcggggggtgaggaaatgcggcgcactgagtaacctctgagctccccagtttgcagacaattgcgacctcacatacacggtaatgaaaaaagatatctgggctccagagtttaaatttttcatgaagaagtttacgtacatatcagccattctgacaatcaaaatatgagtgcaatagaaacaaggtgttactgtgtagttggctacatatgtgtagagacaatgacaaaggccaactgacatgccccacagaaaatgatatctaccgtgatcattgcatctcttttgcagtactgaaatcatactgaatattgtctgttctgaagagtataatctccttagcacctggctgtttgggaatcatctacaatgcccccccattccaccccacaggtggggggaaataaataattttgtccatattttggggaggtaggttatagaatatttaattatatttttcattccttaaataaattctcctgatcctcctggggagggaagaaaatatttgtttcatcaacatgatttctttcctaatagcgtctatcatctacagcaacaagcccaacgcaagtcctgaaattcggaagatggataaggcttgttgattgcaatgtcaaggtaggatttggggtgctttagcaaaaatgacggtgtttttctatctgcattatctagagagggttattaaccctttctatgctttcttgaggggtttatctccatctagaggtgtcatggatgacagtgatgactttttcagataatgtaacaggcttttgtgcagtatgaattcatcagaaaagaggtgagaactgatatttctgggaacctcctggatgccagacgtggatccaggactattacatatatatacataaaatatatattatttcatatagtcttcatagcaagtctatgaatgacggagatattattatcctccattttattggtgccattagatttttcccctcaatttttcaaggtattctcaaaagttaatttaaggcaagagaataagaaatatttatttgtgcttccaagtctacttgggaagagcaataaaagtaaaatctaaaaagcctaacattctaatagattcgtccaacattataattgagtcaagcctcaataattttactgttccatgtatttccttcaaggaaacgtcatccctctccagctaagggaaacacaaaaattaaaacaaaatttgggggagagattatagtaaccaacattaaatatcctcagctattcttattaaattgttcaaggcctgagattgaaggaggttgcagtttgctgagcctgctgaaagataaattaattcccaggttttaatggctcctgaagctccagactatttgtccagtattattaaggagcatcttaccacctcactttcatagcaatggaatacctcacaaaaggatgatgtacgtgtactgagattattttagtaaagcatctgatacagcttagtattgtctagtggaagaactgctaaattatgttcctctagctgcctggtagccatgagcaaactaggaaaacttcatcataaattgaagttaataatatattattgtgatattttatgtcagtatcatatataaccccacctgattgttgtgaaacagatgggtattaagcactttgaaaattttaaattattgcactaagcaacatttattatttatttgttagcattctaggctacctatgtcatttcatctacatattgtactgttgaacctcaaaaagaaatcatcaatctccagtctaatgtgtgctcaagttatggatctctccaacactgccattcttcaagacattttaagaaggctttttcatatactgagaacattgctgcaagacagtctagtcatctccattctagacaaacaacattgaaaacaaccaagtggttaagctgcatcatcatttggcaagtcattagcagatttaatactaatgctcacctgcaacaactctttgctaatcacttctgacattttaatgcacaaacgacatagtgaaatcaggatttcaaataagatatacacaagatggaattttaattctgtttttgtctcctacctggcatctctacttcaacctcgctattcattcctcttctcagctgtggctaagacagtgtcatctgcagtttcctaaaatagttgcgtattatagcattgtacatatagctggcatttgaaacagtcattcttcttaattatggttaaccttatgcatagatgaccacttacatggtctaatttgagaagcactcgaaaggccttctggtccctaaattagtagccttcatggttttccatataacttgaaattctacattcaggaatttccctctttcatcttagtcactgtctcctttaaatacaagtacacctttgggtaacatactgttattattacctattaagaactatgcataaatttattgaaagctattagaaagcctttagaactgcatcgtccagtgcaacagccaccatatatgggtatttaaattcagagttgaattagcgttaatggcaaggtgtggggttgagctcaatgtaaaaataaaaagtgaaaactgaacaccactgaaaccaaagataatgtcaactaatatctagacaaggatagcaatgaatgaattggctaggatttcctttactttttcataaaacatgatgtcttctttaatcagtaaacgcttacgaataaatgtcagtgttcaaatcttttgcaagtgtattttaaacttacgtatctcccattttatctcagtaatcaagactcactgaatactcttcaattatagcttcctgtaatcaaagtagtaagacttgcccaaattagcaagtaattattcttaagaggagaggtataaaagatggtaacagtggccactatttattgacatttaccatgcactacacagttctaagaggtttacaggtatataaccatacaagcctgatgactaccccatgagaaggtactactattatccagtttgcagttagggaaactgaggcatacaaagaggttaatctgttcaaactgaatgaacaaaaccaagcttgaaaccaggcagttttattccagaggccgtggtgttaaacaacaaactattgcctctgtttagaaattggctaatttttctttcatactgtaacaactagtcttttaacagaacaaatttgcatgtaaatgtgaggatattaatggacaatgtccattaatcctcgatatgctgcttggcaaggcaatgagacagacatgcaacatttcatctagagattcacctaccaataaagaagtagagcaaatgagaatgtactgttaatgctgagagactgagggacaagaagctgagtgaagctcaggggagttacagagataatacaaagacagaaatgaagtcagggaaataatgctattgtatgtagagatgactggacaggcagatgttactactgtgagttggacccacaggtttctactacatgtaacaccacaacaaaggccattcatatttgtcatttatataatattgcctacttgaaattcaagcagtaaaatagaagctctgaaggtctaagaccgactgacagaaggatcagtaaaaatcgtttatctctttccgtaccgatagtgctcccgaaaacatggtgaatgttcctaaaactcacaagacttaaagaagtgtggctagcaccaaccccacaaaacgacacagtacaagaagggcaaagattctctgtatgcccagggaaagcagcattatgacaggcagcgcagtgaatatggtgggcagactaagccaatttttcggaaaaaagctaaaactacaaagaatattgtgctaaggcttgagtgcactgatcccaactgcaaatctaagagaatgctgccattaaaagatgcaagcattttgaactgggaagagataagaagagaaaggtccaagtgatccatttctaagtgtcatcttttgttttattatgaagacaataaaatcttgagtttgtgttaaaaattatttatcatatatcaggaaggtttcaagtcttgtctgatcccatttgccatgtatttccttttcatactagagtcaggaaaagtaatttgatagctatgacttggaaaataggtgctataaaaagtaactgccagttttttagtttactgatctgagcccaggtagaaaaaccatatctgagtacaatacttagactaaagttatttcagggtagaaagaccatacttgaaaaaattctaaatatgattaaagtctttttaaaagtaggtttttaaaaattcaaaaaccaaaccaattacttccatttcttacttccattttaaattgacaaaaaacctgatccgtgattaaaaaagaatttattgctagaaagattggagaagtccagtactgtggtatgtagctttctctcccaaatgtatctatattctgtctgatcttcaaggtccgtttcaagccccacctcttgcaggaagcttttgttgactagcccacatatatgataagtgccttgcccatagtaggtaatcagttaacatatcttgattgattgtattgtattccaatggttaaagtaaaggtgaaagaagatgaaggaagagctaaaatagaatttttagcacatctgcacaataatattcaagaattcaaggcatctaacagaataacagtttcccctgaaatgatttcaggtaatttctctgaacatattttagggcaataaaaatattataaatcttcttaaattagtttagctaaagcttagccctaccacactgttttattttccatttcacagtgaaatacaccattatatatacatatatgagagagagaccatttcattgaccacatgcatggctatagaattctctttttattagcaaactgagttctgcacccattttgcggtatgggttgatggctcagaaagaagcgcaagttttctttttaaaatagcaattcctaaatgcctttgcagcaaataaacttgtaaataagagctttatttccttcctttttatactgttaaaggaaatcagacattagtattaatgaattgctctgagtgatcacgtcatgaatctattagttttttttatcttaattaaacagttaatttaatgctttgtggcttgtgggtagattgttctagcatttttggttggtcaatgactcccagaggtctaataggcctgtatcttttagttttaaatgtaatgttagtctaaaatagattcagaaagaagttgattacttcattcttgaaggaagtaaaacaaggaagatctggtgtctctccaacaaatattttttgaaacttcattttgaaaaagcagaaatgagctggtttctcaatagatttatttatttagtcatttcatcatacctctatatctatttttaaaatcactatgtaaatggaaaagaacttgtatggtagaattatgcgcccaaatgactattcattgatacaatgacttgctctccaaagtattatttaagttagcaagggcagattctttagtttggaggattattacccacctctcactgggtaactgtctgtgtcaaattttcctgcttctactaccaaacctcagccaatttcctaaatttcacgtaagtaaatctataaaattcactgtccatatttatctgccaaattagtgaactgtaagatgaagatgaataaagaaaagcctgtaagaattatggaatttcagcaatggcttagttgaaattcagcaagagaatttcagttgagggcttaatgtacatttaacactttgttggatgctaatgaggtgaaaaacatattctacaatacttccctaaggaaacaaataagtactgttagacagtaaaggcaattcaatgtaataatgtagttttgcaatttatggtataggcaacattgatttctctctttcctactctctcactcaggatgaatgaagaaaaaaatggtccagtcatttgcttaactcaggcctcagtttccacaactccaaaatgagagccttatactaggtaatctttctgtaaggatccttcaaactaacctctttgttataaacagatacagaatacagaaaccactgaggttatatgactgacttccctaaggttacaaatatagagtcacaaattgtataatatataaaatggggaagagaacatggagaaaactcccacaaattttattaggttggttcaaaagtaattgtagttttcaccattgtggttttcaccgcaattacttttgcaccaacctaattcagaatttaaaagtgaaaaacatttgaatgctgagaagataatacattgttataaagtaatttgaatttttaccatagatttatactttactttgggtaagtgccattttcagaaaggcagccaaatttgtacaaacatagtggatattctgagtctcttgattgagaatgaagcaacaagatcaaataaaagttcatttgtttctctagtataatacagaatacatttatcacaacacttatagagtgagaaattattaaaaaaacactctatcccttctcccagatttctttaatttcttatgataattgaaataatgcttgtccttcctaccttggattcattcgtggataacttttcttaattattccccatttcagtccattaatacagcttcagaattatttctgaaaaatgttgttcaaatgtgccaccttttaaattccattgtgattatagactcttagggttagtaattgaaagctcatttcagacaactccctatctcatgtttgaactctgcacatctcccactctctttacaatggcaccaaataatgctacccaattcctgggcagagcatagataaggctaaaagttgtcagctaccaaagtagctgctgaatatcagaatgaaacccagggactctaaagtgggttatgaagtgatgagcttcagctaacagggaacattaggaaatgactgcagacaaatcctcatgcttaattcagagaaagatgtacggtttgattggagggggtgaggaagaaggatatcatacagactataaagccaagaagcaatgcttagaatgcaaatgtgttataattttgtgtgtgcagtgtaaaaagactactggccatattttaaaaagtcatctaggttacactcacatacttaagaacaccagaatttccattttaaattttaagaaaatagacataattgtttgcacctcttacatggcacttagcacattgtattacattgttttttccttagatatggagtcttgctatgttgccaaagctgaccttgaactcctgggctcaagcgaacctactgcctcagcctcctgattagctgggaccacaggtgcatgccactgcacctggcttctatcgcattttatttttattacttggtttttaacttatactttagaggcaggcctggtgttaaaggttttacatgcatcacgtcacttttaaatttgagtcttatctttcctactggattataaattcacatggaacaaagattataatttattcatgtttatactccccagctaccgtttgcatatatcattacatattgtggcttctctcaacatatatttgctgaataattaatatacaaaaagacacaagcactgtgggaaaggtatttatagtgcaaatttggagttaaatgacctaagttctagtctgttataagcctctatgtcctcctccgccaaaagagaaaatcagactggatggttactgagataatttcaaatgctacaactttaagaaaatatcaacagtttctaattctgaaaatccacttcaaataataatactcaggtagttgattttatgccccagaagattaatggttatgactcttcagctacttaagtaattcttataaaatctcaagtcaatattcacttcaggtctctaacttgtcattttccattcactccagtgccctacatttgaaatgattcatgtcttaaagatttctgagtgattgaagacatgtcttctttttgtcttttgttatttaaagtaaatttaagatatctttggctattaataataagtaacattcattttaggtgatttataataaattaaactgtgcagctacaaactctacacaaaagaagttacttaactatttgataggacagataacactctcctgcattttcagaaacgattaagccatatcttatagttaatctaatatataaaaaaatgaacttccttaggatttagaaatgttactaaaaataattagcattgtttttttctcaatagggtttctagaagatttctagacatcttgaacggtgaatcataccataatagatattttacttttggggagaagagagatgggtgtaaaacagttttcaatattaaaatgtttaatacatatatagaaattaaaaaggaagtaaaggttaaatggatcaaaatgctttggcaaaaggcattttgacatgtaagcaattcacaaatgtaaacaattccagttattcatattgtcaacctttgaacatagataattcttttacccatagtaaagaacattggagatacttatactttctagttcaaaagttttcattattttaattcctatagctctaaaggcttcagaaagagagattacaaataacatgtagacaactccaaatttcttgatcttactacagattcgctaatgcagatatgtttttttgagattcatcccaatatctactttccattctctcttaactctttttatattttctatcaagtatttttaaaattttcttcatttcctattgtaaattttttcagcctaagagcaattcttatattctgtttcctgttttctcctccctaattttttatcttattttctaacgaaggcaacatatagctgaaagggtttaataatacagtcacagaatatccttattattaatatatctactttttacaccataatacaaattttctttgtagatattttagagattgtatatatttttctcatatatcccttcatttgattttcaacataacttcgacttagttagggccagtattactacattgattacacaaatgagaaaacgaagggtaagaaaggttaaattacttatgtaaagtcacacaattaattctacagccagattcaaacaaacccatgagttcttattcagaattccattctttttatttttttgagacagggtctcactctgtcactcaggctggagtgcagtcatgcgatcatagctcactgcaaccccgaactcctgggctcaagcgattctctcacctcagcctctcgagtagctggaactgtaggtgtgtgtcaccgtgcccaggttgttgttgttgttgttgttttgtagaaatgagggtcttgttatgttgcccaggctggtctcgcactcctggtctcaatcatcccgcctctgcctcccaaagtgctgggattgcaagcacgaaacaccatgctcggccctaaaatttcattctatttccagtactttcccctctcttcgtgtcatggatatttagttccagagaacttcagatgcttagaaataaatgatacaattaggaagttatagatatagatatgtgtatgtatatttgtatatatatagagagagagtcatgttactcccagatgtttaaaaagcatgataaatacttggttttctacaaagaatcagacattcatttgcatgtggtcaagatttaaataacaatagactgactaatgagcaatatgacagattaaaacacaaaaaaaaatcccaaatcattttctgcagaatatattggaagtctagctatctggttgcactttagccaaacaaagtttccttaaaataaatcaagccttgattgagttctgcttcaaatttttcaaaagagtgcttcaacttattatgacttctctcttactttcatgactattagccctatccctttcacatttcctgtaatagccagaacccagataacagagggtaccttctgcatttaaaaataatcattttccaatacttgtatttaaagaaaacatttctaccttacccacacacatggcatatttttaaaatacagaagcactgataaacaatttaacattgcataccctggatttaaacatttaaaatatactgtgcatgtggataaggtagcaatgtttgctttaaatacaagtattagaaaaacaatttttaagagaaaattttaattagtataaaaattgatgaaataattgaataatattatcccaaagttagctttcagtggagaattttaaatgggagttcattaatatcttgctgaatatcaataacgtaaatgctgagtttatggtttagcttcatgattagaaattgtcttattcctttattatatttttagattgaattggatataggctattaccttataaagggttacaaaagaaaacaaattctggacaaacattcatctagatgcctttaattatatttcatatgatcattttgcccctgtactagaacatttattttttgaggagtattcagtttcctctatttgtattcagaactcctttgagtctttggggggtgatcccaaatggcaggaagaagaaaaagaaaagttatttatagcttgttcatgacttttatcagtgttccattttgatttccaattactttcccctggaaaatatatctagataccttatcactatctttaatgaatctaaagctgtacaatttgtgttgctataaaataatttcaaaagaattattcaaacttttgtcctcagtcagatcttaacttgtggtactccagcctgctcttgatctgtctgagtaatcgtgtagatttctatcacatcatcatcatcatttaagaaatattttttgtgtcggccatggtggctcactcctgtaattccagcactttgggaggccaaggtgggcagatcacatgaggccaggagttcgagaccagcctggcctacatggcgaaaccccatctttactaaaaatacaaaaattatcccggcgtggttgtgtgtgcctgtaatcccagctatttgggaggctgaggcaggagaatcacttgaacccagaaggcagaggttgcagtgagccgagatcgtgccattgcactccagcctgggtgacagagcaagatttcatctccaaaaaaaaaaaaaaaaaaaaagcaaagcaatattttttgaagctaaattatacccgacattgtaaaaaacacatgttagagaatataacacttgttcttagagtcacaaaactgtcaagggaggatttagcaaacattttacggttcctaccattgagaaatttatcttctatttgggaagataaactgtattggcatgcaacaaaaatgaagacattatgtagtgaaggactaaattgtgtaccacataaaaatgaaggaaaagaaacaactaaaggaattttattggcatagagaggaaatgaattggagcttgaggacaagtagggtttgaattgacacagaaggacaatattccaaagggccataggatattcatgtttcacggtatgagaagaggtaaattaggaactagttagtgggggtgagagtcacctctaatctgaatatgtttaaaacagtggtgagacatgcaccatcagatgttctctggagaaatgaaaatgtgatactggatctctggagatagaatttcgaacaatccatgctacactagtttagctaaatttcaaaattgtacaaaaaagagaaggttgtagagagaaaagaaaagaatggaagtccaaaaataaagcatttattatttaaagttttgggtaatatttaagattgatatttacctgggaatattaatgatgaaaattttctcaggttttccccaactttagacattgttacattcaataattgttaagattctgctctgggcaagacatttgactgagtacttcagggcttcccagaagaggaaacaatacttaattctgatctttagtagtttgaagtctagtcagtagctggagatcaaatatatgagctctacacaaaggatttggcagcaaaggttactgttaaattcagagaagattgtaagagcacagtagatagaaaagagattgcatgggatgaaaatattgatacaaaaacctctttaccccaaagcccagagaggaagtgtaaatttggatcaacccttttgggtgccattttcactatcacctaaacatagagtggccaaacctctttttgactgactcacagagattttcggatggataagacttttgtttaacaacagaaaaagcctccatgagtctggagtcattcatattcagtcctgttgcttttattcccttaacttaataaaaataagtaaatcagcaaacaggagttgagtgccttttgtgtgtttagcaatgtattagattatttgaatgatgccaatagaaatatgtaaggtcccttatatagttaggagtcatatgaattacttgctatcagcaagcccttagaaacctgaattataccttggtttaagttacaagtaagtaatgagctgtagatagactttcagttaaaattaatagtccaaataccatatgactgttagttctcaatgccaaaaagtcatccattttatgagattatttttaggaataccagcaaagtactttataattcctaaatgcatggataacgttatgaaaataataacacattaaatactgagcactctaataaagcaagtagaactaaagcatactgatcacatttgtaagtgactcaatattgcctgttattattaaatgattatatattattaaagatgaacaaattaagacttagagagggttcttgatttgcttcaggtcatacagctaattattggcaaaactgcagagaacttaaatttcctaactctgaaatcaggttcttttccaccatggttcactgcctcttgaagcctatgtagcatattaaatgaaagcctttaaaaatttgactacatcatactgtccttgagaatcatgtcatgcttaataaattcaaaatgaacaggaagtacatttgcatttttggcttcaaaaattagaaagttaatacaagtatgtgaatactttcaaaattatgacttttgttcttactaacatataggtagaagatgtatatgtgtgtgtgttatataatatccgtatgtttcacaatgagagagaaacatgtaaagacaaataagagtattttttgaagtttaaattagatgactgaccagttaacaggccatgtgctcttatttatgatagcctttatttcttaatttatttgagcaatcgaagtctgaaagagctcaagactggatgcttcctttctataaattacatctcttaaaatgtacaaatgcaagcatgagtcactagctacagaattccagctttaatacattatgtcatttttataaggaaaccagtgaccttcatgtggtttttaaggacaatgtctctgtgaactacagactatgtgaaagatgaaatcataacatgaacaatcaaacaagctcaatggcatgatctaaaagataaaaataacatgcatttcatagattgaaatctgcttacctctgtgattatttttccatgattcatttgcatgtgtgccttgcatatattgtattgatttgaaattaaattgaaacattcacatatgttacaatcacattttaaatagttaactttcactgaggtgtgcacaaaggaatggtgatgagaaggaaagtacatagcccacagcaatcctgaatgtatattttgataggtagtttgaattttctatttactcaaacttatgtcagtaatgtttaaactatagtattactgaagttgttatttatatataccattccatctagtaaatatagagcagaatctcggagataggaggaagtccaagaaagaaatcacggacacttctaatgaaaaggaaagagaaagggaaaggaatcaacaaatattgagccctaaccatatcctactcagtgcgtgttgcaaagtacatatattatctcatgtcattctcacaacaactgtaagaaaaaggaaatggaaacagagacaggttaagtcatgtgcccaaacacacagctaataaggcgttgagccaagattcaaacccatatctgtctaattacaaaggttgtgtgctctttttccatagtaccttgattaacagccttaaggtttaaaaatatgccaaatactcatgcacaacaacatgctctcagtataacatttacttaatcatttttcatttacaatgttttcaaggaactaaatggaagacaagtcaggagacatcaatcatatatcgccttctacaaatcaggaatgtgtgtattttcaaatatctcagtttgtttttagaggtgaaggatagctatttactaatagtaataaagatggaaaaagtatgcaaaatgctatctaataataataattggtaatgaaataggaaaataaaaggtgaatcacaatatttaaaaaatattaaaaatattttaaaatatcaccttaagaatcacatttactgggaaataaaaggcagttataataacacaggaaacattttgactgcatattccatgaaattactactgtctttatacttttgtagcataataagtgattctattttaatctaatttcatatataatagtaatatattttcataatttaacgagttcaaatctaaacatggcacttgcattttaaatgcaaagtatatgtaagatccaattttaaagatccattttatgtattctttaaaatgttttcttccatcatacaacttcagatcgacaatatattttgtattgaattgttttctttaatttttacagtgaaacttgtcatttcaagtttagtaaatattatgacttgattttcaaataaaaataaagcataccaaacacatctacctgctatctaagagtattttaagaatcagtttccaaatactattcagagcaaaacctatagaatatccagaaactgtcactagttttttactcatttctgaattcattagcttttaaactctttctttttttttaggaaaatcaccagtggtctatatgctggtacaatttaagcaagaagacagttgagaggaagagataggcttgcaaatcaaggtacagaattgccccagataacttttttcatgtgcgtccctgtgaagagaccaccaaacaggctttgtgtgagcaacatggctgtttatatcacctgggtgcaggtgggctgagtccaaaaagagagtcagtgaagggagatgagggtggggctgttttataggatttgggtaggtaaaggaaaattacagtcaaagggggtttgttctctggcgggcaggagtgggggttgcaaggtgctcagtgggggtgctttttgagccaggatgagccaggaaaaggactttcacaaggtaatgtcatcacttaaggcaaggaccggccgtttacacttcttttgtggtggaatgtcatcagttaaggtggggtagggcattttcacttcttttgtgattcttcagttacttcaggccatctggatgtatacatgcaagtcacaggggatgcgatggcttggcttgggctcagaggcctgacattcctgccttcttatattaataagaaaaataaaacaaaatagtgttgaagtgttggggcggcgaaaattttgggggggtggtatggagagagagaatgggcgatgtttctcagggctgcttcaagcgggattaggggcggtgtgggaacctagagtgggagagattaagctgaagggaggtcttgtggtaaggggtgatattgtggggatgttagaagaaacatttgtcgtatagaatgattggtgatggcctggatatggttttggatgaattgaaaaactaaatggaataacagaaggagaaaaacaggtataaaaggtctaagaattgggacaactcaggatatctgattagagagtgcttaaggagattcagcatagtcctgccagcaaagattatttatttacttcaagagttaagagtggcagtttggggatagcaccaggagatatcagctgtgatggcttggaaaaacagtgtaaactggcagtgtaaacaagagcagggcatgtatgagtagttgagaacggtgaataggagtatgactagacagaagatagtagggatgacaagttttttgggggcacagtctaagttggtctggtgtctggaatgagactggggcctaataaaaaggagcgtctatacaggagcttaaatgggctgtaccctgtagcattccgaggacaggcctgaattctgagaagggaaagtggtaaaagtattgtccagtcctttttaagttggtggctgagcttggtgaggtgtgtttttaaaagacctttagtcaattctacttttcttgaagacggaggaccataagggatataaaggtttcactgaatactaagagcctgaaaaactgcttggctgatttgactaataaaggctcatctgttatcagactgtattgaggtgggaaagctaaactgaggaattatgtctgacagaagggaaaaaatgactgtggtggccttcccagaccctgtaggaaaggcctctacctatccagtgaaagtatctacctagactaagaggtattttagttatctgactcagggcttgttgagtaaagctaatttgccagtcctgggtggggcaaatcctcgagcttgatgtgtagggaaggcagggggcctgaataatccctgaggagtagtagaatagcagatggaacactgagaagttatttccttgaggatagatttcctcgatggaaaggaaatgagaggttctaagaggcgggctagtggcttgtactatagcataacctgcctttgctggtgtgtggcgattaggcctggtggaaccgccatcaataaatcaagcatgatcagggtgaggaacaggaaagaaggaaatttggggaaatggggtgaatgtcaggtggatcagagagatacagtcatgggggtcaggtgtggtatcaggaataatgtgggaggccggattgaagtctgggccaggaacaatggtaattgtgggagactcaacaaagagtgagtatagctgaaggagccgggaagcagaaagtatatgcgtcaggtatgaggaagaaaatagattttggaagttatgagaactgtagagagagatttgacatagtttgtgattttgagggcctctaaaagtattaaagcagcagcagcagccgctgcatgcagacatgagggctaggctaaaacagtaaggtcaagttgtttggacagaaaggctacagggtgtggtcctggctcttgtgtaagaattctgaccactcgaaccatgcctaggaaggaaaggagttgttgttttgtagaaggtgctggggtttgagagatcattcggacacgattggcagggggagcacgtgtgtttttatgagaattatgccgagataggtaacagatgaggaagaaatttgggcttgattgaagtaatggggctgtctgtgaagctttgcagcagtacagcctaggtaatttgctgagcttgatgggtgtcagggtcagtccaagtgaaagcgaagagaggctgggattaggggtgcaaaggaatagtaaagaaagcacgtttgagatctagaacagaataatgggttgtagaggcaggtattgaagataggagagtatatgggtttggcaccaaggggtggataggcaaaacaatttggttgataaggcgcagatcctgaactaacttgtaaggcttgtctggttttaggacaggtaaaatgggggaattgtaaggagagtttataggctttaaaaggccatgctgtagcaggcgagtgataacaggctttaatctttttaaggagtgctgcgggatgggatattggcgttgagtggggtaagagtgattaggttttaatgagatggtaaggggtgcatgatcggtcgccaaggagggagtagaggtatcttatacttgtgggttaaggtggggggatacaagaggaggacgcaaaggaggctttggattgggaagaagggcggcaatgagatttagctgtagtccaggaatagtcagggaagcaggtaatttagttaaagtgtctcagcctaataagggaactgggcaggtggggataactaaaaaggagtgtttaaaagggtattgtctaagttggcaccagagttggggagttttaagaggtttagaagcctggccgtcaatacccacaacagttatggaggcaagggaaacaggcccttgaaaagaaggtaatgtggagtgggtagcctccgtattgattaagaaggtaatcacttaccttccactgtgagagttacccgaagctcggcatctgtgatggtctagggggcttccgaggcgatcgggcagcgtcagtcttcagccgctaatccgagaagatctgggaaggagtcagtcagagagccttgggccagagttccaggggctctgggaatggctgccaggtgagttaaacagtccgattttcagtggggtcccacacagatgggacacggcttaggaggaatcctgggctgcaggcattccttggcctggtggtcagatttctggcacgtgtagcaagctcctgtgggaggaggttctggaggaatgcctggccgctgcggttcaggcgtttggaagttcttgtgtgctggagatgtggctggggtttgtctcagagtggaggcaaggaattgcaacttttttctattattgtacaccttgaaggcgaggttaattaaatcctgttgtggggtttgagggccggaatttaatttttggagttttatttaatgtcaggagcagattgggtaataaaatgtactttgagaataagatggccttttgaccttttagggtctagggctgtaaagcatctcagggttgctgccaaacaagtcatgaactgggctggatttttatatttgatgaaaaagagcctaaacgctatctgatttgggataaagaaaaaggagcattaaccttgactatgcctttagctccagccacctttttaagagtaaattgctgggcaggagtgggagggctagtcatggaacgaaactgtaagccggaccaggtgtgaggaggggaggtgataaaaagattatagggtggaggagcagaggctgaggaagaattgggacctagctcggcctggcgaggagcagcctggggaggaagggagaggtcagatgggtctgtagaaaaggaagattagacagactcagcaatgcttggggttggtactgaggggacaggcgggagggaaagaaggaagatttgggacgagttgcactgggcacagagactaggaagggactgacgtgtaaaagaatgcctggacgtcaggcacctcagaccatttgcctattttatgacaagaattatttagattttgcaggatggaaaaattcaaagtgccattttctggctatttggaactactgtcgagttggtattggggtgaagcggcattgcagaagaaaataaggcatttaggttttaggtcaggtgtgagttgaagaggttttaagtttttgagaacacaggccaagggagtagaaggaggaatggagggtggaaggttgcccatagtgaaggaagcaagcctagagaaaagagagtagagaaatggaggaaaggggttcaggggttcttaccttccagaaaagtgggaaaaggggttggggcacagagataagaggttggggggcagaaataagggattggggcgcagagatataagaggttggggcacggaaataagggactggggcacagagatacgaggttggggtgcagaaataagggattggggcacagtgataagaggtcagggtgcagaaataagggattggggcacagagataagaggttggggcacagaaataagggattggggtgcagagataagaggttggggcatggaagtaagggattgggggttcttgccccatagaaaagcgggacttgccactaagggtgaaggagaaggggttggggtacttaaccctctcccagaaaagcgggacttgccgctaagggtgaaggagaagggcttgaggggtacttgcccctctcccagaaaagcagagaaggggtagagacaaggagagaaggggttgagctacttgccccttccccagaaaagcgggacttgccgcttaaggtgaaggatcaaggcaggcgtccctgcgtggtctgacacccttgaaacgtgggtgtataatcagagaggcgtccctgcaacgattaaacaccaagggaaggctgccttcccagtccgtgaccggcgccggagttttgggtccacggataaaacatgtctcctttgtctctcccagaaaatgaaaggaattgaaattaagagaagggagagattgaagagtggaaaggagaaagtggttgatggacagtgagagaggttggagaagagagtaagaagaggccgtttacctgatttaaaattggtgagatgttccttgggctggtcggtctgaggacatgaggtcataggtggatctttctcacggagcaaagagcaggaggacaggggattgatctcccaagggaggtaccccgatccaagtcacagcaccaaatttcatgtgtgtccgtgtgaagagaccactaaacaggcttcgtgtgagcaacatggctgttatttcacctgggtgcaagtgggctgagtccgaaaagagagtcagggaagggagataagggtggggccgttttataggatttgggtaggtaaaggaaaattacagtcaaagggggtttgttctctggcgggcaggagtgggggtcgcaaggtgctcagtgggggtgcttttgagccaggatgatccaggaaaaggactttcacaaggtaatgttatcacttaaggcaaggaccggccatttacacttcttttgtggtggaatgtcatcagttaaggtggggcagggcatattcacttcttttgtgattcttcagttacttcaggccatctgggcatatacgtgcaagtcacaggggatgcaatggcttggcttgggctcagaggcctgacaacttttaattaatatcaactgtgagtagagaagttaaaatgaaatatcaaacacaatgtttgaccatgataaagaaggtgtggagtttcttcttcttggccatttattggatacttaaagacttgacattttcctcaccaaagaagtcactaggacctatggtacaacgttaagatcaatgatgaaaaagagtcatcctcaatggaagagtatgcatcattctgattatacacaagcattgattatttgctgatgtgagaaagggtcaagataaaaattgatctttgaatgtatcttattcaattttttaatatttcatagtgcttcagttgtttggcacatttgtcatatctttaattttttttgatgtcctgctccacccttccatatcactataaaatgttaatacatttttcatacacatgcagaacatcaggttttaggattatttttaaattaaaatctgaggccaggtgcagtggctcacatctataatcccagccctttgggaggccaaggtgggtggatcacctgagatcaggagttcaagaccagcctggccaacttggtgaaaccccatttctactaaaaataaattagctgggcatggtggtgcgtgcctgtaatcccagctactcaggaggctgaggcaggagaattgctggaaccgggaggtggaggctgcaatgagccaagatgataccactgcactccaacctgggcaacagaaagaaactccacctcaaaaaaaacaaaatctagcctttcatgaatcttacatgtataaaatgtttacacttttattatgtaaaagtaatgtattcccccaatggattttataacaatacagtcagtccctcttgcaaaggggactttttcataactcccctactgtttcattaaaattgaggtttaatttgattctgtgttctcacatttaaaaatctatatttttaagatctgctttttccttcgaagtaatggctttaactccgaatcacttttaacagttttattgacctgtaattcacatactatccaatttgcctattttaatgtgtagaattcagtggtttttaatatactcagagttgtataatcatcatcacaatttagaatatttccatcaccccccaaagtaatcctatacccatttacaatcactccacatacttcttcaacccccagcactaggcaaccagtaatcctctttttatctctgtagatttgcttattctgagaacctgcaaacttttaacggatgtacttgctgggaatgtcagagaagttgtttgagattaagaagggttggcaaacaaaataaaatttgttgttagatttaggcaatagggtcttgatttatttggctaagttcttaattttttcacacttctgaaatgaaagtaataaaattttgtctctgagcttctgtcatccttacttttgctattcaattttattttagtatggcaaaataaataaaaaggaagtcatcctccaagtactcctcttaacaataaattgattcagaaaaaccaagtttcaaactcaggaaggttaaatttctagtccatttctttcattttttttccattctgtccaatcaagatttgtcaaacaaaactatcctttccagagaagaggcatttacctcaaaaaaacttttgtgtacgtggtatttgcagttgaatgtcataagaagcaattgattgaagtgtgccatctgtttcttttctaaatctctaatatgcaagacacgtctttaaaattacacttattcagaggatttttatgaaataaaattgcctgtcattctaattagctctgaatacttctcttgcaacagtggtgtggcataacacattagtaggaactttggttggtatgtattttggccactaacatcactaataaaaaaacagtaaataaaatcggaatatagaaactggggctttctacataaaatctgatttttttattagtatttattatgcttcccattaaaacaataaatctgatatgtattatttaatatacttcccattaaacaatacatttcataatacctaataaaataagaaaatagatcctattaattacatcctcaaatacatattttaatatttttctgaaatatatatgctctttacacactagaatataatcgttttcgttatctgcattgtgctaaatgtgaagtgatgggcgatgcaccattttgtatttaaaagatttctcctatggtttttttctgttgtaattactcttttggttgaccacgttcggttggacttctgaccattgttccaagcatccactccattactctatttgacatgacacagtgagtttaaaggacagtatcgtgttagacaaagattgaagttttaaataatacatgataacttgaagggaaagttaagaaaatttaaataaataaagaggatgaggcaaggggatatgtatgtatgctttaaatagtctataaataagactcagtgaaagatgaaaatatcgttttgaacaaagaaagggtggaagatatagaaaacgagcagagcatactgtatggttccatttacataaacttccagaactggcaaaaataatctacagtgatagaagtcaaaaagtagttgcctggagcttggaaggtggtgactacaaagaagcaggaggatggaattgttttatgttttcatcacagtggcaattacacgggtgtaaacattcatcaaaagtggtcaaactctacatttaaaatatgcacatattagtatatgtaaattacactcattaaggtggattccttaaaaagtcaaagtaggcagtaaagggtaccattcagtccctctgtggtcctgctttaatactgaatggaagacaacctccttctttttaaatgagcatgaatatccatgaatatcgaaaagagagcattaagctctttgtaatgactgcatttcctcatcctgctcaggattgactactggcattttaatgcacggtaatgtgggcatttctttgatagacattccactttaaatgcctactttttccatattatttcaactgaaggagaaataaggcagcaaccttatctattaaatcttcacagggttcttatgacttttaaagcatcattttgaattgaagctactattttatattatcttttctcagggtgggctgaaaacaaaatagcaataatttttgtaggaaaagtaggttaaagtctgtcttgaataatcacaaaatcacacttaatgtcacctcataaatcagttataaatagtgtcagaggtaatagaattgcacatgcgaaatttaaaaatattctgtgcacaatttttgtagaatggaatggcatggtgtttggattaatatgtacggcaaggttatggtcaggcacatctatgttttctatctagagtcactcgcctacaaagggaaaaaaatcagtcactgtggaaatttaaaaaataatactttggtaggatggagagaaacttgaaatgacagagcgttaatcataaaatgtatctcaaatttatgtataattagctgagaggaaaaaaattggaaaggagagtgtatgatagatgcaaaatgttaatataaagaatgtcgtgatcaggaggaagggaagaagcaagtgagcctcaagagaaaaaaatttgacttcactcaaagtacttcatatttttgcaaaattaattaaaattttagaaatcgacactaaaacgttagagacctcagaaaacactctcagttgataggtcttggagaaatttttttaaagaatatctgattggataatttttaatgacggagcagtaatgttttagtgttaaatatctcaatcttcccctaagggggaaaaaaaacgcaaaaataaattcttcgtgaataaatggcataattacaatcatagcacacattgttctgactgcaatagtcacaattcgccactagggggctgtaattctgttcttagcagttcttggtccacaacattttcattccctcccagggtacttgaacagttaggtgaagttaagtgggagcttcgacgggcataacaggtcattaatgtgtattgagatgatctcatgcgtttctgcgatgcgatgtataattcttgttgtatagaataataacttggccaccagcttcttcaccaagcatggagtctcatcattgctccaagattgctattaattttgtacgtattacgtagaatcattttatcttcctttttcccaggaaattatttttatttactataagtctcctactttttcatgaaaattgaaggttaatgtgatcatgtgttcttgcatagtcatttcaataaatctgtgctgtaaaagagacaaaaaatgttggttcaaatttataaatactaaatgtattttctgaagtgtagattaaaacagcaaagttgtgggtttttttattttttttctttttttgagacggagtctcgctctgtcgcccaggctggagtgcagtggcgcgatctcggctcactgcaaactccgcctcccgggttcacgtcattctcctgcctcagcctcccgagtagctgagactataggcgcccgccaccacgcccggctatttttttgtatttttagtagagactgggttttaccgtgttagccaggatggtctcgatctcctgacctcgtgatcctcccgccttggcctcccaaagtgctgggattacaggtgtgagccaccgtgcctggcccaaagttttaatccaagttatttttcactcatttgaagttagaactattttttactttcataaggaatgaaaaatataatttgttggtgtagtacattgtatcttgcatgatgtaaggggtagtcacattaaattatttaaatgcggctataacatttattgaatattttatattatacttcaaatatgttaatttatgttgataaatttatgagctaacaaaagatcttgtcctcaatataataattaacatttcctatgtatttctcataactttgatgatctttacatcactcaattttacttactaggctgagtgcaagagttagctttatatttttaaaaataatccctgcatttaaaactttttttgatcatgctttatgtgtttggggaaatttttgatgtttaaaacatgtcaaatattaacgtccttgcaccaaatttatttgtcctactgcaaaaatatagctggctaatatttatttcagtcttgtttttgcattccagaataaatattggcaactgatgctcttacaataattgatacagaaatggtgattttcaaatgttgtttcctcttccagcgtctaatattgttttagtatctgtggatgaaatactatttactcttgctctgtaattgttctatgtgaaatgtttcaacttgacatttgacttagaattttgctgattcatttagaattcttaactaatatttaatttcctctttagcagaaggacgaacactgacttacctgctataggaatggggtccggatccagaccccaagagagggttcttggatcttgcacaagaaataattcagggcaagtctgtaaagtgaaagcaaggttatcaggaaagtaaaggaataaaagaatggctacttcatagagcagccctgagggctgctgattgttttttattttattttattttattttattttttttttgagacagagtcttgctctgtcacccaggctggagtgcagcggccgatctcggctcactgcaacttccgcctcccgggttcaagcaattctccctgcctcagcctcctgagcagctggaattacaggtgcccaccatcatgccaggctaatttttgtattttttagtagagacggggtttgatcatgttggccaggctcgtcttgaacccctgacctcaagtgatccgcccacctcggcctcccaaagtgctgggattacaggcatgagccactgcgccctgccctggttgcccatttttatggttatttactgatgatatgtaaaacaaggggtggattattcatgcttcccctttttagaccatgtaaggttacttcctgatgttgccatggcatttgtaaactgtcatggcgctggtgagagtgtagcagtgaggacgaccagaggtcactctcatggccatcttggttttggtgggttttagctgggttctgtactgcaacctgttttattaacaaggtcttcatgatctgtatcttgtgctgacctcctatctcatcctgtgacttagaatgcctcaactgtctgggaatgcagcccaataggtctcagcctcattttacccagcctctattcacgatggagttgctctggttcaaacgcctcttacatacctgctgtactaatattttgctgttttaaattcattttatataaatgagacttctttcttctgaagcttataggtatcagccttactacttttcagccattcattatatgtgaatggtatacctactctgtgtggcaccttacttatggagttcttactgcatttttctcaatgtttgcttttagggttatcagctaacacccgcgagcatctataacataggccaactgacgccatccttcaaaaacaactgtaagtatacacataagcgtgcctcaagactcttattttgaaataatattcaactattatatcaaggtgattcctattattttgctagtgtagacctacccctgaactagtaaaacatatgccattaagggcctaacatgtttgaaaaagaatattatgtaattggtaaacagcattttaatgcaacctgaaaaaaaaaaactcggcttattttattactaagtaatgtgtgatgcagaccccttaccgaactgttaaccaccaccgcagatttatagtaaataagtataaagtatgatagtataaattgggacaattaggttagcgaagttcaattttcttcttcaatgacaaactcttgttttttttttgtttttttgttttgttttgttttcttgagatggagtctcattctgttgcccaggctggagtgcagtggtgcaatcttggctcactgcaacctccgcctcctggggtcaagtgattctcctgcctcagcctctgggtagctaggattacaggtgcatgccaccacaccaggctaatttttgtatttttagtagagacagggtttcaccatgttggccaagctggtctcgaactcctgacctcaggtgatccgcccacctcgacctcccaaagtgctgggattacaggcgtgaaccacctagcccagcctgctttcagtaacaaactcttatatccatgattggggtgtaggaaatctagctgttgttttctatgataaattttagaaaacatagctagctcttcaaaatactctcaatggatgcacttaaaaatctcagcaggagaggcagggagaggagaattttgtttctcaaaagggagtatcatttataaatgctgaaaaacgcagatccagataatggaacactctacattctatagatgtctagagcatgattatttgattgggtaaatatattacaagttaaacaaggtgaatttaaattggattccttattttcgactccagactgcatggggaattctcaattaaatttctgattgttctcataatcatacaaatatttaataccacaaaatgtttttagaatgatagttttggaggaagaactgatacgatggtatagactaaatcatttttgacagtaaaattttaacagaaatttttagtataacattaatatatacgcattagattaaagaagtgaaaagtcgaagtctatcaaaattcgaaagaggatagggatggaataaggttgggaatgtctgctgcacatgttaataatgatcaaaaataaaagaaataagaaaacagtgatttgacatcaagacagttgcatcaaaatggctgcattaaaatgtaccctttttcagaatagccaattgttctgttttattcaactactcaccatttaagatgatggcaaaggtaactttctttaatacatattgaaaagagttcttgatgctatcaacagctttccagaggggaaaaaataaaaaaaaatttcataagggacgttcaaaaagtataaaatgtaaaattttgaagaacccccacagcagtcctgaaagcacacaggaaatcactcattctgtttgtgaagattcaagtttgcttgcagatgttttcaatgcgttggtgaaataggttaacctggacatgcaggtaagtttctactctcaggcttcaaacaatgttcacacaagactatctcacatatatcattggcatggtaagcctcgcctggtagtaaagaccaaggtcagccttactagaatgtgaagttcgccaatttcatctttactgtcttcctttcaatgctattctgtccttaccatgttgtttttcgacctctatgtgccaaatattcacaactccatagtgagtactccttgcttctctcccaggcctgtgcacccctctttgtacacacacctgttgacactttgctcttatctaggtattaattagagaagatttgatatacaaattcatcataatgtggcaatatcttacaagtcctaccccatctagagggaggcatggtttaacatgtggttcctataactgaatcccttgatgagctgaaggggaaaatatgcctcaaatctcatcatgtaggtatgtaaggcctttgcctacttcacttctctgtaaggctgcctttgtcagggtatatcagtgacatgaaaaagatatgtacaatatatttattatagaaggttggagcttgattatttatggtaaataatgttggtgttgttaaatatattaattcttactgtaaatagaagagtaccaagagttttattgtaatgtgtatacatctacagcctgatattctttgggttgttttttttttaatctctgggtccttggtgatttctatggctattttatttttatttttatttatttattcatttttgagatgaagtctcgctctgttgcccaggctggagtgcagtggcatgatcttgactcactgcaacctctgcctgccgggttcaagcaattctcctgcctcagcctcttgggtagctgggattacaggtgcccaccaccacacccacctaatttttgtatttttagtagagacagggtttcaccatgttggtcaggctggtcttgatctcctgacctcaagtgatccaacagcctcggcctcccaaattgttggaattacaggcataagccaccgcgcccagcattttaagctatataattcaataaatcttaaaaagaaatttgtctccactatcatttgaacttagtaataccttccgtaaagccttacttatgctacctattctactgtgctatagatgtatgtatatatttatatcacagtcaaagtaacaatttaggtaatgtattcaatgtctcctgtgaaaataatcagttggacaactgtgctcctcctgagttgtataaggtttgtgatatcagtaagtatcaaaggtaaacattatttttttctgtaaaaccgcatcaacatttcaagttattcacagaaaaggttaatgtaatgaggaaatagtatgcatacattggttctacattgtcaaaacatgatttataatcgtcactctcttgacacttatattaacaatttaggaatttttatctttcaattatgtggtcttgtgttactataaataaatgcaagttcaattaacagaatctgttttcaatatgagttctctgatacagaactgagttatctattgcaaagttctttactctaggttaccaaattacttcaagaaaaacataaataggctgggcatggtggctcatgcctgtaatcccagcagtttgaaaagtcaaggtgagaggatcacttgagcccaggagttcatgaccagtctgggcaatatagtgagactcccatctctacaaaaaatttaaaaattagccaggcatgatggtgcaaacctgtagttctagctattcaggaggctgaagtgggagaattgcttgagcccaggaagtcaaggctgcagtgagctgtgatcacaccactacattccaccttgggtgacaaagcaagatcctgtctcaaaaagaaaaaaaagaaagaaaaacagaaatacagaaatagaccataacaaatagcaaatgttgcttacattgatagacaattccatcatttcactttgcagtttgttgtagttatctgttttattcacaaatattttaatttcacatctttgatttaaaaatgaaatatattttactactcactagctcttcatttgattgatgtaaataatatataatcaaatgcctgtatcaacaagtcaaacatattctgtaaatatatacacctgctatgtacccacaaaaactaaaaattaaaaaataatttatgaaaggagcagagaattgagtgtgttaagtaacaataatttgttctatatatagcacatgtattttatatcacttacaggaactaacatgaagtcttgcacataatatacattcaataatatattcaataattagtttaataataactatcaatattatgacaaaataacagcatttctagaagagaggtactcaatcaggaatgcattttagtaaatgaacatacacatttaaagcacaggaaaacctgaactttataagatatttccacattctgtgcagtttttgcttttgttaatcaaaaatttaaatgatcctttataattatcagttgaagtcaaaacacatggaattaactaagtacttaaagaactgattatcgtaattaataatctaacttagccaactgataactgttaaaactatctgccacacatatttttcactcaatagtctgtgccaaaattcaacaagactaacaacatagtttagcatgcatcctttctaagatactgcaacttttgtgaaataagtgaaagttacctcgttttggaaaggaaagtagccaaatggttatcaaggtggtttcaaagttacatgttcatccatattagataataacagtaaaataattttatatgtatgttttctggttttcaacatatgtctttcaaaaatcggattgactttttaaattatacattttcaaaacattaatatcttcttaaatataaaatataggtataacttaagtaactgtaccaagtaaattaatacatgtcttataagaggatattatgcttaaagagtttatgacacaagaatattgatttttatttcgctatttgaaaatgtgtattagtcttagcctttagtacatatgactctaaacgtaacatagctctttcaaataaaatacagacattttaattgtgtggaagcttttatatgctgtgtgaagtgactatttgcatattacatcatgtttcaattgcattttgcttttatttaaaaatgattttttcctccagcaaattaaacatatggcccagacaagtagtacattgtgcacataaaatttctaacaattcctttcagagattgccactgtgtagatctaagtacagttgtccacttagttctctcataacaagcctttagagatgctaataaactaatactaaagtaataatgaagatactattaaaatatgaaaaccaaatcatatatgtgtggtatatccattagatgtatacataaattaatctctatatatttatttttgcttccataaagtattctcagtgacttcctagggttttaattgtgtaagaaaatactctcaatgtgttgcaagtttcttagcatcacggggaattgcactgttattcagataactggattaacaagaaactgcgtcatccttgaatggcttactctcccttatcccccgtaatgaatttattactaactccagtcaactccagtcggttttaattcctaaatatcttcactccatttctacaaacatcataccagtttggatttccatcatctctttagtactagaataaccttctaactagttctcccaattacgcatttgcactcccaaatccgttctcccaattcttattgctcctaggaaaataccaaaatctttatcatggtttataaaagacaacctgatctggttcctcttcagcatcatatattccctcacccccctcatgaatagttgggccccactgatctactttcagttccttgagcacatgctctctctgatcacagggccttgccagaaattgtgccttctgttgtgaatactaccttgcattccccatctctcctaatacttacatcaccagtacaccatttaactcctatataagccatcaaaacacgagcttaaaggcatttttttttctgggatcagggaagacttcctgcccaccataccccctaacacaaggtgagaattctgttatataccctaatagataacatcatgtaccttcatcatagcaattattacagttgataattatacatttgtttttgtgattccttgaggattcctgtctcctccactagatgttaattaactccatgagatcaggaacagtatttgctttcgctcaatattgtattcttagcatctaacacactgctaaggatataccaatgatttaataaatatttgttgactggataactgaataaacaaataggtattatttatgaaaaagtcatttatataatttttggtgatggttggtctgtgactgttcgattgcagaggatatttttctaccttcccccaagtggcagctgtaaatattgcagcctggtgaaaaatgagaagtctcagtaactaagacctcaacaaagggttgtatatgtgagctgtcaactcataactgacagcagtaaaagtactgctatgattttaaatgtaatgttatctatacaagcaggtgaaacttatatatgcctaacaccatatttgcattattgaacagtccagcaaaaattttgaataagtttcacttgccctgtttcatgcagcacgaggttcacattcacattttaagatagcagataatcaaatcatatcactgctatgctttattaaataagcaaactcaaatgtatgtcaaatgagttatagcataatttataaagttttaagattattgccaatacggcttacatttcacactatatatttatgcatacatgtaatacagtatgaatatattgcctgaatatatgactatatggaatatatatattgaatatatatgaagataattgaaatatggtgttactaaatgaataccttgctaagtgatataatgcttagttcatatactttcctggctaagctttcttatttctgctgtaatattacattatactttatatgtattacacggaattgcactcggctattttgcaatgacccaaatttgcattaaattccatatatctaccataattcatacattttattatcctggtcatgtttcctgtttttcatctgctaaaagattgatgattttaagacagcatgatgagtgctagactagtgcagtcagtctggggaggaatctgagttctgcattttttttttctttttttggcagaggagtcttgctctgtagcccaggttggagtgcagtggcacgatcttggcctcactgcaaactctgtctcccgggttcaggtgattctcctgcctcaacctcccatgtagctgggactacaggcgtgcgccaccatgcctggctaatttttgtatttttagtagagacgaggtttcaccatgttggcaaggatggtctcaaactccggacctcaagtgttccacctgtctcagccttccaaagtgttggaattacaggcatgagctatggcacccggcctgagagtctgcatttctaaccagctcccagatttccatggactacacttggagtcacaaggtaatgaatcaggggatgagaaacttttgaaaagagctagatgataaatattttggatatgggaaccatgtaggctctgttgcaactactcagctctgccattgtagcttgaagtcagccacagacaacatatgaatgagtgagtggggctgggttccaatgaaattttatgaacactgaaatttgaatttcctacaattttcccatatcatgacatattatttatctttttgtattttttcaatcgtataaaaacaaatacatcattcttagcttgtaggccatacaaaaacagtctgttgttgccaaccaccctgctatggtataagatgccgatcgataactgttgtagaggctggaggggaggtagagtgtgacaggataggctttgtagaaaggattacagttgagctaggacttgaagaaggaaggcttttcctggacagacaagtaggagaaagtgaaagacaaagatgtaagccagcaacagcattagtatgttctctgaactgaaagcaatggattgtggcctgagaagaacaagcccgtctaggttgagaaggctcaatgaaaggggggtcccttaaatgcatgtctaaatagttttaaaccttaatgagtagtgatgtcaggtgagcatccagaatgagcagtgggggatgctattaagttctacatcttagaacttcaagtcaagagagaactggactactgggagggagaaagtatagaaatgactgaggaaaccaggaaaaactgcacttgaaaggccaaggctctttgaaagtgactacaaaatgttctcaaatgaaagctttgtggatgctttatacaaatgatcagggcttgcaaatttattgatgaaatgggaaatatgtatcacatagccggacagagcaagcctgtcaagccatttttccattgctacagagcacacagcagattaaaaagggaagctaagaactgaggattgaagatttgaaaaatggtctccccagatgcctcagtgtctgactgactttgctgataagctacagagtaggaatacacgctgaggggtaaaatgagcatatgggttttataaaagatgtttctattagttctctggaggtggcagtgaagtgagataatgaaatactacaaaaaaaaaccagagctggaaattatgaaaaatgggatatcaagtagaaaattaacaaaatccagtgcttttggaaactctcttctcccaattatttttctatttcccatctcgttctcacccatttccccacaggatgctgtccagttgttttggaggtatgtttcattggaatagtggagttaagatttgctgagtaactactctacaaaaagcatgactaataaaaaatctcatcatccaataaatgctgaattttactaccatttaacagatgaggaaagagaggcttggaagcctactttatttatccagatctcctccaaaataggcaatacatctgccagtagatgtggcttacctataacccctggtaaaaagtgggaagcagagcaaagggagaatttccgcttttccacaataagggaatgctagttaatcttccatcttccagacgtacaggaaagatttgtctttggctttgttcaaatcagaaacaattacctacaagttttggtcacagcattttaggtaatttttaaatactggctaaccatgagaggaaaggcagtaaggttttattaatagaagttagaaagggtagcaaatatagacatagtaaacttaatagggtttaaaaaaaaattcaaaggacctgtgatcaggtttcccaccaaacaagagagatattaaatatggttataaactatcatgtattgagcatctgctccatgccaggcactattggacagtgtacaaactatgtcctttaattttcacaacattccaatgactggttattattacctatatttaacatatgaggcctaggggcttaagcgagttatccacagtcccctgagtcctataggtttctattgtgtcaatctggtaatattaagtacctaacacataccagatgttaaacaaatgttaactattgttttcttgctagtattgtcattattataactgacgtttacttaactcctccaagccttacttaccttaaccataacatgaaagtcaacacaaaataagtttgccagaatgattaaatgaaacagcccacttaaagtttctggcatacagaagccacttagtcaatgttaaaaccgtataaattttctcttgaaggatgttttttatttttagatgaggctatataagacagtgtatattgatgctttcagctatttagtggcatgcccctggataatgaacttgatgtttatcttcagaaaacaatgtttgactagaaaatgacttttttcaagtgcctgtgatcaggaggttaagagagtttatggctgaaatattcagcatacacatcaaagtttcttagttttttctatttcatatgctatttccttttcctctcttcctataatttgtctccctaagaacttaaatagatattttatactgtttgtgtatttagcaaaatagtattatttataatgcaattgaaatagtctaaaccattggtgtcttagtctacaagttgtctctttttttggtggtggttttttttttttttttttttgagacagagtcttgctctgttgcccaggctggagtacagtggcatgatctcaggtcactgcaacctctgcctcccaggttcaagcgattctcgtgcctcagcctcctgagtagctgggatgacaagcatgcaccaccacacctggctaagttttttgtattttcagtagagacagggtaggctggtcttgaactcctggactcatgtgatccgcccgcctcagcctcccaaagtgctaggattatgggcgtgacctaccccacccagccccaaaagttgtcttttaatagttgaagcaatgtttactggtagagcataagcgctcaataaatgtgttaaataaatatcagatgaaagagtaaatgaacaactctttccattattacttattatttttatatctttagatttccacaaagaatgcttccctaaaattggatatgtacttatctctgcaaattcattttgacaaaacacatcatattctcctagatataaaagcacaaatgaattaatctttattacactttacaagttaaaattatatttgaaattgattttgctacttgatgtgctaacatttaaatgcagctcagcttccttatattgtttccttcataatgcttctcttcatttaaaattcattttgatgatttctggcactccttgtgcctttaaagcataagataaaatttcagtttacaacctgatctttatgttattgactaacagcaacctctgattccaaaaggaaaaaaaaatgaccaagcatctctagcatgttaagaaagaactcctgatagtttagagtcttctccaaatttgtcaaataaaggcacagctagaatgtatattattaaaaagagtaattctttgggaaaatgtttatttgagagcttataattgaaaagctagctcggggaaagaaagccctgatgtcaaattaggggaaaaaaaatgaagaaagggcaagattagcatgcattgtaatggagggtgctaaataaggctctataaaacagtgcatattgataatttcagctatttagtggcatgcccctggatatttaaaaagatatttggatatagtttacataaaacctccaaatttcaatagttggtgccaccttcaccataataaatgagttcctgctctgttaatttccatgacagctggttgttcaaaagagcctgtcacctccctccccgcaccttctcttttgcacaaaccagctccccttagtattctgccatgattggaagcaccctgaggccctcaccagaagcagatgctggcactatgcttcttgtacagcctgggcttttctaaaatattctctacttatagtttgggtgtttgaccctccaaatctcatgttgaaatttaatccccaatgttgagaatggggcctaatgggaggagttgggtcatgaggtaaaatccctcatgaatggcttggtgctgtcttcatggtaatgagtgagctcttgctctgttagacaccatgagagctggttattaaaaagatcctggcatctttctccctctctcttttgcttcctctctcaccatgtgatctttgcacatgccagctccccttcaccttccaccatgagtggaagcagcccgaggccttcaccagatacagatgctggcaccatgcttcttatacagcctgcagaactgtaagccaaatgaacccctttttaaaataaatcacccagcctcagatattcctttataacaacacaaatggattaagacagaaagtgagaagtggcttttgagctcaacattgaagacagaatagaatttagaatttgaagggggaaagagaaagagtatctcaaagtgtgtgttggagtaggggagtttcatgaaaagcttggaaaccaatgagtgttgaatgaggcagggctgatggtctgtggccttactgggttgtactcagtaataggagatcagctggaataggtaagtgacagcaacttccagcagctctaccttcattaaatgttatgatatcatgaaccagagaacataaagttctaagtttattttgggggaatgttatgtaaatccaagatcattatttttgattcttcatattaataggcattaagtgtgcattagaaccaaaaatggataaccaaggatatggtaagaggcagatgccgatttggtggttttgatatttacggtagctcttctaaagagaaactcctgttaagtgcttagacatatgggactggccagcctaggcaacatgtcaaaaccccatctctgcaaaaaaaaaaaataataataaaaaattagccaggcatggtggcacatgtctgtagtcccagctactcaggtggctgaggtgggaggattgcttgagcccaggaggttgaggctgcagtgggttgtgattgggccactgtactctagcctgggcaacagaaggagaccctgtcacaaaaaaaaaaaaaagaaaaagaaaaagaaagaaatatggaactggaactctcatctttgtctcatagttttgatgctttgtgctaattattatacctgtaacaaacatcccttgccaccaggtggctacagagttatgccatgttttcaagagcttaagactccaatgtagtgaaagcttttccaactcacaactttaaaaactgataatctatttaatgttctatctactatctagacaaccttttaggaaaagttgacttgagttcatcccttctcaatattcataggtttagagaattgatttatattcctaaagggggcactaaagcaaatgaaatagaaggaattcatatgatttgttttcagtttctagtgaattctgtcatttaaaaataatttttattcgtgttccataattcactgattgagattccttatggcagagttatagctgtgagaagagatgttcactgaattagagcaagagaaggatagcaagcctctataaagccttaagtggaaggtcagaggcaatttgaatagtagtagttggcagaatacagattcagtgtctctgacttcattaaacgttatgatatcatggcctacagaacataacgttctaaatttattttttgggaaaattatataaatccaagatttttttttgactcttcatattaataggtaatgcattaagtgggcattagaaccaaaaaagatgtaagctagtttttaaaaggcaaaacacttcaattaacatatcaaaatactcttgtcacaaggaaagaatgttgttcattgccctaaattattcataagttttcacataatttgctgtaaaccatagactgatagaagagtccagaactagtagttgatgttgatacaatgaatttcatctttttccccttcttctacttgtgcctatgagggttataataaagaatgagtggactaaggtatctggaaaatatattcttaaatattagattaattaactaaggtaatgatggagaactattatgtgatcagcactatgccaggaattactggggttgcagaaaagtattggccaagatatctgaccttcacttaaaatcttattggtgcgataagattaattaacataaaataaagaaaaagaacagtgtgctctaagcaataaggtttatacatgtacaaagaggtgaggaattaatgaagcctgcatttcagcagaagatccttaaggaagtgctcttatcaactgggatgaattgtataatcattttctgtcattatctctttcatatcattgcacagtctcctttttatgccccatgcaggcccttgcacatggtaggtgctccataaatatttgctgctggatcaaataattttttcacaaggatatagtaaaagcaagcaaaagagagacattttgtttttctgttgaatagttatcttgagaaaaaaatctgcattgaccatgatagagtaccttatcattagatcataggatcagaaagtaaagcttataaatctgctttctaaagagtgcagtgcccagtagctcatcctcacaggcttgaagaatgaagaccaaaactggaatgcctagtggatcctgaaaacaattttagttcactagtctgaatcaattagacatgacctataatatcaagattgcatgtagctagtagttaacttttcagcagaaatgtttctctaatgcttggtatatgtaaaatttgatggaaatatttaagtaatgtgaatttgctctcttttttaaaagcagtatttaaatagtatctattttatgcctaacaaaggcaggagtcttttatcttgatatctgtatctatctatctatcttttaattgagatggagtctcactctgtcgcccaggctggagtgcagtggcacgatcttggctcactgcaacttctgccgcccgggttcaagtgattcttgtgcctcaggctcccgagtagctgggactacaggcgtgcaccaccatgccaggctaatttttttttttttttttttttttttttgcatttttggtagagacagggtttcgccatgttggccaggctggtcttgaactcctgacctcaggtgatctgcccacctcagcctcccaaagtgctgggattacaggcgtgagccaccgcgcctggccaatatccttatattaaggaactcttatttgtttagaaatgctcctcttaaatttcagtcctccaaataaacaaacacattgaccagtatttgttgcaactagtagttggcaagtacgtaattttattggaacatggttaggcataattagaacagtagcacatcaccaaaggtagtgatagaataacagccaccaataaaataaaaactttggcggaatttctgtaggtgaattatctgtactacaaagatgcattttgacgtgtatgcacactgagagcaatataagaatttaggattaaggctgttgatatcatacttacatataaaacaattattttgggtactacaactgcttttcaaaactgtcaaataatgaacatgtatttttcggaatgatgaattagatggaaccacaccttcataagtgaatggcccaatgtaaactattaaaacccacaattaataaacaactagtcacatgttatttttccatctttttatatttatatctgtgaaatgatctgtgcatttaagagagtatctatactctggttacccaacagtttagaaacgggtctccattggaaaaacagaaacgggttaatttgtatctttcccttcaatttgctattattctagaattttaggggagaaaatatgcccatttatgagtcacagaaaagcctgtgccctttaatatctggagtacactttcttccccgactcctaaagtgggtaatgcttacttttaaattgttttcctcctcttcattttttaaaagccgttagccaagaagggactaggatatcacttgtagttctcattttgctgagaagtttctggtatttgattccattctacttcaaatgtctgagaaaagttccaaacctcaactttgtacatgaaacttccccatacagggaggacaggcaagaaagtaatgggacattttatacctattgtaagaaccaagcatttgtgggaacgtgaaccaactggatctcttacacattgctagcagaaatataaatttgtaaaattacttggaaaaagttggcattatctcttaaaatcgaacattcacaatctgtatatgatgttttgttttaatttttaattaattaattatatctatagagccatatgtggagacatgacaatggtgattcatacaccaagggttataattaatccagttctgtgcactagaggccagattattcctagaattcaaggatggctgagcacctaagcagcatcatttggtaaggcagcataccaggctaggacaaaagtcaagggggtatagagaaaggcacttgttttggtgggaacactattaattagagtagtgcttggttcataaaattttatctatgaatatttgctgacttaatgaagcaaacaatgaagaaaaaggtaacgattatttgccaatggctgcttgaggtggcagattttcagcgataaccaagagaaaaaaaaaagaggtacatcaaatggatagttttctgttttgtacatttgagagaatgtgagttccttccagaggcacaggaaagatgtatcattgtccttcaaacaattcaaggatagtgatctacaaatttgttgtcaggaaatattaggcaatttaaaatagtcattcaacatatatgccaacataaaatagttggatctaaagcaacttttcttttgtaaggggaaattataagaagaatagaaaattgtagaattattaactaaaaaaaattccaacatttttttaccagatcccgcacaaatggtaatttgaaaaaataaaaaagagagttggtattggtgagtggggagatttttagttatgacaatagctattaattattaaatgtttaacaactaatgtcaggtagtggactagactctttgcaagttatttcttccaattctcacagcagtcaatgaagtagttattactgattccatttaatatatatgaaaacagaggctacaagaacttgagtgagtttaccaaagtcccacagctagtcagtgacagtgctgggattctgagcccagatctgcctgattctaaactcacattttcttcactggaagttgacctacgtttgcagtcaccatgttgagtgaatgaagcaatgggttctgagatgtttctggtcacctacccactccctcctttaagcttgttcttctatacagagcatggggccccaaccccagctctgctgtctacagcactgccaagtgacccattgggctccatcttgaccaactgggcatcaagcggtgcaaaagcaaatccctctcaaagctgggagagtcacaccgtgggctactcctgcatgcagctgggtacatatctcctgggtcctatgacctgcctaaaaaaagtgagagagtggagagacagatccaggcagctcagtaactgctattactagaaaagcgtgactatgtctggccgggcgcggtggctcactcctgtaatcccagcactttgggaggccgaggcaggcagatcacaaggtcaagagatcaaggccatgctggccaacgtggcgaaacccgtctctactaaaaatacaaaaaaaatcagctgggcatggtggcgcacacatgtagtcccagctactcgggaggctgaggccagagaatcccttgaacctgggaggtggaggttgcagtgagccgagatcgcgccactgctccagcctggtgacagagcgagactccgtctcaaagaaaaaaaaaaaaaaagtgactatgtccgtaccaggttaatagaagatactcagtaaatattatcctcgctattacattatcataatcattactagctgtgaagcttttagcaatttacattaacccctcttagactcagtgtcctagtccataaaataaggttgacactactggaatgatctacgattgtcatggtgattacatgacaagataaatccatttaaatttctgggcaatttgctcattaagtgttagtaagacagagagataagtggttttctccttttgatgtgatgaaaatgagattataattatcttatagatgatggcacccatgtatttgccccacatttctactagcttcctgacaagctaggcttccccagcctcttcattctctgtatataaacagtcagcttagacctagtgctgatagaattccctttccagttctttcttataagttagaactacattcaaggctcattcctggccccctttttttccatcatgacaccttcaaatactcaagtccccactaatctctctctctctaccacataatttgacgatgatcaatttttcatttattctgttcattcaccttgttagcttattaactaattggtaaaccctttgaaaggtctatcttctcataaatcttagtacttactgcagcacctatcccagtgcctttcataaagtagaagctaaataaataactattgctggataaattaatgtaagttatctatgaagtcagccatcaatttttgtaaccaaaactggaggcaagctttagaagattgaatgtcatagttttagcactgtataaaacaaggtactgttttacgtgataaaatacaggatgaaaactcatttaaaatttagaaaagattagtttgaatccaggataaggtaagtaaaaaataattattttgaaggaagacctcacctcatactattcttgtgttaaaattatggatggtaaacttgccttcctaggaaatgtattgaggggggactcccacaaaaaggacatggccctcattaacccaaggtcatatttatgttctgatcataaatcagatcagatcaggtagcaaaagaatgtacacaatctgcatttcatttacaatcttactattttcagacaattgagacaaaatgtatcagttaaaaatatatatctcaataaatacttactgattgatatgtaaaacccagtaaaaaagatgacacatctttcctgacaattggcaaggattaatataatgagttctttatgccatagtttggtatatattttaaacattataattctttcaactataatctttatcaatgctattgaaccaagaataaaaggaatgtgaacatcaagtatgtgggtgatatggaatgggagtagaaattggcccgtgcctttatataaacctccttgtcttgatgttccagagactggcctccttagaggaggcctccttagaatttattaaattctaataaatattattatttagaaaaataaataccttctttcttagaaacatgtcaaggtagggtgctcacgtgacctaataaccttgcaaatgaatgtctataatgatagttttattattttctctttattattttaacacagaatgaatgctatttcaatatatcttcatcccttacccataaacacaaatatcccactgataataagatgtgagaaggaagtcttttaaattgatttttaaaacttaatttcttcaaataatatagtcttggggctcatcttagaggtccatgtggataggtcagaatctgtcaacattatgtctttttctcagcatttttcctaagggaagcatgctattttgtttcccttgtaattatttttgcttctttttcctgctagtgtactttaattttatttggaaatttgaggatggaaaattatgattatttagattttctaataatataaaacactttttgtgataaagactatgaattctctttgacacaaacatctgcctgtagttgaatgaagtattatttaggatagaatgtagtattcaacaggaaaagcaatttgtctaaaaaatgcttctttccttgctgcatttaccctcttgccagcttgatgtatctgcactgcctatttgttctttgttactgtcaagatagcaaatttctatctggagcagatggtgtaactgccattgttcaaatgcttcaaattcattctgctgctgggtatttttatcattaaacctctaatttagcaatattaataaattgtatctatggactattctgtctgggatgtctgaacatttgttaaatatctgaacataaaaatatatattcttttgatatcatgaaaattgtatcaaaatttatttgattatttcttaacagaaatcaatgtaaagatgtgttttattaatatgttcaaaggcatcattctctctctctatatatatatacacatatatgtgtgaatgtacacatatatatgtgtgtgtgtgtgcatgtatgtattctaagcagataaaactattgttttaaacacctagtgatcttacattttggagaggtagtaaaaaagtacgttaaatatatatgcatgtgtatatatatatatatatatagagagagagagagagagagagagatggtaggtaaatgctataaaattttagctattagtcattagttctataaatttattagttgtgtatgaatctataatagaaggtacttgtttcccttactacttcctccattacttatctcaatagaaatttaaataatcttgatgtgtgtcttcatactcttaaatagagagtttaaatttaaatctacttttaaattacaaatgtgggcctttttatctatacgttctaacagcatgcccccctcaccccatgtagaaagccatcatacttcatattttaccatcaggaaggaattagaaacaaggctaatttttttactctccaccatattttcaatactaaaatgattaaaactggagcaacaaacatttttcagttaactttatccttacagctttaaaaaacaagacaataagtgaaaatttgcagaaatattaataacttttaaacaaattatacttacatataagaattcagtaaatagaattctgcaacttatcatgatttttcagtgattattactttagaaattatttcattcactgtggtctgtaaattgtggccagccatggtggcttacacctgtaatcccagcacttcaggaggccgaggtgggcagatcacttgagctcaggagtttgagaccagcctgggcaatatggcaaaaccttgtctctaccaaaactacaaaaaattagaagggcacggtggcacatgcctgttgtcccaactactagggaggctgaggtgggaggatcccttgagcccgatgaggtagaggttgcggtgagccgagatcacattactgcattccagcctgagtgacagagtgagaccccatcttaaaaaaaaaatcagtaactaaatagaattctgcaacttatcattatttttcagtgattactgctttagaaataatttcattcagtgtaatctgtaaattgaaacaatatcccatagttggacaactgtacaatcagcaatgatcaattctaatttaacaaatgttgaacaaatcaacaactattagggtgactatatattctacttttcctaggacagtcacagtttatgcttattgcacatgtattaaatataatttttaactctcaaaagtgtccaatctggatgctaaattatatactcattctgatgcaccaaggtaaacctgtgttacatgctgatatatataaagaactataaacaaatgtcccttacctgaagaagcatacaaaacttattaatgatgcaagatatatacataaaattcttgccaaatgtgttttttattaaaagcttcaatttttggtatagccagtaaacactaaaaattcagagaagagatataaggatatggattagaatggttaaggctagtttaatggagttgctgtactaaaagacattgtgggcatgaagtcacatagttatggggatgaagacgaatatggtctacagcggatcaatcaacagtggaaatgactgaatataaagaagagtatgttaataagaataataggtaaggactcagaaattctggtctcttgtcctgctcttccactggctaactttgtatcattgagaaaattacttcttcattttgactttagtttcttgatttgtaaaatgagggattgaactggattcatccattcatcagtttttttatgatgagattactttgtgcaagacactccactaaggactatgtaaatgatttttcaagttcctttcctgctttaatttttatggtaatcacttttgtcaccaatacctccaatgatattgttgtagccagtttagaatcacgtgcttctctgtcaaagaagaatatttcttgcaggtaaatgttcccaaaccaacaaatatttgttgcattaagttgaattgaaacttttttcttgcaagtaccctttgtttcctaattggattagaaccatgttttcattccctgtgatggtaatgcaaccctagagtgataagtgactgccaggaaaagctggctttgtgtattttcagactgtgaatatagctgttatgttaacaggtaactgaggctgcagccaactcagctgggaagcatgaatgctgtgcaatggtttttttttttttttttgtccctgcttgcaaatgaaaccagtttcccatttgccctacctccccgatctaaagaatcttgctcttattcccagtgctaatcacctaacaggaaaggtcatgctccctggagtggagttatggtactgaacagcaaggaactctagcaactcaaagaagctgagttgtcttctgtgaatccagctgattcaaggctacaggcccacttcccagtgcaggttttcctattttgaagggagttggaaaagtaaccctaaaacatcagtatggattatacatcacttttgataatacacactgatgctcccttccactaactggataagttgaggatagatctagcctaaaaggaatctgatgagcaagagaaaattatttttacttctcaaatattcattctgtacttgaaaattgtggcatgataaatgtagctgtatatttatccataattaactctggagccttcttaatatatagtatatgcaaaatacaagatcaaatgcagatcatgtttaagttgatagctcattcttttatctttgtcacttgtcagaagtcagagacagatattgtgtgtgcctctacaggatatagttaaagccaggtggagtctacctctgactaatgtatgattttcacattgatattgatggtcatgaagctagcagtagggaattaaatggagagaactcaagactttatcaagacaagttgaatgaaaactaaaagtaggaaaaaataggagttataataaatgtttgatcataaatgagtgctacaaggaaagcaaataatcgtgagggtatttattttctccagattgcacttttacacacagaacacgttgtaaacgttgttaccaggggtttcctctcacttttggtgtggttagggattggcagggaaactgaagtcctttcaggaaaatattcatagtcagtaccgtttactaattttttaaaaaaataagtgaattttaagtgttaagaaatttctactagctttccacatagatctgttgacattttttaagtgtatttttttttcagaaatacataatcttgtaggtttaagcctgtaaatatacagaggcacttttaaaagtgttaaatcagagatatgaacaactgaaaactaaccaataggagctggaaatagagttgtaagcaaatggttgggaatctgtcttttcaaatatactgcatgagaaatataaatcagtctttgttttattctgccagtcatattagaatattctacaccctcaatctataaagcactcaaaactttgaaaacttctgactaaacaaggagaagtaggaagaggaaaagaaaaaagcatatggaattgcttgacaatgtgctgaaatattaagctgcagacatctctgactaagtgtatgtgtaaaataaagaccaaatttgaaagtagattatttattttgaaaatgagctcaattatttcagggtctagaagcaaacacaacgtaaacctctactcatcgtgtatgtgtgtcggtatgtgttagtgtttaattaccactgtggcaaaataagagcatgatccaaattctgtgcctcatcccagaactttcagagattattgacaccttacagagtcattgtaaaggatcaggtgcaggaaggaaaattaaaatgcaaactcacactgacgtgcagagtgagtaaccagtcttagaaaacctgaaaagccatgacattgagcaaggcaaactgggttttaaacaggcaatgggaaggcttcgttttttgcaattgaaaaaaaagcaaaattcgctaagggagagtgagtgtaaacctaaaagaaaggaagcttaattgagacctacaagatggtgggtatgtcttttttccctgaggagctatgaaacttttcagggacagaaataataagaaaatagatctgcatccattgtggttcagggtaactgactgggctctttgcctaactactaggcaactttgcttaatgtagaaagaaatgactcaggttaaacagaatgcttcgctgatttttccaaacaaacccacttaaagaatttcagaaacagggagtttcctctcagatgagctagtgaaaacctactcatgccccaaacaatgtagtaaacacaaattgagagcgagcaacaaaatagcccgagagttcaatataatgtggaaattcataatttagaaacaaagtctgtcatttttaataccttcaaacaggaatttaacaatgtctgtcactgtccatctttgaaatgcagaggtatgagatgttatataaccaagatctttaggttagcaagcatatagatcaaatatgttgtaaatggaatccttgtacaattttaaaccttcttaaagtgataatttgtaatatgtttttgaccattatgtaatacgtttatttatttatttatttatttatttatttattatttttttcttttattattatactttaagttttagggtacatgtgcacattgtgcaggttagttacatatgtatacatgtgacatgctggtgcactgcacccactagctcgtcatctagcattaggtatatctcccaatgctatccctcccccctccccccaccccaccacagtccccagagtgtgatattccccttcctgtgtccatgtgttctcattgttcaattcccacctatgagtgagaacatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggattggttccaagtctgttattgtgaataatgccgcaataaacatacatgtgcatgtgtcttgtaatacttttgtaggtttcagtaatattctacaagaagaatggataaccttaatgatctcgaatatttctggttttacttttgcttgagcagtttcataaatgaatattttacttggcacattatttttattattaaaagaaaaagggcttctcctattacaaaaagtagttctataaatattttgatcaaatttttaaactatgtgacaaaacaatgtgaaataaatatttcaaatgccatttattgatgagtaaattgtaaatattgctaaattccatttacaaattcttggaggaacttggtttttaaaggaaaacatcatgatcaatgtatggatgtgctcattaggagactcttggcctttttcagaaggttatactctgccatagtataaagaatcctggtgtgttcgggtgatattttcaatctaaaatctaggaggcaggtgctcacttgtcctcctccatgcttggaaaatgcagggaggaggccatagtggcaactgttaccatgattaatttcgttgggatagaagatggacccgctggttgtaatcaatgcattgaggactctcagatcagtgggactgtgaaattttaaactcctcaaggtagaacacagtggtaatgttttgaaatttaaagattttgaaatgcaagctacttttctcaggccatttcttctaaacaacacaacataatgtttaagccatgtgttgttcacagattataatgttgcagtgataaaatatatactccattggcaaaaataaacagcggtaaagggactgagattcttgatttttaactttgtatttaaccttgtgtaatgctgcctggaaaatttttgtaaaagtatgaatagatgtaagaagattaatatattattactgtattttacaatctttctgtccttgagtttgaagtatattacaggttaaggttaagccaggaagtaagattgctttatagaactttataactttcaaaattgacatttgaagaaattgtgctatactataatagtgaaataatagtaattacaaagtaaatataatcatcattgaaatataaattttcatacattttttgttcgacacatatttatataatacttaatatatgaaaggtattttccattcataatctatttatctttaatgataatcattttagcagtctaatactggaagtagtattttcttcaattgactgatgataacgaatcctcgaaccataaaaagtagaattggatattgtcagtctctacatctctacttaaatgtattttacattcactttaaatgaaaacaatgaaacacatatatctttaagagtgattaatgattagaaataatcaagggaggcttcttatatgacacggaatgctagttagaataaagtacacggctgggccattgggaagttgaacattaaagactttgccaatcacatcttatcatttgccacactgcaggtagagatttatccacattttgatcttataagactcaaatctcatagtacacaaaaggtgtgtgttacagagtgttttcaagctatgacataccacaatgaagcttgacagtaaatgtttaatggttggctcttttggtaacaaattgggcatatttttaaaattattgacattcatttttgcaatggcacaaacatcttttgaagacttactaaatacagggcactatgctaagtgtaatgaagacaaaagcagattctgtgcattcaagtagcttacagtctggggaatagagatttcttgaccttatttcaaaagtaggacctttctatcttatggatttgtgatacaacatctattttattgcgctgtttctccttgtttcgttctctttctttctttctttcttttccttccttccttcctgtccttccttccttcattctttccctccccctccctcctttctttctttccctccctccctttttctttcttttttctttctttccttctttctttctctctttccttctcctttctttctttcttcctttctttctttctttctttttttcttttcttttcttttcttttctttctttcatctgtgtatttcatcagtgtctacaccaggctgaagtgtagtagcacaatcgcagctcactataacctcgaactccctgtctcaagccatcctcctgcttctccttgtttcttaaacttgaataaaatgtttattcgtagtagattttctgctttagcagatgccactggattctgttgacatataaaattcacgaatagatgcatatattttctcttaaaactgttttctgcttttgcatagtccttatattttagaacatgaaatcatttacccctgtactctgttagaagctcttctgatatggtgacattgattagtatattctcatttaaaagtggagaaacagttctgtgaaatactgaacatggatttctgactagctctcatagtgagggttttcttttatgatttgattagttttcaaagtaaaaaaaaaatctatgtctttccagacttggctaggttcaagtggtcatccatataagatcaacaagggataagttgattttctttcaacacttgctttcaatattttacttttttcctcattaaaattcaaattgctctcaagagcagagaagtatgactacatttcccaacagataataatgaaaaatatcatcgagaaaagatgttatgccattttattttattttaagttccagggtacacgtgcaggatgtgcaggtttgttacataggtacacgtgtgccatggtgttttgctgcacctatcaccccatcacctaggtattaagcccagcacgcattagcatttcatcttgatgctctccctccccttacccccactccccggcaaaaagccccagtgtgtgttgttcccctccctgtgtccacgttttctcactgttcagctcccacttacaagcgagaacatgtggtgtttcattttctgttcccatgttactttgctgaagataatggcttccagctccatccatgcctctgcaaagaacatgatcttgttcctttttatggctgcacagtattccatggtgtatatgtaccacattttctttatccagtctatcattgatgggcatttgggttgattccatgtctttgctattgtgaataatgctacagtgaacatacgtaagcatgtatcttgataacagaatgatttatatttctttgggtatatacccaataatgggattgctagatcaaatggtattttgttatgccattttatcaggatgtggtcttcattcaggcagtaataaaataaagtacattaatttttatacatttttggaaatatcaaggctacatcttcatagcttaattcctattactgtgccttatatgaaaaaatatgcaatctaagaggagggaattgccataaattaaaactttgagtgtttaattaatactatgtgataccatcatatagaaagtttaaaaaacttaagcaaatattttattttgaagcttaggaatatacaagttagtatcttatatgtaacacgggtagatgccagtcagattaataagtgagacatttatttatgtttttattcattttttgatgtatttacttaggctttaggtgttgttgcttggcttttgttttgtttgtagggctgctgtacctgaatgataacatttttctagcttctgagtttgtttagaaaaatgtgtgatcttgtaatttagggcagtggattgtaattttttatagaaattagtttttaacaaattagttttttatagaaagatttcttggactgattatgaattttcagtttacaactgacacacataattgttttcttgttaacaataagctttagcccccaatgattttataattatcttccaacattttgcatattggtgttattgatgagtaaatcaagaaaaaaattcagcaatgaattttgcacaatagaatcaattttctacaaaaataacttgaaaataggagacatgatttttaaaaaggagaaacaatggtattattagtgaattaaatgtgaactttgtgatatcagattatttttgctgttttgggggttcacactttcattctatgtaagtgaagttcctagataaatgagtctttgcagattacagagcattcaaaatatattaggttggtgcaaaagtaattgctgtctttgccattactttttttttttgcaccaacataatatatgtcttattgtttgcaagagccatgaaatctaggttattgatttgtgtcttaggggaaatgggagtagcaatattgattactttgtaatctttattttgtcttctttaatatatatgttagtgtttttaatgcaaacttcttattgccataaagctttatcagccttcacatactatttatgactatgttggctttttttcaagtgaaaatatgaaccacagttaaattggatgatttaacctgggcagtatggggatagtaacagggtgggaaagagtctttgagctttgactttgtgtcctgtctggaaaatccaaattaatccgttttaacaggattaagctctcagtgtgaaagtactttgctaggaaattatcaaagcacaagttaattagaacacagagctccttgcatgggctgacagttattaattacatgttcttgggctggcttaatttcaggcaatttactgctgaaagtagtagaaacaaaaagtttctcttagtttttagtcttgtagagaaaaaacaatccctcaaactaccaactgcgaaataactgctgtataaggtataaagaagacatattttagatttaagttcttcagccagtgtttttggtcattttattcccttcactataaatgtgaattctaagtgcagttagtggaacaatttgggaacttgtgtgtttgcctaagtaaatagagtgttcaaagattgatgtagctactggtagataagtgtgagtttgccttgttttaggattagatacatttctgagaagggctgcgcacggtggctcatgcttgtaatcccagctctttgggaggcggaggcaggcgggtcacttgaggtcaggagttcgagaccagcctggccaacatggtgaaaccccatttctactaaaaatacaaacaaaattagtctggcatggtggcgcacacctgtaatcctagctactcaggaggctgaggcaggagaatcgcttgagctggggaggtggaggttgcaatgagtagagattgctccactgcagcctgggtggcagagtaagggagactccatctaaaataaataaataaataaataaataaatatatatatatatatatatatatatatatatatttctgagaagttctatgtaactatactttttttagtcatattgtaagtgcatgggaaattatttaatgagctttatgagcctcggaggttcacatcatgggattactagaaccattgcattgttcccttttaattttttctcctcatacttaaataaaattataatcttattcttaaaaattagattggtcttacctctttatggtttatcgagttggcatatcacctacttatgggatctgaacgttttggtgcttgagcctctgttgagtattacatgcctctgctaataaactaagtactgctagaggcaattattttgaggtaattattttctcaaaattgaaagtattaatgattggtggtatcatactgtggaaaataaatgaaaagtgagagcatagtaattaagttcttagttcttaatgctgagtttcttaattatggtttgtccatgtcatgatgtaagtggctgaggatgtcagggtattgcccagacatacaatgaaaagatgagtcaacagagaatgagggctcaaaaaatcaccaaagtgcattctctataaaaagcaggtggagagaaaggaatataacatttttcaggaagggattatgggcaactggaaggaaaagacacatgaaaacaatccaaaacacaagaaaaggcagcatttcatacctctattgtttgagggcagggggcagacagaatttctgagctgatggcagtaatccctattctactgagtactataaagccacttagctacaaaagagagagaatgaagtataaggaagctaaaaaaaatacgtaacattgaaaaagatgtataagtatcaagttgtgacaggaatgtaaaatatagaagaaaattgctatattaaggctcacataaggaaaaaaaagtgcctcaagaaaacagcatgaaaagatagatttatgcaggaggaattaaggaatatgagaaaatgtagtggacatgcctgaaacacagacatcagtttccctgggtagaggagggagtgattgatgggggaagtggaagaaggagagagagagagaacgtaataataaaaaaaatgagtaaatgacaaaaaattagggaagcaaactgccccagttgaaaactgatttccagaagcataaaggataaagttaaagggagaatttaagaatttagagtttaaggggaatcttggataattaattaaaatcaggcaactatgagcaacataattgaaagtaggtacatgcactgtgtgtttagtataagaatgcaaaaggcaagttgataaaaatgcaaaagattgtggtgatttatgcaagttcagggcaataaataagaaaaagacatttttatgaaaaaagataagatatggaccttttctgaatgatctttatcaatcattagataggatcattattctgaaacaagcattaaaaagttgttaaaatataagaaatctaggaaggttgatggatgattatgaataaaatggaaaaccggaaaagagaaaattagatttgtgaatattatgcaccacaagagatgagattgcctcttttctatgtgcaatcaaaaggtctaaggatttttgtacttgaacttaaaagaatttatgcacattatttatgttttcagattagctacagtatatcttaaaaccattatgggagtaaatattgagtagattaattaaagttttatatcaattcagataaatactttaaaggtttaatttattgacaaatatcatttgaaattaggtaaaatcatctaggttattaaaattatttaaagcatatttagatttttgtgatattcttagagacatctgtgatttgaccatatggctgatcattctatttttagtgcataccacagatctgttaataaaggctaaattgtctttaattttaggttcagacctatgataaatataaattaaccttacaattttttcctaatccatagaataaattttaaattgttaaaaatcacaacattatttttccttaaaaggaaaatacctctgtctttttatccagaagtacaaattttctaagatatatatgttgctaacagttgtgaggtaatatttcactctgcttttaattgcatttccttgatgattcgtgaggaacattttttcataacccttttggccatttgtatttcttcttttgagaaatgtctatgcaaatattttctcccactctgtggggtgtctcttcactctgttaatgtgcagaaactttttagtttgatgcaatctcatttgtctatttttgcttttgttgcctgtgcttttggggtcatatctaaaaaatcattgctgagacttttcccatatgttttcttccagtagttttacagtttcaagtcttacatgcaagtctttaatcgcctttaagttgatttttgtatttgatgtgaaagataagggtataatttcattacacattaattcgcatttctctggtgattagagatgatgaacattttttttcatatatctgttggccattcatatgtcttcttttgagaactatctatacaggtcatttgcccatttcattactgcatgatctcacttatatgtggaacctgaacaagtcaaactcatagaaatagagagtataatggtggttcccagaggcctgagtggggaggaaggtgaacggggaaagaacagttgttggtcgaagagtaaaaagtttcacctaggaggaatgggttctaagaatcttattgcacagcatgaggactatagttaataataatgtaatgtatatttcaaaatagctaaaagaatggattttaaatgttctccctacaaaaaaatgataagtatttgaggttctggctatactaattagcctgatatgatcattccacaatgtatacaagtatcaaaacatcacattgtatcccataaatgcatacaattattatttgtcaattaaaaataaaacttaaaaaataatttgacaacatgctttgatttacattttccagcatgaaaaatggtctttacatccaattttaaaatcacccttttaattttcctcaacttcaaatatgtataggtagtttgcttagcactgttcacttctctgtttactatatgcctactgtgggccagacactgtggcaggtgttaggaacccaaaaaagaatgttgtaatatttgttaattaattgctcctagccttgtagaggagagagatgtgcagacaaataattaaaacaaaatcgtatgaatgtaatgttagaaataagcatgaggtatacaagtaagctagaggaagaaatggttggcactatcagtgcaggcttcacagagagcatgatatctagcaggactctgtgtaatgactatgagatggccaagcataaaaagaggtcagagacattgcaggcagaggacatagcatgtgccaaaacagagatgtgtggaaacagtacagtctgtattttgctattgctattataggggagcagaaatatcatcacccatcctgtgttaatggctgtactccctgtaagaaaagacagattaataagagaaaagcatacaaatttatttaatataagtttaaaataacatgggaaacatcataaagaaacgaagacccaaataaataagtaaacctttttatttttagtgctaggtttggtgcaaaagtggatagtagtggagaagtatgattggataaaaaagtatgatctaatgtaataaaacttgagggaacttaacaaggcctatttgttcagattcccctctgtgactctgtattttcagagataagaatgttcctttcttttgggtatagggagtgcagttctcaaatgaagatcttatgacttgcttcagaggagaagggtgaggggaaagtgagaatgaccttcctgcttctgctgttttcttaaatgtcaaggtgccatgttttggaataacacgtcctggtctccatcattattgtactactacggtcttctagaaacttcctttttccattaaaagttatacaggtccaggcaccgtgactcacctctgtaatcccagcactttgggaggccgaggagggaagattgcttgagcccaggtgtttaagaccagcctaggcaacataatgaaaccccatctccacaaacaatacaaaaattagccaggcatggtggcatgtccctttaatcccagctactcaggaagctgaggtaggaggactgcttgagcccaacaggttgaggccgcagtgagccatgattgtgccactgcgctccaacctggcaacagagtgagaccttgtctcaaaaaagaaagttatgcaaattgacagattgttggtgtcatcatcattattgcttagtctgtgttaggctctagtactttaaatagtttactcccgtatatctcaatatatgtcatttttagctttaggcaaatgttcagagacatgagtgctatattagctcaggaaaattttagaagtctgtcccttaacaaatatttcaaaatcccccttttctgtattggagtatggaaactaacatgtaccaaaagtttacttttgtgataatttattgattgcctactgtacgctacatacggatactttaacgtcaacagatcttggctccaagagaacagcagtacataaatttagattcaggctttattttctcccttttgcccccaattatttcatgttttaagtattttccacatatgatcatgacaattatagtactaaatctatagtgtctaatacacttttcaagcacttgggaggattctatatttttatttgtcaaattcagcttttctcaatactatttaaatgttattcagaagatattaatagttgggagcagattttgttacatttgcctcttggctgttaatacaaacagtagtttttatttttgtgcttttttcttgatgattaattattttgataattcccaatacaatatggtacagcaggctttctttcagtacaaagaaacacagtgtttatcctactgtaaacactgttaatgcagttttctctgaagaatgctttgtgtcttctgaattgggggacaccagcaaggcttttagccataggaacataagaaattcttgtggtcacagagcaaaggtaatctttcatcttttctgtgttatttttatttttatttatttttgttgttgttgtttgtttgttttttaattttttgatggagtcttgctctgtcgcccaggctggagtgaagtggcgtgatctcggctcactgcaacctctgcctcccaggttcaagcaattctcctggctcagactcctgagtagctgggattacaggcacgcatcaccacgactggctaattttgtatttttagtagagatggggtttcaccatgttggccaggctggtaacgaactcctgacctcaagtgatccgcctgccttggcctccgaaagtgctggaattacaggtgtgagccaccgtgcccggccttttctctggttttgaagatttgtgtagcatcaccattcagtcatttctaactgaacaacaggtgaggagtaggaaacatagtttcatccgtatacagaattttgcctgacttcctatgaaacagaaatagcatgagcttgacgtttctgtctattttgacagatctggagaatgaacacaaagtggatagcataaatctctaatttgactacatttaatgtctaagtcattactttattgcaaagtaccatatgaatgaaaattaatgtttactaaacagatgaaaggaaaattcccaagtccaatttgcagatcatatagatggtaaaagaggccccagtttaatgtattaagaggattcagaaatcattctgaatatcagttgtttagttgattttaacacatcattccatgcttaagactgttcaatgcctttctatctaaactccttatcattgcatacaacatgttaataatatggtcctagggttttctccctaatctcagtctttagaaatcattttgtcacagtggttcacactcaccttaaagtcatttgtacttggtgttctctctggaacactagttttccatttcttcaaatgactagatcatcctcattcttcaagtctcatgtcatatgtgactgcttggaagagttccatcctgatcatgccatccaaactactcactcccatttcttgtgttgatctgttttatctttcacagcattattactgtatacaattttcttctttatttgttctcttctttattatctccctctttctgccccatattgtaaactcccttgtagacagttcctcatctgtcttgttcagtttgctttctattgaagtaagaataataagtaatcaaaatagctaccatccagctgctctattgaatcttaaatctagtcagggctgtcgaattgaacagtgaggtagaggctcttggaaagatttcaaagacacagtaagatgatgaaaagattagaaaataaaacctatgaagaggagaaaatggtgacatgggttgcagtattaactaccccagaataataatccattatatttgctcacttcttgcagtttacagaacacttttgcatgtatgaactccgttagtattttacatgatatctacatttatgattatccctgttttacaggcatagaaacggaggctaggggaatttaactgacttgttcaaagacagatagttataagttattatttatgttttctcagttctaaggccaatattttttccatgacactacttttggtttagtcttcaaagcaaataatttaatttggatgtgatgaacaaagatgtttaatattagggattataaattctgataagttatcccagttgttcccagataaatttggaattccttttgaatagatattcatctgtctggtatggtttggaagagggtagagggtatggctagagggtaagagactacttagatattgtctcttcaagctttaaaatcctataatcttttggctaagtttttgactttcaaaattaatcatttcaaatttacttaacatttaaaatttgatcaaatgataccaccctttgagccttctatcacaactggacttggctctaggatgtgctcattgcatgggctgtgtatagtattattcaatacccagagcatgcagtgtgaacataatagagattgaaagacagccagaagggtaaaacatgaattcttaaagagtaattttgtacttcatgtagatttttttaactctccattttcagctgtttactaactatgcttccaaattctattccacaactgaaattttaaactcacaacttaaatttgcatgttgcttctattataatacattttttattcctcttttatttacattaaaaatttactgaaatttcacatgaatagtcaaagttagctttcagtagcagttagaagcattcttttaatagaactataaaaatacatttggaagaacattattatgatctttcatcatgttgaaatttcttttgatgacacatcagatgctatttacagatgataattgaaatctccatagtataattttacctcatgatgatatcagtgaacatatcatcttgtgatcagctaactggatgtttctttaacccatttatttaaaatttcacataatttccaggtgttttcttttataatgagaatctgttacttcaacaattctaagtagatcatatgtctttgatttgaaataggaaaaaaaatttcctagactgttagaatgattttgtttggttggaaagctgcgtgatctctgcatataattccaagtataaaatgtacttgatgcagtcctgactatattccttataattagaaaatttatttttattttttgcgtctccttgcttgtatcaggaaccaaaactaaacttagtcacctaatagccaaatatttagaagtacttgttaagaggcctagtccaaaacatgaataagaaatgttataagtggaagaaaaataacagaagttcacttaagtgagaatataaatggaatagaggtgggaaatggatttatatagaaagaaacattttaatacatgctgattagaaatattgcggcattttctgaaatattatcaaactgaaaattatggtctaatagttttaaagaaaatatcataacatattcaacacattgtgtttctccatgcctggcatatagcaggtcctcaataagtatttgttgaaagaataaataaaccaacaagtcttatttgagcacctgttatgtggaggatacaatcctacgacccagacagaccttatgatctagtatgggagagaagaaatataaggagaatgcacaagtgatcgccatatctgaaagtctgtgataagaattaaagaattggaaaaggttagaggaaggccagattatttctcatctgggaaacttttggggagaaaagaggacttgagcttgggatttagtaagaatcaagtgcacaaaagtatttattgtagaaatttgagcgaatatataaatattattaaatcattattattataagacagtcaataaactaaaacaagaattatatcatcaataaatcttgttataatcatccattcttaacttcatttgcacattacattgatataatatgaaatagtctaggttcctgcaagcctctttgtcacttagctttttttttctttactacgttatataatttataggcagcatatccaaaatgtttcagtaattactctgcccatcattttattctttgggttaaatttctagcctaagttattaaaaattaatttaaataatgaaaataacttcagttatgtctaatttaaaaattcctattaaatatgtcaaataatagtttatttatttttaacctttttcttcctgagaagatcaaagatcttagcatatttctttctatttcctcctaggacatctttgtgaggagtagttggtatcaggaaaagttaatttcatcaggttagggagagtgttaggagaaaagcaaactgattgtcccacccaaaatatttatgcctgtcttgtaagtgatatgcagatcactttgactctaagctagttttctcatccccttttcatgcaacttgcttcttactgactttgccatttatcagacagaaccttattatgtgcattctcctcctattttccctcctctccctcctgtttctccttgttcatctttcttctttattaagtgtacaaggattatgcaggctttgttcaccattctatatctagctacaaacactttctatagggttgaattggaatccatataaatgtttgctgaataaagtaatagccacccgctttggaaaagtcagcccatttaaatatactaatctaagaaaatcagtataggaagattaatctgacttctgaatgtacatagtgcatactaaaataaaatgtggtcagcttttattttattcactcttttgcaatatttctgctactacgctgcagaaccttgtctgtctcatactccttcagcacttattaggtgtgtaatcttgagccagtgaattaaccttcctgagcctttagatataatacgagactaataatatcttgtctatctgaagacagtaaaatggattagaaagtctattgatccaacttatgataaatgaagatgtgaataaaatttttaaaaattgatttatgaaaattatactgttttctgctctttgcttattagttactgtaactaattcctcatgagattccaaaaccccttaacttaaaaaacaataaaataatagatgtatgtgtgtatatgtgtatatatgtatatatactcatatatatataacatatatatcatatatataattttttcgctaaaaactcatggtacctacctagtaatggtgattattatcatcagttagaagtgtgtaattcatgaaatttctaaaaacaaattcaaatcaaaagctttggtatgcatatttaatgatatattttgaagagttaaagcttacgtaaccatcaccagtgtcctttcaattgccataattgtagaataattttttattggttggctgtttttcttttttttttactggcactgaaactttaccccacattgttcttttattcattaactaaagttgtaccctaatacttggttctgtactaggagctgcagatacagcaatgaataagacacaatccctcccttcaaagagataacattttattgggagaagtaggcaatagagcagacaattaatatactgtgttgaagtgctatagcaagaatgagctcaggatacattgtgaacacatgaaagttctccgaacccagctagaaggtagaggagtcagtcagggaaagcttcctagaggaggtgatgtcagtattgtatttctcctgcctatacatgtccttcccaaggaggttgaaatgcaaattatttaaacatttagtatctaagtgagatatacagtaaaaatttatcatttggttatactggctacttaatgtttagtactaaatgaaactacaaaacacattaccaggactagaggtggggtagaaaagaaaaaaaaaaaaagccataccaagaatgaagaggcagttttcacaaacctgccaagtaaagaataaggtatgattaggaatcagatgcttactagtagacttcctggagactaagaatcagaaggctgaatggaatttaggtgacaatgctgaagatttttctaagagggtgatgtatttaggttaagtaacaaacatgacagttaatttgagttgtgtgctttaggttgttcatagaactgagaaactgggatcagaccaagttaccatggcactatttctgttttaaatggtctggtaaaccacctgtctaatctattaatcaaaatgtgctgatatgttgtagtgattaccttattatctattcctaataatactcctacaatgtgttttcagcccatattggagtatggctaatgcactatgttaatattcttttgctagatatgttcattttaaagttgtcaattactttttgttgttcctcaagttcttgtgtatttttggcacatgccatttaagtgtatttttttactatattttatgaaaataattttacagctacctcatgtatcagcccaaaatgttagtaaatgacttgtcttcctacaactctggatgagatatatctatatctgccttttaggggctggtggggctacacactgtagaattcttttctacctcttaaattccattggcttgattggattccttcggaacatattataccttcttgagttttgtgtaaaactctacccttctgattttacctgttaattaagtttacaagaatgacttgctgaatcatggcacatttattttgattattcccatcctggctttcttcatatttccattatcatttcaaatatgcatttaatttttgcttgcatggtaatttcagccaacttaccttcatttaggtcagtttgtacaagaaaattaattatcttattgtttcatccactggattgatttctgctactgtatatacaagccaatagtttgttcttttcttttggtgccttctgtaaaactggggaccattgtcaattaattgatggctcacagatttctttctgacctctattaccttttctgaacttcttgtatcacagaatcacctatcattttattgtgttcactttgttggcttagatgatttattgtctcactactaattatataactagggaaattagagatggaaagattaatgtaatcttccaacttctttttgtgctgtctgcacttatatttttcttagagtattgcttcaacatgaagaaaaagaatgctcatttaatcacccatccatccaatttttaatttattttttaactctcagtacaatacttcacacaaagttggttacaaatgaacgaatatatcaatttgtttcttaatgcaataaaagtcctgctttcaaggagtcaggttctgcttttgctttacctataactctctatagtctaaaaaggaaggagaaatggagtgagaaacagaaatagagagtttttaatccagagagacagagagtctttttaaatgcagtattgcttagaaagagcttactaaggtaaactcaagtctcaggtaatttttttttctggaataggttttattttgtgcaaaaattgtcaaatataaaagtagtttatgtctgaatttgccatcgattatcatagactttacacagaaaccttctcatggaagatgaatgaatttttctgaaatcacttttaaatgtagccaatttgtatcagatcctataacatgaatgttaacactgaagatttcatttcacttcaatcttagccaaaagacatattgacctagaaaaggacatatgtgaaaaaaaaactaaaaatattaaatatgcttgcatcatgtctaacttggcaaagcaaatgtataatttatcttagaaataaatattatataacagagtaataaataatgtttacagtgggaagcagtcttatcttcaaaaacaacttttctagttgtgattataaaacaatcttgcaaataaagaagtgcagctcaatgaaatgtaaaagcatgccacttcaacataatttagctagttgctttatcttgacacatttcttgattttcatgatattagtgtaaaatataaatattttcatacattttccataacccgattgctctttctttccaaaataatgatgaaatggaacaagaaaaaattgtctcccagcaaatatttagacatgtgacattttgtgtttttaaaggtcattgatattttagggtatttatcttaactacttaatatttttaattgcttgaattgccttcagaaggtgactacttttctatttggttgcatacatggaacccacaataataatatgtatgaaaattttcctctttataaataattcatgcaaattcaacaatacaccctgaaaagtaaatatttatcacctgcgtgtaatatggaaaacatttagtgttattaagaagtaaccgattgcaatgaatagaagaaatctgttttaatgtggtaagtctacctcccttaagatacagtttgtctagggcagctgtgaatttgttcctatacttcatggcccacctaatcaaattcttcaagagaggtaattatctttttattctcatttttttatatatattttttattatgctttaagttttagggtacttgtgcacaacgtgcaggttagttacatatgtattattctcatttttttaaggttcacaacttccatgatggaaatagattattagtaactataactcctgaagaacaagccaatattttgttgttgttgtttttctgtgtcttctgtaaaactattaatctcggtcaattaatttatggtttgggaggcagtcagtcatgtcatgaagacctaatctatctagaataaaaaaacaagatgcccaggcttaaaatttctttgttacaatataatagcatttctgtaaatagtaattttatttttagaggaagagtaaaacaattttttttgtttgtttgtttgttttggtttctccatgatccttgcattagattttacatttaatttaacttattttaatttttatctacatttgctcttgttaataaatacttttaaacaagtacaacaaataaaattccagaattgatcacttttattattgcaaaagataatctttcatcttgaatatttatgaattatcatattcccttctaacaaggatagcaatgacagtttctaatcctaaatgactgatacaattaattaacctgtgaaatataaaatgctaaaggaacaagtcaagagaatatatagaagtatgaaatccaaactaaaattgtttttatcttttagtttggaaatatacaggaaattgctgagttctgtctctatcaccagatagccaaagtagaattttagtatgtgctcatggaatggtgggtggatcgatgaagattatcaggaatattggagggtttctattttatctcttgtggtatggcataaatggtgaagcattaaggtatgaaaatgtctaccttgtactctcccatagtaaatatgataagctatgaaatcttgaagtggaaatatccacaactctacagaaatataaataattgaataagcagataaaggggggagaggagggataactctgccatacagaaaaattccagtttataaatgtggacacaattagggaaatacaaaatcatcatcaggcaaacacacagtaaccattgttgtttcaggccaagtccactaatatgtgctaaaataaggggggcaaaagttttaggataaacagggtattaacatagtttcaaaatatctccctcaagttatctatttggttactgtattagtttgttctcatgctgctaataaagacaaacccaagactgggtaatttataaaggagagaggtttaattgactcagttccacatggctggggaggcctcaggaaacttacaatcatggtggaaagggaagcaaacatgtccttcttcacgtgctggcaggagagagaagtgcagagcgaaaaggggaaaagccccttaaaaaactatcagatcttgtgagaactcactcactatcacgagaacagcaacatgggggtaactacccctatgattcagttacctcccaccggatccctcccacaacacagggattatgggaactacaattcaagatgagatttgggtagggatacagacaaaccatatcaattacaaagaggctaatgtagcatcatagaagaataatcagcagacttcactttaaccaagtaatcaaggttataacatagtgacagtttttatgctcatcccatctcctcaccatcatataatgcattgagaagaacacagcatcacttctgtagtattcttgcccctgcaaaaaagaataacttcagtctaatcatcagacaaacccaaactgaaacattatacaaaataattggccagtactcattaaaaaatcaaggttatgaaatacaagggaaggctgccaaactgtcaaacgttggaagagattaaggagaaacaacaactaactacaatataggacagctatatacaatatagtcaacattcaggagaaacaacaactaaatacaatatagtcaatatattgtaatatattgactagaaatataatataggatcctggaatgaatactggactagaaaaaaaactgatgaaattcaagtgaggtttatagtttagttgatagttatcttccaatgataatttcctcattttgatcatttgtttatgattatataagatacttggggaactgagtgaagagtgtacaggtactctccaccatttttacaatttttctctaagtccaaaattattttaaaataagaagtaaataagcaaacaaacaaaaaggcagaaatactgtctgcaccttccatgacacaggctttatcaagtgatatgatgaatttggatgttatatagataagaagtgaatttacacatgtagtaaaatcggtgtatctatttaatggactttttaaccacatgtcggtatctttaacgccacagatatacagtgagatcataataaccagtatgtcagcttgaagaataggaacatatagttttatcttctaagattcaaattattattcatgatttgtttaaagcaaatcaaggctgagtttgtaactctggaatttttaacttacagattctcttactcattcctgtcttccaaacataaaacatttttatttccctgtcaattcattattaggagaaacaagaatcttgaaaaagtctttcctatgcatccagcaataaatgtattctactccaccatggactgtttattgactttattacaagtccattatctgttttcatttttacttctccaaaattgctaattagaacacaacacaaccatttgcatccatagaaactttgcgtttacacgattatctctaaatggtattatttccattgagttgtatttctttgtgactttccaatccatattttactaattcattttgtgcataaaattgcacatgatttttaaattactattactacattttactttattttaaacttaacctttaatattgcacactgagaatccttataatagatttgaagtacaatgccctttttaggatttctatgtgtttgaaattacatgtatcagtgaataaggtatactgtcaaatacttaataccttaagaagtcattaatgttaccaaattatagtgaatggtgctatattatattttgaacgtttgtggcctctaaaccggtagcaagtctcttttagataattttgtaaaccccaaagttgtgtattctatttaagattatttatacactcatgtattgattgagatatctctgcaaatatggttcatttaggatggatcttgttagttattagaagttaatagtcaaataagtattcccctcccctaagcttccaggctaactcatgtctccctaactttggccacaggcccaagcaagcatctatttttaaagtgaccctggaagtatgtttcttgccttcggaagtagagtgatgcattatctggtttgagtggaaaagttggccgggcgcggtggcccacgcctgtaatcccagcactttgggaggccgagaagggtggatcacaaggtcaggagatcgagaccatcctggctaacacagtgaaaccccgtctctactaaaaataccgccgtggtggtgggcgcctctagtcccagctactcgggaggctgaggccacgtaaatacacaataattgttttgctaattagtttgaacactatgaatgaatttgtaaaaaaaaaaaacctataatatccaataaaccattccaaaaaggaacacgttttaagggaaatgattgtatatatgttatgaggtaaaatttatttttactccagaatgtcagctagtaatgacacctggctaattttcgtatttttagtagagatggggtttcaccatgttggccaggctggtctcaaactcctgacctcaagtgatccacctgcgtcagcctcccaaagtgctgggattacagccctgagccaccgtgcctggcctggaaatctataaataattattttggcacctatccatctgcattctgacctccttttggcgtccagagatctcaaatccttgagcatttcagggaccactactgtgtaatacccaactgtggttttgttcttgactttcatttaaatctgccatgaaaacacacataacaagcaagtcttacgtttcctaggtcccactattttaaggtttaatttgcaaattaacttccaaagctatattattctacttgttagccctttcaaatagaatcttgctgccaactggttagccatttcaaagtctttaaacatgtgcaatacatttgtatgtattacacagtcaatatgttatttcattctacattgattgctctctattggcaattgtctttttatttggggctaaaacaaatgctgaagtaaaataatggcagagtttttcaatattcggtaggaatacaaaatgaaaaggctgccttttttaaataaccaatcgcttaagtacttcatgtaatacttcttaatttcacacttataagagaatgtttatacaggtatagggttactgaatatttcacttaatttttttataatgatattattattataaaattacatggtgtttcttttactggaagaaactataaaattcagtaaactcctctaaacttcaggtaatttctttcatatgcaaatacattcacaactttaaatctatttgaagtaatttagttctacagtatgttgtgtttctctgtttacctaccaacacacacacaccaagatgcagatcacaaacacagaaaaagaaattgttcccttgatttaggacttgaaatataatcaagccttaagatgaataaattatttgaaaatatcctctaggtatttgcacatataatatatcccaagggttttacaatacaatgaaatatactttttttctaaatgactgtgcagacacatgcagaatccattatgcattaaagggaccaataacttctcctttcactgataataattcatgtagtgttataaacaatgctaatcttgccaggagatggcttcttattcattttgaaattatcagtgaatcagacaatatatctatttcatgttgtaaataaatgaggaaacatagagtaaggggaaaaataatcctaaaataaaatgtatacaatagtattgcccttgattttaaagtacttgtgtaagtaacagaaaatcatgatgtctaatgtaaatgtcccaagttttagaagagtggctaaatccattgacagagtactcaatgctgtataacagagaaagaaataggtgtatttaggtgtattattgtaaacaggtgtatttttataagtaacgtgctaatcatggatttgcttgatggaatctattccaaagaacccaacttagttcttgaagtgccataggtctcaccttcccaattagattgtaagctctccttcatcaactattacctctttttttttgtttgtttgtatctcccatagtacctagaactgtactgattcttaatcagtagtcaacaattgcctatagaacctaatgaaatacttagtgtattcgttccagcaacatgttcagcactgtttcattgaggagaggggataataagcaggatggtatgataggaaatatgcattgacctggatttttaaatgaaaaatgaaataaattaaaatattaaaacttaaatgttaaaaatctctatataggattatagtcacatgacttatgaagctttgagcaaaaatatgccaagaaggaaatcataactaactggcatttattcttgcaaagtaaaaaattaaaaagctttcaaacaaacaaaaaccaaatacacacttgataaaaattatttttatctccctataaaggtttttgttttacttttgtttttggtggattgattttatatgatgctaagagctctgaaacagcagggctgttttccaaatttagcccccactaagtgagggaaatgcatttccaactctatgtttgcttttaattatttatttaccaggttgccctttctccagaggtagtaaatccacttaccttttatgcatttttgtctcttgaactgaaagtataggtaggatctttgtctcagcaagaagaggaaatagactagactgcgggggtgagggcagtgcaggcaatctcgtaatgtgttaatagtaaccagcaggaataattctgactagatcatttccactaaatagtttagtttgtgaagaagactgacaggatcatttccactaaatagtttagtttgtgaagaagactgacaggagtgaaggctcagaagattatttggaaaagaccagtgctttgcatctggtgaaagtcccagcaaatcatggtatcagtgaggactatactaggtgtctctttttccatctgacatatacccgtgcaaagttttaagattcagcagtaaagcttttattctcctaccacaatcactatggctgccactggttgtgaaaatcacctcattttattgtttttttcttcaacttttatttttaagctctagggtacatgtgcaggatttgcaagtttgttacatatgcaaatatgtgctatggtggtttgccgcatagatcaacccatcacctaggtattaagcccagcatgcactagctattcttcctgatgctttccctcctccttccccacctccagactccagtgtgtgttgtttccacccatgtgtccatgtgttctcatctttcagctcccacttataagtgagaacatgcagtgttttggttttctgtatctgcattagtttgctgaggataacggcttcaagctccatccatgtccctgccaagaacatgatctcattcctttttatggcttcatagtattccatggtgtctatgtaccacatttgctttatctagtctatcattgacgggcatttatgttgattccatgtctttgctattatggatagtgctacagcagacatatgtgtgcatgtgtctttataatagaacaatctgtattcatttgggtatatacccagtaatgggattgctgggccaaaggggatttctgtccctaggcctttgaggaattgccacactgtcttccacaatgactgaactaattaacattcccaccagcagaatcactttatccaagtgcttcaagctgttctgtaacttaaggtggaattttcgacaatgtcaaaattactcagtttcatactgttgatgttcatgtaaatttttggttaattttttaacagcttgtttgagatatcaaaagacagaattataactaatttagttctagatctaattgactttccttctcattcatgtatcgcaaatagaacaagcactcccactgtgcaatggcagaacagtgagtttcataagggggtacaaggtaacagaacaatagaaaaaaaactgattggttaacgtcagcttgcttcaggttacttttttttggtaagggtttaagcagaggagacctccttattacactgactcaggtaggattggaagtatcctgttttcaggaaaaactgatctgtttcaggatctgtctgcttccttagagtttcagtttgattatttggcctttggcatgattgcctccatttttgttcgatctgctctttagggccaactgtagtagctaaatccaaaacaatggactggcataatttttgtttaacagagttataatttaaatacagttggcccttgaacaacgtgggtgttcagggtaatgaaccctgtgcagttgaaaatctgcatataacttttgacatcacaaaaccttaactactaatagcctattgtgaagagttactgatattataaacagttgattaacaaatgttttctatgttatatgtattatgtactggattcttacaataaagtaagctagggaaaagaaaatgttattaagaaaatcataaggaaaagaaaatatatttgctattcattaagtggaagtggatcgtcataaaggtcttcattctcatcatcttttcattgagtgggctgaggaggaggaggaagagaaggagttggtctcgctgtctcaggggtggcagaggtagaaacagtggaggaagtggaaggggaggcaggaacacttggtgtaactttttctgaaacaaaatctgtgcataagtggacttgagcagttcaaacccatgttattcaaggatcaactgtatttggttagttgctgatatgtcttctttttcgcaggtatacccttgtaggaaattaaagcccactttctccattattatctctttaagagaggtttttcttcttaaaatttattttttatctctctgatatgatactgcctctcttccatctttatcatttgcaaccaaattatatctagaaccagaacctgtttatgaaaagatgtgccttctcacttcgtgctgctgaagaaagatccacagtgatagtagagaaagcaacatattagctgctaaaaagattgcaaacataaactacaattgtaaattttgaagtcaactatgttctgagcttgatttctttgcttcaactgtctgtatgaaatggaataaatacagctaaccaaccttcagggatagttttgaggaatgttgtgaaaaataataaggtgcaatcgtcacaaaaataattttctagaaaaactgaattgaaaatcaacctgagtatttaagatacagttttaaaaaactatgagaacaacctttctttctaaaacttaattcttatttttctttatgattatctaattttgtcatattaatgttgtcaaggtgccatattatgtacaatgaatagagaacttgagttctgagcaaaagttacattttagattttgtaataacattgagaagattcaagataatgagctttgtgtttggttatttatgtaagtagttgaacactcacttttttttctttcttgacttgatttttaaggccatttatattagatcttccctaattcatacatatgacttttttcttttaggtataatccattgtatagtcacttttaagatgttttgaaaattaaaaatattttaaattcaataaatagcaatattggatctttaaattcaatagggaaatctcaggaaatgtactgtaagttacttccctatgcttgtcttgaataatcttttaattttatttttagttaaaaaattacttagcaactgtagcagtgacataggtaacagaactgccttacaaacaaccttgcattatattcattttctactatattttttaacatcctgtagtctatgaattatcagaatcattgacctcttaatcatttgtttgcttcttgaattttaagggaactctgggcactatcaaaatgagggaaacataatatcacattctaaggaccttactatattcaaacctataagcaacaaatttaagtactagattataggctaatcttaaaaactattttttatagtatcagttgtttttttaacaaaaaataccttagagaaaaacaataaaaattaattatttatgcagagctctaattttgttctctgtaacaggatgcttggtttctgtcttattgtttccctgagacatcaaaaacaggacttaaataaattttcgaaaagagggtttctatagttacgtgtttttgtttgttttttagtattgggtactagatacattacgtacttgtaatctgacataaacaatttaattatcattagcttattgtatctttgctgttgatcaactcaacactcaaagcttactcttcgctaccagtgtcttacaaaatatgtactgactatattttgagaagcctaaaataaatgacaaaagtactaatttgctgaactttggaagtgtatgagaatgtttaagcgatttatgacatgttgaggctatggaaggtagaatggaagatgtggaactgggtgacattgaagtaacatgtaaaatgatttctaggaagccaaggaactaaattgtactcaactagtttttcctgtgagcccagattgtgcacagaccctcttccaaacgtgtttcacaaatccaaggcagttatagaagaagtaagaatgtgtgtcctgattatgagccagaaacatgacctttactgaaaggcaatgatatatttattaactatttaaacatttctagaaatctacagactcatttaatgcttgcattaaagttattttaacaaaatccacttacatactttcttcttatgtatggtaaaaattactttcctctaaacatggtaaaaattatcacctgtatctgcccatgtcttggaagagaaagtacatacaaaaaaatctgtttcattgatattgaaggacaatatatgtatgtatctacaacacaaatatacctttgatttactaagccaagtaagaaatggaagtgtttgggtataatagactctcaatgacaagtcctgccactttttctttcttagcacgtcttcctttgtagactatattgtttctaaagtgagactatttatgagtttatcctcctagcatagatgcctgatctgttctccttttagcttgaaactatttcagtaagagctttacacaataggcttgagggcactttaagaacatgtcttaagaatatttgaaattaatgactaatcatcccaattcaataggacaaatattctgatctacatttgtgcatcacccacacatttttgttttaaaatttttatttagctcttagagatgctgtgagggaagccatcctccaaagctccaaaattctataattatttttaaaattgtatttatggctaggtataaattcaagataagtgggtgtagaacctgaaaaagcatagatggggaagtaaaaataggtattacagtatgtgccccaataagtaaactctactccatatattatcctcttgcatattctttaaatctggtgttaccaaaatgggaaccaagaattattttttttacctgtaatatttcataaacatgctcttacataaccctcctgctttggaggatctaaagcacaaaatggaagagagattatatagccacagtttttccttgggattattaggtatttcaagtaagtgttagatacttagggccaaaaattaacttctacttcaactaaaatgtgtgcgtatgtaaataatataatatatacaatgtaatatatataacatgtgtatatagttaagattatttttgaaataagtgacttttgtaggatggtggcactgttgacataccaaggcaggaatagatactttctttcaaatgatttacagaggtcaaaagtaaaggtacatgtgttatacaatactgtctatgatatatgttctacacttgtgtcagttttttttttatacaggggagaataggactaattagtctttttcattgcattttctatcaacaggttcttttctaaagttcatgtagtaagtaatatgtcatagaaactgaaaaaaggatagcaatcataggctggcttttatcttaccaattaatctaagaaccatatacacacaataattcgctggtaataagttaaagttttctcagaatgtgaagtattactttaattcgatgagcagattggtacattagagctttttcattggagaagaaaaacttcataaagcctaattcccttttgatttatataacagtacccaaactcttactgagcccccttcgtctattacttagaattgtgatgatcatatgaattgggaatcatttaattgagcataataatcatcaggcaagccagtgaaccaggttgttgaacaaattaagcttattaccattaagagtggtggcacgtgcctgtaatcccaactactcaggaggctgaggcaggaaaatcacttggaccagggagtccgaggttgcagtgagccgagatcgcgccactgcactccagcctggcgacacagcgagactccgtctctcacttctatcttttaagcactaagttaaaagagtacttttacacaataaactaggggtgttttatacttacaacagctaacattcattagacattatgtatccagcattattctaagagtattgtatgcatttttcactgtctccatacaacaactatttacaataagttttgttcataacctcatttaaaagatgagaaaacaatcatagagaagttaaataattggactcagatcacacagcttaaaagtagcaatgctgccagacgtggtggttcacacctctataatcctagcactttgggaggccaaggcggggggttcacttgaagtgaggagtttgagaccagcctggccaacatggtgaaaccctgtctctacaaaaatacagaaattagctgggcaagggcttacttggccgggctcagtggctcacgcctgtaatcccagcactttgggaggccgaggcaggtggatcatccaaagtcaggagttcaaaatcagcctggccaacatggtgaaacctcgtctctactaaaaatacaaaaaaattagctgggtgtggtggcaggtgcctgtaatcccagctacttgggaggctgaggcaggagaattacttgaacgtgggaggcagaggttgcaatgaacctagatcgcgccactgtactacagcttgagcaacagagtgatactctgtctcaaaaaaaaaaaaaaaaaagcaattctgaggcaactcctttagcaatttactgcataaagttttctatttttgtcctcagaaaatcgtcttttatgtatttggtctttattaactatgtaaccattatattgacatttggccaaatgcaaaatgcattcttatcctgaaataagcaattaaaaatgaattgatatttttaggcaagcctagcatgtagcaacacactttttatggttttgctaatctgatagtgtaagttcaatgtttataatgaagatgtatttaccaaaactcaaatttatgcaatatattaaatttatcattaaatgtataaatttttgacagatagattattaatatcctctatatgcaaacccatagactattatcacgagttagccatgtgtttgcctttaggcagtttgcccgaataaaaaatattcaagagcaaattttttttaattttaactatagtagtgttttataattaatgtacgagtttagctgaagaaaagacctgaataaagaatagacttaaagttcattcgtatttaagttactggctattgtcactgaattatctattcttggttttatgaataggcatggaaatcatgaactggactcatcatcacacttatgtcatttatttgatttgtgaaacattttggatcaataattttaattaatatatatctaatgtgtttccattttgtaaaacaatttctttacagttcttaacacattgagggagaaatcaaacagattaacattcaaattttcatgtatgaccattggtaaacacagaacagaaggaaaacatcccaaaatgttttttctaccaaaattatggatgactctttacaaataaatttcagcagttttagataaatttaaatgaatattgaattaaaatggcaaaagcaattaaatagaaatatagttatatgccttgttttcagatcccagatgcctgatctccagattacgtgaaaattattattaatctcaatgacaaatattgaaatgagcattttgctatgttactgataggttgcagtttttaatcaatagattgaaaaactcacaagatttggatttgtaacacgttgctgcaagatttgggtttgacatttgctttaacgtttaattcaattatttttacatttccactgagattgacttgtataacaacatggtgtttatttcaattgttaagttgatctgtgatggcttcgaaaatatgtaatgttccttaatgtataaatgttttaaaatactataaaacttgcagaatatttcttttaccattagcattattatactgtaatcattcacattattgatgtggactattatttttaagaaattggtattcacagtaataggctgaggcattagcattattcatagtcagaagttcattggaaagtaaaattaaatattcaaataccttataatattttctttaaaaatagcaatagttgtattcactcgcaacatacttgagcatgagtctaatatgcacttgtcatagagcctgttcatagaaaaatgaataataacagtacccaaacatttgtcttctccttctttctcaatcatggaaatgaaaaaggtcactactatttatattaatatgtatcagaaaccgttgggcttctgctagatacaagcaaataaatataaacaagaagaatagcagatcctgagcatttgcctttataagagagaagtgctaaatctgaaaagtagagtaacttggactataaaattaaagtttatctgaaatgtggtgtataatcatattttaacctcatctctgctaaaaaggtaaattaaaaattacatgggtatggtgaaacatgcctgtagtcccagtgactctggaggctgaggtagaagagtcgcttgagcccaggagttaaaagtggcagtgagctatgatcgcacccctgcactccagcctgggtgacaatgagactgagtctcaaaaaaaaaatcgtatttcacaccacttagataaaatcatataaatatttcaatatcactcctggattaaataaaatcatatgtaaacatttacttaagctaaattattttttaaaggggtatgctatctataagacttgggcaatttacttagtttccctgtaaaatggaatattctttacctataaaatgggtattccttacctttgatatgagagttaaatggaatagtgtaattatatacctagctgtaaaatagctatagctaattctccattaaaaatattcacttgtacacatgcacacaaccaattaagacttcaaattaaggcatgtatacattctgtagagtttcaaatataactttggaaaatacagcagccatatttacttatatgttaatatgcagatattgagattattagattatgttacaatatgctgttcataactgagttgtttagtcaatgtttcctacttttttattgttaaaacagcacagctatgaagtgcagttatcttaatttagctataactaagactaatgtggatctggaggctcatctaattgcaccctcaagatcaacaggatttagttaaatctcatcttccccatgtgtagctggaccttaacattctatgattcttcattaatcagccaatttttttcagggcaaaggctgcttctcagttgtcaaatagacaaacttgaaagctatatgataactcttaagattgtcaaacaattatagttggccgaaagcagtaatacactctgtctcacttttgggacctgaattatctaaaagttaactttagtttggaatgaactttaattaattccaggaaacaaaaaccagtaagaagcaaattatttcaccaagttattacattcattttttatgattatcttcaatggatttgatggtaagaatgtgaattaataaattagatgtatatgatattaagctaaactaacctagattttcagtaagagattaagaaatctaaggtcattatgattcaacctttccttccctataaactttcagaaaaccctctttgctactctctcttctcgggatcttcatctccaagggaggggattccaataaaatcagaaaagaaaaaaggcttatattatttggcatttgatattcttaaatcctactgttcttattacagtagatctggcatcatatggtaatgaggttttattttaaatgaaaatcctcaagactaagtagaaaaacatggacacaaaattatgtatttgatttcaggtatgtgaaaatatgtatgagattgacagtagttatatatgggggttagcatcacctggaactttttaaaactattttttttcatttttcaaactttgtacaatgaacatgtatgttatttatgagcaatgcaattaagtgatattttaaaacattgtggaaactttttttgctatagactgaaactcaaaattctacttctataactaaaatcttcagtctgtaaatttctgaaaatacattaataatatataatatcataatatattctaataagaaagcacatcagacactgtctgtttcaaggctgtgcttgatgaacctttgaacttatagcttgttatggagagtagagaagagaatggctgtgttctcagcagttgtgtttttccaaagaccatgcctcaaggcaatgcaggggcaccttttaactcatgaacaaatgtgtttgttgattaaacgtccagactcagtaatcacagcccagcagagagcttcgtgacatatctttccacctatttcatagtctagttttctaggatattctcctgagaaaatctttaggaaaaaaagtgaatgacatatggttcattctatgtagtgtctgaaggtctgtttctatagcaacaattaacaggctaaatgttaggatttgaaacattctatagctaccattgcttatgttaacaacaaactttagggaaacttctgaccttatagtagtgactttgaaagagtgaattgttttcaagaatttattttttttctaaatctgcagtagtcaggatataaaggagaaatgtgtcttctggcgccccttttcctatctgcttctctacttcagatgtttatttttgtatttctgctcatatcctcccaaattgtaaatatgaaactttgaaacattataattatgatacgtaatcagggccaatcaatgcccttaagtcaaaatgcatagcatgatgagatactttatattgcatagtgtcttaaaaaattataacatctattatttcatttaagcctcccaataatcccttcaagtacataagacaggtattatagtcactcaatagatgggtatgtaagttatggttgagtgtcttccctaagatgtattaaaagcagaggcagttttagaatccatgttttctgcctctaaactctatactgtctccagatagttttcttgatactgtattcattattatggtctaggaagttgatgaatcttaaattcaattcatagtttcacatcatgtgttcacaattccaaaatcatatttatctaaacttcgaagaaatacggaagtatagttaatatgattagagctaaatgtctcaggcactgggccagttgctaccttttgcttctacattgtgtctacaaaacaagcaaactaaaatatctgtaaatattacattaacattttcttcaacatagatgtattattaaaaatctagtggcataattataagacaactgtcatactcagcagcaaatgttctacattatttaatacatcttcaatgagccaggtcagagggtggtatgcatacggtagaagtgcaaaaatattccttcttataaaaatagacaaaaaaacccaacacaatccaacttggttaattggaacagcatggcaaaaagagatttgattaagccctttttacttttaatttcaactcttatagtagtacatccttctaaaatgcagaagtcttccattcaggtttttagtcaatgatctaatctgtcattttcatctatggaagaattccaggggataccaaagaagttactaatctatatccacagggtagaaagggactttggaatggtggagtctaattttttcttaatgtgttgtacttaatctaacattagcttgttgaaagtttattttatgttctcgccttgacatttccaaattaggcacctttggcatttacattactctttttatttcccggagctttgttgtagtacactgaaataatgactcatcatacaatatgtgatgacctaaaatagttgctgtagcttcccaatgtgccagaaagaaatagctgaagccctgacatcttgtttcattaaacaaaaattcaaagtaatggcagttgccaaagaacataaaatattattatgttgaaagattttctaagtttttaagacttttcgtttcttttttcttttttttttttttttttgagacgaaatcttgctcttgtcctccaggctggagtgagatggcacgatgtcggctcactgcaacctccgcctcctgggttcaagtgattctcctgcctcggccccccaagtagttgggattataggcgcctgccaccacaaccagctaatttttgtatttttagtagagacgaggttttaccatgttggccaggctggtttcgaactcctgacctcaggtgatccacccaccttggcctcccaaagtgctgggattacaggtgtgagccaccgcgctcagcctttaagactttttgataaccatatctcatattgtgtaggtaaataagaaccctgaaaatcatctgcctgcaatcataagttttgtctgtagcttcctaatgcatatagaaaaaaaccacaataaatgaaattgactaatctagcaaaatgcctaagcaaatagactccctctccaacattcagaattatctttaatcttgtgatataattacctcaattatccataaccattattccatgctgaaaacagaaatgtgttccacttcagctttctgaggtaaaaaaaaaaggactaacttttgaagaggaaaacaaaacaatcatttgagctgcaaagtgtttccatttttatgcacattaaaaaatccatttggaaaggaagaattcattgtaatctgcaagagtaacacattttgaattgtaatacacatattttatttcatacgaatttattaattattgacagaagtactcatgagagtgtttaagttggaatgtgggatatcatgtgtcaaaaaaaggctcacataatttgttattattgctctatgacactcttttgtttttgtgctttttgcctttagatcagaatgaatatgctctgcacaatttgttaaatctttagaaaaccatcaaaagaccactctggaattatttgcattgagccaaaaactattcggataacaggtggcctgagtgggtgtgtgtgaaattcaagggatagaaggaaagcaagatttgcttacttgaaatcctccttcagttcagtgatgggactccttaattgaattcaaatcctgagcaattgtatttgatttcctttctgtattaataaaggcatagaggcataaaagtgtttaacatgttcaagaaacataatatggtttgtgttagatgtgttggcatatgtgcttgttgtgtacttgcagggcccgtgttgaagggggaaatgagaagtaggttgtggaaattttgtttaagatctaaagagtttgggttttactgtgtggtcaatatagatttcctgagctgattgacaacatgattttatctcatacgggaaataaactatggtggcaattttgagaagaactgaaatgggtaagagtctggaagcaaggaaaaatatggcgagactattggaataatctagatgaaagttgatgagggcctagataaaaggaagagacagattcagacagtttgatgattcaactcttaaattatctggaaaaactatgtctcaatgaaatattagttttttttttcttctttttagaggacaaacctcagttaactacaagaaaatgttcaaccctataaaatgatgaagcacttactagaattttaaccacggtacaatgaaacagtatactaaacaaaaataaaaatgccattttttgtcaccagtttcttaatgacaaaataaggccttatattttgaaacaacataagacttgataattttcaaaattaaaaagctcagaaggtaattcctcattaacaatagatcacactggcctttaatgtatgtaaacaatcttgagtattgtcaataaaggaggaaaggatgataattacaaacagactaagcttcttgcaattgttttctgcctactcaaatagaacataagagagctcagtcccgtgtacccaaggttaggaaaaaaggaaatattactgtgtccatttttaatgtcaccacttttcccttctatggcttaccagatcatcaaaatgatcctctaatgccgtggctaaaagaatagatgtcctaaagcactcttttttttttctattttctcgagctttcgtgatagataagatcgttcagtactgctttgaaacaacgacattttataatataaaattacttttgaatcagaaggtctggccattcttctctcctctttcctgtgctttgaattatttttggaccccagcataattcaaggtaaatagatcctgtgtgaataaagtatgggcagaatgattctttctctgcacatgtagtaaatattaaacattgatcagacagttatgtgcatgagaaaatatcttgagactgtgtatttggtgtttctctttccctctctgtctgacacacacacacacacacacacacacacacgtttagaaagattgatgtgaaacagacctaaattaaaaaggtcaaactaacccccttcaaatcctgtcaaccttcccacctatattcttacttccatgttcctaattgaaattggaaaaaaagtaataggcgaaactacacaatgctggtgttgatttggcagtgagggtcgagataagagagagaaaactaagctctagtgatgcagtggcagattggcgattagtaggcagaccattctggggaatgaatagagcctcatgagtaattatttaacatgaaagatagtgtttacattgctcttccctgcctgtttcacattctggtaatcataatcttgtgaggctcaaatgagataatgaatgtgaaagtgctttttaaagtatcatagattttaaggacattatacatttaggtctaggtaacaacatttcagaagatataggaattttcatctcccaccccccattcagtttctcacggattgctttgaaactgttagccttaagagttccatttttattatgtaactacatagttagaaaaggtaagaatttcactaataaaatattcttgctgcccagtaatcagacaattaacagggttctgttcccccacaaacaagacatcctcctgggcttcctcaagagtttcctcaagaaaaaagttaaaaataaataaagtaaaaatacaaagcagaaaagtaaaatgttggaaacacaaacttactaagccacaccttggaaacacagctagatttttagtttctaagaatttaagagtctaagagatgattatgtgaacaattatgaattaagcccctcctgtgggcaggggcctgattattttcctatttttcttattccatacttaatagggggttgttatatactttgctttttctacacacagtgctggcttatccttggcagtcttaaagaaacttaatatcacagatttttattttttaaatttatttattattattattagagacagagtcttgctctgctgcccagtcctgagttcagtggtgtgatttcggctcactgaaacctccacctcccaggttcaagtgattctctcgcctcagcctcctaagtagctgggctcacaggcacgctctaccatgcctggctaattgttgtatttttagtagagatggggtttcaccatgttggccaggctggtcttgaattcccggactcaagtcatctgcccgtctcggcctcccaaagtgctggaattacaaatgtgagccactgcaccttgcccagtgtgacagatttttaaaagcgaagatgaccttggagataatccagtgagaaaatcacactcaactggaatgtaaactccatgaaataagccatttcatactcacaactctattactaaacctaatagcttgcaataatacataagagatgtaaacagaagaggaaattacatgttaaaaagatagagtcttgcccaggttcacaaaaatagaatctaggtcttcacttctagctcagtgcttttcccatcatgccacactgagcctcctgaaggatatgatgtcttctccaaatcagtataatttaagttctagaataatgttttcttggttactaatgtgtaactcatactaaattcataacttttgaattggattatactgatttatatctgcatattacaaactatacctacttcacttgattttactattgggcattttttgttacaatttgtttacttaaatttggaactgtagagaaaataaacagaattagatgaccaaaataacagaaaggaaattgtttcatctttgaatagacaatagttaattaccaggtcctaaagccacttctaatacccatgaagtttcttagttatcttgccaagaatgaaaaataaatgaaattatgcaaaacattagttggtaggttaaattctgtggcaattaaaagcaatttattaagtgagtaatgtataccatagagaaggaaaaacttagcctctacacttctagggtgtttttccggcggagcctgataattaaattgacataagacagaacaacagaagaaaagcatacaagtgtatttaatacaaactacataacacaggagacttaagaaaatgaagacccaaagacatcattagagctgaacacctatatgctgaattggacaaaaagtaataagctgtgaaaatgtgacaaggcaaaacttctagggctatgggacttgtttgggtggagatgtgggcaggaaataagggttagtctgacatagtgtgtttgtacagatttttcttggtctcaccttctcatccttgatggtaagaatgaaactttccttctagtataaggaagatatctttcacatggggatttcatctcttgtttctaagaaacagaatgaagtttggatgatcttcttgtatctgcttttcttcaagtgtctttaactcagaatagtcaatattccagaatggcatattttagggtggcatattcttaactccttcaatacaaaaaggcttgtgtagagactttatttaaagcaacatttaatgttaatttttttaaaattatatgtccctttatcctatttgtttcaaaattttgctacttcaaacctaacactttccacagaaaaagcctgtcattgccttctagggataaaatactgccatgcagaacatggtgcacatattagacatttaagtaatttagatgctggaagggaatgtaacatattatacttgttaacattgttgacagcaacatggaaagctcattttgtctgattaccagccttatgcttcatccggaatcttatttcaatatttaatacatttcagcatcttcctttcttatatcaaagttaaatatattgtacccaaattttatcctcttccatattccattcccttagtggaaattgaggacagttggtcattttattctgggtaagattactatttacacttatatagcattgttaaatcacctccttgatctttgccaggcttaataattattataattaacatcttttgagttcctactaggtattatgtacttttacttgctgtattttatatgtttcccacaactctttgaaatagatgttacctctattttaaagatgaaacaattgatgcttcaagagaacgacttatcctagatcaactagtggcagagcaagttttagcaatgagtaacactgcaagaaacaaaaggataaagaagactcaagttacaatttgcagttgggttttttaacctctagctccaaagagatgaaataatgttcctctttcaataatgttttctctggtttgtcttttgtctctcagattaatgtgaaaaacactcttttgcaaaatgtcaggtattctggtaatctaatctctagattaccaaatcttggtagtcagtcctcttctttctacgatgtgaacttatgctgaaaaagactaaccttagtgtttttgtaatgtgttaggaaatatattagagttttctattgtcaaaacgtgttcctctctgcctgtgtgctttctaataactacgttcccctttccataaacatgagccttcagatacacagttgtatggccagcagtgtcacagaagaagaaacaaataaaatgcattcaataaaaatgagataaggaacacatggattccttattttaatttccaggaggatatttttcatcttgagtagctgaacaattttaaactaagacttatttttaaataagttttgccacctataaaattcaattatttaaaatgtatacatgccattaagatataattaccttgcattcagagaaaaggatttaaacattaggaaatttctttaacaggctgacaattttcttttttaataaatggaacaagaaaggaatacccagaaccacaaagaaacatatttaaagcattaatggaagaaagataaatgcatatctttaaaatgctacaattgagattaaattggtgattaaaatttgccatcttctgacaacaataactttttatatatattttaaaatgagtaatactattttcattagaaactgaatcttctaaaactggactacttattatctataattggtgggcggcaacacattaaaattcaaatttctacatatttccatatgtaaatgtgctttttatattttttaatatgctgctctttttaggatttcaaagttcagaaaaataagattgccttggaaatacaatttatttttctttctctttaaaagtctatttcatgagctttctgctgtttaagttttacagtagggctcctgacattcttcatagaaataaatcttatttcttttgtttacccaggaaaagagaaagaaatctgtagttcatttagagataaggtctgtctcctgctcaccctccgcctttccttccctccatccctaataccttttcttggtgattctgaaactctataaaatactggtatataataggcttcatcttacatttctctttaggcttttcttttaagaggtggaacagtgtaatgcatataactacttgaaaaggagcaatttgcctttgttcacttcattcgaagatatctatcaatttaacattattcaactgtatctagaagattccctttctgccaaattggaaaataggtacccatattgataataccaggcaagcatatcttactgatcagataccaaaatatgaggttgtaactatgatcgtaatatgatcagaccaaccatgatggagatgacaactctgtgtcactcttggaagcctaatgaaacacttaagctttggaaacgtagactgtttttaactatttttaatccatcagtggttgttacatacccaaaagataaatgattgctctttgaggttctttacaacactcgttgaaaaataaatgatgaatataatagattgaggatagacataacttatcctgaaactgctattcatttatagcattatatcatctagtcatacaaaacaaacacattcatacacagatgtacctgaatgccatattgagacttttaaatcttttttttttccttgcattctctatccctagtaaatgtaagctgaagtttcatcctggtatcgggggagagggataaagggactcatcatccataaaacttaggtattggtaaagaagaacaagctggccaggcacagtggctcacacctgtaatcccagcattttgggaggccaaggcgggcggatcacttgagcttaggagtttgagaccagcctggtcaacatggtgaaaccctgtctctactaaaaacataaaaattagccaggtgtggtggcctgtgatcccagctactcaggacctcagctccttgggaggctgaggcacaagaatcgcttgaaccctggaggcagaggttgctgtgagtcaagatggtgccactgcactccagccatgtgacagagtgagattccatctcaaaaaagcaaaaacgaaacaaaacaaaaaaagaagaatcatttaggaatttcagacaatgcgacctagtaaaagaatgactctctgttcaaaatgcttgacttctgagaattatcttttttacacttaaaaatttgttttgagaaatatcttttgaaataaaaatattctctgtacaagttcatacaattgctaaggcacatatctttccctgaaaaaaaatgacccttgccagcagtgaaagtatatttaattaatataaattcataaattctattttaataacataagcgaagagctttatattgagagccctttgagataaactgtatcaatagatttcacaagctactcagttgttattatgtattaatttagtatttttatattttttcatcagttttatcttagaactttcctgaagtgtcctattatgttttctatcatgtttgtttgcttgtcacattttctaaaatggttagctgaccgagactaaagaattcaatagaaattattaactaatctcaagtaaagatattgctcttagaacttttggccaagagttaaacatagctggaaaaaagtctaaagcttatacttattttaaaagaggcattgcctattctgaaattaaatgttcttcataaagtaaaagtatgctttggaatgtgctttattttcttcttagaagccaggtatgtaataataaaaaatacctctcttatttcacagccttaaattttttaggttacttttatttagtagttaccctggttctcttgactatttcttgaaagggggagatatttttctaaggaaaaataggcagataatttctacttttatgagactctttacaaacactctaagaataagtgcaaaagcttttttggcatataaagtattgcagcttttttgcaaaaataccaaatctaagaaaatgagaatggtagtgggaggattgtatttctcctcattatagtacattaaaaataggtctttacaggaaaaggactaaaacaagatacttaaaaaataaccatgatataaatggtttactattttaaaagtttaatttataatagctgtttttatcaaaaatctctgccatgaaaagcctttttcttgaagtctagacaggtaagaagtttatataaatacatcaatagatcaaaaggctaaaatctttcaattaataatgagatgtagtttgatgcactgaaagggaaacaagagcagtaatacaatttgtatactgcagtcatgacattttagtgaccttcaaatttgatggatatttgttttctaaaggttatcatcatgtttaaaaatattttattaatttataacatttataccataaacaccattaatttatatcattaataaattccactataatgtattagtgaaccagttagcagctgtaagattgagtaatatttagacttttattaatagtttctaaatgtcccagactaattaaatcttctcattccacaagaacaatgcttaattatcttgactacacagcttataagcaagatattaatagaatattcttgtttcacaccttcagtggtatggagactgtcagtaaaactatctcttttcattgctaacacttcattggaccgattagatgacttctgaattcattagtgaagtgctaacttcctactggaactggaactggcatagtgtgttttattactgtgtatgtttacatgtgctgatacacctttcagaaagttgaatctttgactaacatataaacctgaaattagacagtaacccgccaccagagggattgtcaatctctggattgcctaagtgtcagatgtctgccaggtgccatacgtttatctaaagcaggttatagcagtggattatcatagagtcatagcagtggattatcataaagtcatagcactttagaacaaaaaagagtctaatccaattgttctattttgcagaggcaaaaaatgaggattggattaactatttctacctagccagtactttatccgtgttaaaaatgttattactcaaattagctgatgtgcacaggtagtggtagtgattttgctacctgatattataatagaaaatgattatatttaatttcccctttttcagtgaagctttcatcattagggaaattggcctgatcatcttatgatcataattacaacctcatactctgaagggcagttgatatagaacaaatccttttcaaagcaacaatataaattgagatcatttgggtaactttcatgacagctcttccctattagcattcaccactttcaatattttattgttcccagacatgattaaaatgaatcttttataaaaataactttgttatctaaaactttttaccagattataatatgaaaattcttcagctgaaggaataatttttagctaccccacttcatggcatgttccagaaataattccccactgggtcaacatcccccagagctcttcttcacagacaaatagagacacaaagaatgtatgcaatttgatgttactgagcacatacacattttggaactattattccccctatcagatagtactattactcttgcttttagtggtaactttgacaatttattgctagaattattcatctttagtgaggctgaaggtccaatgttagaatgttttagagacttatttctgagagggccttaggtctatcaaggtgggcaaggttgttatttttaatcaaaataaaatgttatgaatcatttaaaaatgtaaactctttaaacagtctacaattttaaatcttttgtttaatttagaaagtaggcaaggctagaaaggaaaggaaattttacccatattacttccacacagtatatttatatattttatttaaaaaatttttttaaataacatttaaaaacaggttacaaaatacttatggcacacatcaatggatataactgtaaaatacattatataacttttatgcaattttattttacatatcctcaccttaaataaaaatagcaaaattttataacgtttcagataagaacaaaataaattaaataatacaaagactcatgaatttcaatttgtttctattttgaaagaagagtgagaaaatttttaaattattttaatattcaatgtagcttctttagccagtgctttccttaggttaaataaaatttgtgtgtaaagtcaatgatgggaacatcattttgaaaattacagtaatagttgagttcatgacactgacttaattacactgacgtttagaagagattttataaatttaaaagattattcctgtcatttaccccagctatattttcttccaataaggctttaaaacttgctttggaaaatgctatgcagaacagttacttagcatgtgtagcaagatacgaagtgggaaatacagatgaaaaacaagtttacactgtttagaaaacaatttggtctagtgctggttatatttgcactttcacaatacatcctgtgcattatgcattacttaaaaatgtattcgtgttttacacattttatgtactttcattgatttgagaatttgaaagtctttcaacatcatctcaaggtatcctgtactccatcgtttactggtacattgcttaaaatttcacgtgtgtcatatctagtctttaaaaatatttgtaattcttttatcaaagaacggataaatgcctaaaatttgtttttattttattatgaattttgtattgttattaagattaattaagattatattgcaataaaaattaacagttgacttgtttgtctaattttgagaccagcttaatatgatctataaagtttacaagtataatttctgaataatgtaagttttaaaaatattactgttttttaatcaaataaataatgagataggtaattcatagataaatgtaaagtgcagttgagactcttaaccaacggtctcttaatacacaatttattttgtctgccttcttttataaatatcagctccattcttgggcaacttttaatgtctcaagcgttttccttttctactatgctcctgatcttcattaaagttttctgtagaatggttataaatattaaaacggtcataaatgttgaaactttccttaagtaggtaatatttgttatccaacgtctcagaggaatttccatttgcttcataaagcatggcacttttttaaagacaaaaaacaaacctggaattgacattcacggccgagcacggtggctcatgcctataatcctagcactttgggaggctgaggcaggttgatcacctgaggtcaggagtttgagaccagtctggccaacatggtgaaaccctgtctctactaaaaatacaaaaattagccgagtgtggtggcacctgcctgtaatcccagctactagcgaggctgaggcaatagaatcgcttgaacccgggaggcaggggttgcagtgagccgagatcatgccactgcactccagcctgggtgacagaatgagactccatctcaaaaaaaaaaaaaagaaaagaaaagaaaagaaattcacatgcatctgggaacaagtgctactccaatgctgtagcaattgtcctacagcgcacaccactatgtagaaaaatgaatttttattaatgataaacatacataagcaaccatgacataatttaaaaatcgtcttataatttgtcaggtttaataagtagttcacttggttcagctgaattatacatgtagtacttttgctacctgggattagaaaactattttatcattcatttcttaatggttgataaggtgaattctaattttaacagatttttattcctagtcatagaaatgtagatgcgaattgagtctgtacatctgcttacattttctttctataagctagtaagtaaataggcgttttgtttaacaaatcagactgaacagagttagtacaatttggctggccagggcctagcattaaagagaaaactgagaaaatttgcatagctgtggtgttccagaccaccatttcttttattattattatttcaacattttctgggtacaggtggtttttagttacatagataagttctttactggtgatttctgagattttgatgcacccatcacccaagcagtgtatgttgcactcaatgtgtagacttttattcctcgtgcccctgtaacccttcccctcgagtccccagagtccattatatcatccttatgacttttgcatcctcataccttagctctcacttataagtgagaacatacaatgtttggttttccattcctgagttacttcacttagaataatggtctccaacttcatctaggttgctgtgaatgccattatttcattcctttttatggctgagtagtattccatggtatgtatgcgtatatatatatatatatatatatatatatatcacattttctttatccactcattgcttgatgggcatttaggctgcttccatatttttgcaattgcaaattgtgctgctataaacatgtgtgtgcaagtgtcttattcatataatgacttattttcctctgcatagatacccagtagtggaattgctggatcaaatagtagttctactttcagttctttaaggaatctccgtactgttttccatagtggtcgtactagtttacacttccactgacagtgtaaaagtgttcccttttcaccacatccacaccaacatctattttttttttatgttttaactctgaccattcttacaagagtaagatggtatcgcattgtggttttgatttgcatttccctgataattggtgatgttaagcattttttttcatatgccagacaaccatttctgtgtgacttcaaagacagcatcacttcctccaaatgaaagtgagtataggatttgtagtagtgaaatgactcattataaccaatcaatgtaaagatggtaaactataaactaacatttattataattttaatacaacatttaatgttcctaagtcagtaacttaatagttaaagtagaactataatatggtagattaaatttggtttgtgatgcagtactttttaaagtgaaattaagtttgcagttattgctgggatcattggctgtcatttgtgagataattcataactcatttttttgaactcattatttataaaaggtatcaatttgacagctctggagacacacttcattttttcaattcaaataataggaacagcaatgctgaaactttcagcagcatctccaactaaagcatctgtcacgtctatcactaatttgaaaagtctgtttcctgagtgaggaattattttggtcaacacatctgagcagcaccccagaaagtcagcctttatcctcagagcaataacgatgatagtgacagttcttgacttttgggagatgcagatgtatatctggttaagaacttccagcttgcaacccagccatttcctcctctccaagtagggggcaagaattaaatatgctaacatgcagaagttcttcctagcacagtacctttcatttaatatgtgatagttttccttttattgtttcttttcttctccagaatacttttgaaaagaaactaaaactaacactacattattttgatatttgactgtttttcatctgcctctatacccttcaagatgtttctttttcagtatcattttcttctctcatttttcattcaactctaacaataaaattgtacatagaaaatagaatacaatgaagaaattttaactgaaagcctgcattttaggaagtagctcacaaaaaaatagatgaaccataaaggatttctttataccataatgagcaaattagtaactaaatagaaaatcattgattctgggataatagggcaggtgctctcctttatattagttgagtatcagcttgagatgaatgttataaaaatagaactcaatacggattaaaaacaataagcatgcaatgttttgcttgattcatttaaagacaatactagaaaaaatttgagactgatttaatacatttatcgtgtcatggaaaacatatgacttataccctaggttgattccttttttgacactgcatcgcatcctatttatggatgagaaagagttgggtcattaaacatatattccttccatggatatcaatacttttactttagcatcacaatcatattgattataataattatcttaatttttatcattctcaatccttataaaaatcctcaactcttactaattccattttatagaagaagcaattgaaggtaaaaatgattgagtgtcttgtagaacaaagtcatacagtgagaaagacaggacttttctttaaaatgaatactagattacttgcttctttggttcccttgagaatttttcttagtagtgaaatactaattatacagaagtcaatggcaaacaagtgtttgtgagctagaaatgggcatatacaggactagggtaaaatgaaaatcacattatcaactgcccgatgctaagtgttagaggttacagaacaatattagtgatgaagcccacttatcatagaagtcaagcttattttgctctgttacagactaatgagagatgcaatttagaaaggatttctgtatgaaaccaaagtttacctgtttatcatataacacttgcttttttgttgactctctatctttgacaaagcaagtttttaaacaattatttgaattttctttttgattatattctctaccatacatgctatcttaattctgtgtatattctctacaatgtcttaactactcaatagtttcttcattcaatagatatttactgaactcctactttttgccaggtcctgtcttagggaatttactgacaaatatctacgctgatagttagagacatagttcggattcacttgatcaattatatttggtgtctttgaatgtttaatacaaattacaagtatatttatacaaatgaatagatttcttcataaaatgtgttcatcccagatggccactgcttcttagaaaaaaaataacgtctatatatcttcttgatacaattactactagcttggaatttttgaaaccttaggagagaaaataccacagccaaactattttcaggctttattttcctgctaagggaagattctgaatctttcctaaaaaataaatattacatttctcctaaatttttatcttcattttcatagagaaagtattcctctcaggagaagtgactatcaatttttctcttcagaagaatttttatacttcagaagtatttagtttgactattagacaatcccagaaaaagcattttgctcatctctaaaatgtgatgtttcaggttatatgttttacttcaagaagaatataattttaatagtcaccagatatcattactgaacattatcactttccagccaaaaagaaagtaaagcatttcagaaatacttattcctgcccactcatttcataataagacttcaagtaatttattgcctaatataagacaattagtgagttctacagtcaacgacatggacaatgccagttcttgtgaacatttccaagaggatatttatgcttaactttttcttttttaaaaaataaatagctttatgtaattaagtagctttaccttataacatataattagaagatttaagtattcattgtaagatcttttttatgtatacatttattaactagaggcatgtgacttcagcatcatgaaccaagtcagtatctgaatatatatattctttacatttttttttgccactacttttgagatctattactgtatggggtgatttgaatatactataaacttttggtaaaacttttctctcatgttaaaataactttttaagtgctcagcaatataggtattataagaataagtattgtgactaaagaagataatcagcagaaatgctgcctacaagataaatttgaaaaaatgaattaacataccaaacgttagcccatttccatctcaaaatacacagcttgctttttttctttgaaagccaatggctcacagaaagtttattcaacaagtatttcttgagtgcctactatgtacaaagcactgtatgaggactttggagcataaaagcagtataatacaaggaagagtatgaaaagaagcttgggaatgaaaccacgtgaaacagctgaaaggagttcagagataggagagatgacttctttctgtcaaggatagcatagtagatagcaaccagtttttttatgttattacagataaataatacaatattccctcaagtaactgtttaatatcaagcatataaatatttcaatatatatgtcaaacaaaaacagcatgtttcagttttttatgtttgttaggtaagatagagcaataaaggaagggatagagaaaggaaaatgcaaagaatggacagaggaaagagatacggaagaaggataagggaagtatggagagaaaagaagtgtctccatattactccatatcaaggattataaaatagcttcagatgaccagtataagagctctgtgtagaacatcccaggacttcctgtcttttaaaagataataggaagtagattacaaagatctatgtgaaacttacataattggatatagacacctcagtaaagagttatgataaataaaaagagattaagtcatggacaaggtatagctagaccagggtttctcatccttggcactattgacattttgggccaaatgtttctttgttgtggagggttgtcctgtgcactgcaggttgttttgcagcatttctgacattcacccactagatgccagtagccacagttttccaattatgaacggcattaatgactccagacatcttcaaatatctcctcagggataaaatcacccctggttgagaaccactgacctagagcataaatatttcagttgtagtgaaggagaagtttagaaaagaaagtacagtcacccgacacaaatgatagccacaaaatgaacgtcatgggaagaacagggattatgatctaatgtggagatacgtagaaaaataaatggaacaatgagaagagagaaaacataatggaagcacattgttcttttgggtagtttgcaatgccttatgtctgaagtctctctacctatgaaaaaatagacaaataatggcatgaccaaacaaaactctagaaaaagtatcatttagtgtcaaacatgatagtaattatcaaactttactatgtttttcctgacagttttaaggtataaacaattaatatctttggaactgcctcagattttagaattgccccacttagcttttccctgggaaaataatattgctcatctaaaggaaaaaagtaagataattaatgaaactgtttattttccttcactcttgaaagcatgaggaagaataaattttattccataaattttttcatggcttccatttattagtaattttcacatggtgaaattcaggtattttacatagaatttcttttttattttgttattacaattaatatttcgaacacccaaaatacattccatctacttgtgcgttatgaaaccatggattatatgtattccaaactctgttcattctattcctcaactaaatatatatatatacacacacatatttagacagagtctcattctttttgcccgggctggagtgcagaggtacaatctcggcttactgcaacctccgcctccaggttcaaacgattctcctgcctcagcctcctgagtagagtagctgggattacaggctcccgccaccatgatgggctaatttttgtatttttagtagagatggggcttcgtcatgttggccaggctggtctcgagctcctgacctcaggtgatctggcccacctcagcctcccaaagtgctgggattacaggcgtgagccaccatgcctgggcacaacaatctatttcaaacctcactagtagcacaatgtcctctgtatttctaaccaataatctaaaaatcactgctatattttgatattggagggttgcaaagaagtagaaaagctttattttttattttaatattttcagctattttcacagtttaccattgaaactttaaaatcaaggggcaagagttattgacaatttgcctccctttaggctttctcatgacaagcaagattataatttctggccttttaaaaataagaatgtggtgactacagactcatccccttagggaaatttgtcacgcaaaccgattacctaacttattaaggcttgtagaaatttggtatgcttttaagaacaataagtattatttgatgaagaaattttaaatagatatgattctttcattttgttagagaccctaaaatgaacctcgaaacagaagatatcccaatgattgtatgatatgggaacaaaaacatagcgttgggttttcttgttttgtttttgatactatagattcagactttttagctaagactaggattggaaggtttaaaatatgtttggttgtgcatgagtagagacaagaaacaacaaataggaagaatgctctttggctttcttaagctaaatatctgcttttactaaataatcgaccctctgttataaggctctgtttcaaatttatcttcaatgtcatcatgattgtcttcctttatccttacaagttcattttaataaacacaaaaaaattatttaaacatattgtattatataattcctagcaccatgatatttattcactgaaatcttttgaagagccatgaattttttaatagcagaattttataaacaataatttaaatattttcccattcagtagtaaacactagctgggaaccaccaacactgtgcaaatagtagctacagtgagcaaataattcctatgaggttttgtgagcttttcactcagttaattgaacaatacagttatatgctcaccctgaccctccaaactcagtaggagagttattatggggtcatttatcctgcacattgcaaatatgaaatgctatataaatgcacaattataataatgatgatgagttgcagtgaggcttaatgtcattgtccctatttaagtataatttaagattggatttagcaagatttctttttcattaacaacaggaatcacataatcacactaggaaacaaatgaatgtcactaatgagacagttttgttcaagtagcatgctttcaatatattagtcaattcctcaaagtcctataaatgagcatgctttatatattattgaacagcattatataggcatcggtacttttctctgacttcaagcaagaccatacattaagcataccaggaaaaaatgaacttatatctatcctccaaaggctgcagtaaagtttgattcactggtatcttttattaactacaacagtcacgtcacccttcatctttggcaatatagtgacttttaggctatgcctatatctgttttaccttcttccttccacctctacttgcaaacaaaatctgtatataatcaatagcatgtactgagatgatgcttcaaatttaccgagaaacgaaaaagaatatgtggaagaacaaagggaagtcttatatgtgctacttaaaatcacgaaattaagtgtagcagttacgtgtaatatttgagtgtagaaaataagattagaaactctagaaacaatgtttttcttcagtcaaaaaactccacaaagatggacagtaatagaagtaggagcaaagctgaattaaagtacacagataacaggttttttttttcttttttcatttatcgagttgaaagtcgttttattttcattgtttgctggactctattaaggatttacagggcaacaggagggaaaagaatttgataatctttgatcaaactatacgatgttaatgatacttattgctcatctttcttctatttttttctattattaattctctgtgggcctagcatttacctctttatcgcataaatcttaaagcaaagaaaataatgctcatagtagttgcttattaatggatttctgtgaggttacactgcagggaaaggatttaaaaacataataatcctgccagtcctttgaacagtttagagcacaggagatacttaaagttttatagcattctcctgggaagccatcagctctttgccttttctcgaatttaagattttaattgcctcagtgtttcaataacaattacagcctattcagaaatttcctttccatgatctgacagctctgggttttaatttctgagaagctttccttaagtaggtaatatttgttagccaaagtctcagaggaatttcaatctgtacattatggaataaatttcccatttatctgcttttgatccatcagtgttttgattgattgtgtatattatgcaagcagagctttccaatgtttcctttttctcttgtgccaccaatctagcaatgcattgatttgatcacttgacttattagttcatattaatccaaacaaagtatcttccgcttttttggcataaatttaattcaatttctattcagacttgttcaaatccaataaagtttttctattaagatggattgtggtgaagtgcaacttctgattctttcccaaacttctttgtccttcagaacataactttagaaaattctaagcctgaatcttccgtatttatttaggagaatatgagaaaaaaataaataaaatgtagacatttcctcaaatccattctctttgatagggaagaaacagttttacctaacaaaaaggccaggctttcacctgctacatcctgcaattcttctgttcttcacccctgttctctacgaatcatttggctgagactgtactttttgcttaagctatcatcctcattacttcttcttgtacctcttacattaactgtattgactaacagtattagttttctactgctgtgtaacaaattgccaaaaaaacctagtagcttaaaacaatacccatttgttagctcactgttctgtaagtcagaagtccagggacctcatctgggttctctgtttaatgtctcacaaggatgaagtctaggtgccagctgggcccagctcttatctagaggctctggaaaaaatctgctttcatgctaattcaagtcaatagcggactcagttctttagggttgtaggactgaggtccctgcttccttgctggctatcagccaggggccatgctctgctcctacaggcaacccacatttcttctaacgaggccctttccatggtcaaagccagcgactgcatgtagaagctttttcatgcttcacttggacacccctttcacttataagccagagaacattatctgcttttaaaatgttaataggatgagaataactccacttggataagtctttttgccaccatataagccaacatgctcacaggagtgatatctcatatttacaggtaagagaacttgggttagcatggtagaaaaagttccgttatcatggaaagacttccagtacccttcaatttttttgactgctatccatagcattgaaatgcgttgttctgtgcaatccagaacacaggcacaaacacacacacacacacacacacacacacacacacagagagaaatgtttcaccaaagagtacttatttttactttgtgcaataaatgttattttcaaatgtcttgtatttcattaaaggaaaatattaatttaacttaaaaaatttatgaccaaacctactaatgcattttgttttgttttaaccagattggaaaaggcagtcacttttgtttcactttttggaaacccatttgtaattttgatgttctacaaaactgaactatcaaaattgggattaagataacatctgaagtgagttatatgttctttttaatactaattcatcccattctccttttcacattagtgtctttgtcatgtgcacttaaatttagtttcaatgcgaaaaaagaggcttaggaattccattggtactcacatagctttttccatccaggtaggagcattttattctgtgtaaaacccaccacaatgttcaccagtataaatgatcactaatagtagttattgtgatagtcactcgacggcagctttaaaatctgtgttgcctgaaattaaaagtggccacagaggggagtctctatatatagtattagaattctgccccagtcacaattcttgtgattgttcaacaataaaacaaatattaatgtggtatagtttgtttaatgtcctccaattttcttttagaaatatttttatagatattttgctttaagctatgactttttaatatactcatcacacaactatagctttgcatctaccaaacttgagactgaaacacagctcttttttccaataacgctgtagcctaatgaaaaattggcacagcatgaatctttcaggttccagttaattgttaacttcttgaagaaaccacatttgaccaaccaatcaaaattaaactttccatagcttcctgccccttcccttcttagcactgatcataacctccaacaatatggaattggtgtaattatttctataaggcctttatgcttcatacaaaaaggattgtgtcaattttgcctaataccatgtcaccagcacctagcacaatgcctgacacacggaaggccctcagttaaggtttattcaataaattaatgatgaatatcagcatgaattattttctttattcctcattaagtgtattttgttagagaccttgctaacctgtaggttcatgtgagcttttcctcagagagtgctatggctaatgggcattcatgttactgccacttcaatggaaagcaaccacacatagttatactttgaaagtctacctccacaacttcacaatgataatgttgattttgaaaaacctttccatagctataatttttatggaagaggagaagaaatatcaagctgctaggcaatgtgttctttcttgcatctgtatttcttatgatcatatgattttatatgactgccagtttactcattaacatcaaaagttgctaccacagatattagcctattgcatttcttttgattaagttataaattttttggcaagggtagcattagtgtatagatttgaaagaaaatatgagcgtaataaatagatctcttcatttcattctagcagtttgtattggcaggtgattttgtactcattcatgttctttttcttctgtaataacataattagtgtaatgaagcattgagttatcccttaaagtagaatatgaatgatgcctaactgtaaatagggctcacataccactcaaaatcattatgaatagatgtgaaggcacataattccacctatcttaataaaaatattaatttaacttacaaaatgtatgacctccattaaaaaatcattatatcatgttctaaagtttgatggagataatgcaccttccctaattcactggctcttcattttattattgttattttattgaataataactaccctgcagaaagagaagcctcaaggatgttttgctgatgggatctgaatcaatataacggctttaaatgaattggacatgctcattttacccacatctacttccctgatttttctgaacttaaaagtaaaaatgacccaggtatttgattattttatgttcatttcaagacttaagaatgaaaaaaggtctggcaaccaagatggccaaataggaacagctccagtctacagctcccagcctgagcaatgcagaagacaggtgatttcctcatttccatctgaggtatcaggttaatctcactagggagtgccagacaatgggcgcaggacagtgggtgcagcgcactgtgcgcgagccgaagcacggcgaggcattgcctcactcgggaagcccaaggggtcagggagttccttttcctagtcaaagaaaggggtgacagacggcacctggaaaatcgggtcactcccaccccaatactgcgcttttccgacgggcttaaaaaacagcgcaccaggagattatatcccacacctggctcggagggtcctacgcccacggagtcttgctgattgctagcacagcagtctgagataaaactgcaaggtggcagcgaggctgggggaggggcgaccgccattgcccaggcttgcttaggtaaacaaagcagccgggaagctcgagctgggtggaacccaccacagctcaaggaggcctgcctgactctgtaggctccacccctgggggcagggcacagacaaacaaaaagacagcagtaacctctgcagacttaaatgtcactgtctgacagttttggagagagcagtggttctcccagcacgcagctggagatctgagaacgggcagactgcctcctcaagtgggtccctgacacctgacccccgaacagcctaactgggaggcacccccaagtaggggcagactgacacctcacatggccgggtactcctctgagacaaaacttccagaggaacaatcagatagcagcattcacggttcacgaaaacctgctgttctgcagccactgctgctgataaccaggcaaacagggtctggagtggacctccagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatgggaaaaaacagagcagaaaaactggaaactctaaaaagcagagcacctctcctcatccaaaggaacgcagttcctcaccagcaacggaacaaagctggacggagaatgaccttgacgagttgagagaagaaggcttcagacgatcaaactactccgagctacaggaggaaattcaaaccaaagcaaagaagttaaaaactttgaaaaaaatttagacgaatgtataactagaataaccaatacagagaagtccttaaaggagctgatggagctgaaagccaaggctcaagaactacgtgaagaatgcagaagcctcaggagccgatgcaatcaactggaagaaagggtatcagtgatggaagatgaaatgaatgaaatgaagtgagaagggaagtttagagaaaaaagaataaagagaaacaaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaaaagcaactccaagacacataattgtcagattcaccaaagttgaaatgaaggaaaaaatgttaagggcagccagagagaaaggtcgggttacccacaaagggaagcccatcggactaacagctgatctcttggcagaaactctacaagccagaagagagtgggggccaatattcaacattcttaaagaaaagaattttcaacccagaatttcctatccagccaaactaagcttcataagtgaaggagaaataaaatcttttacagacaagcaaatgctgagagattttgtcaccaccaggcctgccctaaaagagctcctggaggaagcactaaacatggaaaggaacaaccggtaccagccgctgcaaaatcatgccaaattctaaagaccatcgaggctaggaagaaactgcatcaactaatgagcaaaataaccagctaacatcataatgatgggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaagggacggaggaagatctaccaagcaaatggaaaaccaaagaggcaggggttgcaatcctagtctctgataaaacagactttaaaccaacaaagatcaaaagagacaaagaaggccattacttaatggtaaagggatcaattcaacaagaagagctaactatcctaaatatctatgcacccaatacaggagcacccggattcataaagcaagtcctgagtgacctacaaagagacttagactcccacacaataataatgggagactttaacaccccactgtcaacattagacagatcaacaagacagaaagttaacaaggatacccaggaattgaactcagctctgcaccaagaggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaaccagaactcaggattaagaaactcactcaaaaccactcaactacatggaaactgaacaacctgctcctgaatgactactgggtacataaggaaatgaaggcagaaataaagatgttctttgaaaccaatgagagcaaagacacaacataccagaatctctgggacgctttcaaagcagtgagtagaaggaaatttatagcactaaatgcccacaagagaaagcaggaaagatccaaacttgacaccctaacatcacaattaaaagaactagaaaagcaagagcaaacacattcaaaagctagcagaaggcaagaaataacttaaatcagagcagaactgaaggaaatagagacacaaaaaacccttcaaaaaattattgaatccgggagctggttttttgaaaggatcaacaaaattgatagaccactagcaagactaataaagaagaaaagagaagaatcaaatagacacaataaaaaatgataaaggggatatcaccactgatcccacagaaatacaaactaccatcagagaatactacaaacacctctatgcaaataaactagaaaatctagaagaaatggataaattcctcgacacatacaccctcccaagaataaaccaggaagaacttgaatctctgaatagaccaataacagcctctgaaattgtggcaataatcaatagcttatcaagcaaaaagagtccaggaccagatggattcacagctgaattctactggaggtacaaggaggaactggtaccattccttctgaaactattccaatcaatagaaaaagagggaatcctcccaaactcatttgatgacgccagcatcatcctgataccaaagctgggcagagacacaaccaaaaaagagaattttagaccgatatccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaatggaaccaaagtcaaaaaccacatgattatctcaatagatgcagaaaaggcctttgacaaaattcaacaaccttcatgctaaaaactctcaataaattagtactgatgggatgtatctcaaaatagtaagagctatctatgacaaacccacagccaatatcatactgaatgggcaaaaactggaagcattccctttgaaaactggcacaagacagggatgccctctctctccactcctattcaacatagtgttggaagtgctggccaggcaatcaggcaggagaaggaaataaagggtattcaattaggaaaagaggaagtcaaattgtccctgtttgcagatgacatgattgtatatttagaaaaccccattgtctcagccccaaatctccttaagctgataagcaacttcagcaaagtctcaggatacaaaatcaatgtacaaaaatcacaagcattcttatacaccaataacagacaaacggagagccaaatcatgagtgaactcccattcacaattgcttcaaagagaataaaatacctaggaatccaacttataagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacaatattggaaaaaaatactttaaagttcatatggaaccaaaaaagagcccgcattgccaagtcaatcctaaaccaaaagaacaaagctggaggcatcacactacctgacttcaaactatactacaaggctacagtaaccaaaacaacatggtactggcaccaaaacagagatatagatcaatggaacagaacagagccctcagaaataacgcctcatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaaggttagacctaaaaccataaaaaccctagaagaaaacctaggcattaccattcagcacataggcatgggcaaggacttcatgtctaaaacaccaaaagcaatggcaacaaaagccaaaattgacaaatgggatctaattaaactaaagagcttctgcacagcaaaagaaactaccatcagagtgaacagggaacctacagaatgggagaaaattttcgcaacctactcatctgacaaagggctaatatccagaatctacaatgaactcaaacaaatttacaagaaaaaacaaacaactccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatgacaatcattaaaaagtcaggaaacaacaggtgctggagaggatgtggagaaataggaacacttttacactgttggtgggactgtaaactagttcaaccattgtggaagtcagtgtggcaattcctcagggatctggaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcggtaaactattgcaaggaaaaaaaccaaacaccgcatgttctcactcatagttgggaattgaacaatgagaacacacatggacacaggaaggggaacatcacactctggggactgttgtggggtggggggaggggggagggatagcattagtagatatacctaatgctaaatgacgagttaatgggtgcagcacaccagcatggcacatgtatacatatgtaactaacctgcacattgtacacatgtaccctaaaacttacagtataataataatcaaataaaaataataaaaaagaatgaaaaaaatatggtctataaaaatagatttgcataaatacaatctgcagctggcttcattctctttttataatgggttggatcatagcaccatgttgagctaaaatctattgcttttggtaatccagtcaagaaaaaagtagtaaccaacaattacatataaatgacataattttataaagtgaaaatactacatggtaataatttgataaattacttaagaaaatttaagattgtaaggtttgtccagattttttcctatagtttattaaaaataatgaaccaaaacaaaaaatttcaattactattgcatataaagagcaattataatctgtcaatgactacaagccagccatcttaacatcaactgagaacaaaattctaaaaacaaattattcttataactttaagtaaaaaaattgaagaactaatttaagtgcatactatttgtctgcttagaaaatggtaaaatgataggaacttcttaaaggaatttctattcaaaatatcgttgcagacacttagattaaatcaggctgggcatggtgacacatgcctgtagtcccagctacttgagagaaagaggtgagaggatggcttgagcccaggagatcaagactgcagagagctttgatggtgccatggcactccagcctttctcaaaaataaataaataaataaataaaataaaaacaattttaaaaaccatgtttataaacatgtattacaagttcattatttaaatgagactataaaacctaaagatgtaaacatcactttaaaagccttcctacttttttcttgactgatttgccaaaagctgcagattttagctgaggatggtgctacaattcagcttcttttaaagatgaaggtgactagagagtgtacttatgctgaacctgcaactatttcttcactataagaaataatttctccttttacaggccatttattccatattgcaatttatgacttaagtaagtgacttttttctttccctgttcttgtaaattctcagagtgattgtcagtctttctcatttgaatatcatggaaactctaccatttcagttttagtccagtgcaaatacagtctattcagtccttctgatttcaactttgcctatttactatataatagtaaataggcaaaaaaaactttgcctaaatactatgtaatagtatttcaaggtaatactatttagaaaaatgtattataaccgtttttacttggtttgtctcccactctttaatgaagccaaagtaaaaaatccagttaaaataaatttttgctgagagttgttttgttaaaaacatatattatcagagttgcatattaggaaagtaatcaatgttaactattttcattaccaatcatgtcactctgaacataatctcaaaataatcacataattctattggctaattttataaaattcacttactcatgaaatcaacatacccctttattttatcatttgctaatcatttagatttttaagagcaatttcacatactatcaaatttttggccacatatcagattaaacaaaggcacagaaagattaaataagttacccaaatatcatagctaagaagtgaaagttggacttaattttctgtctttggaacccaaagttctatgctccttcaaatgcagcatacatgtgtcttccattaatgacaattaaagtcaacttattccattactgtatgcattttaacctgaaggtttagagacatagagttggtttcctgactcaaaagttttagcattggcctggtgtggtgggtgatacctgtaaatctcagccctactttgggaggccaagatgggaggcttgcttgaggccaggagttcaagaccagcctaggcaacataacaagactctgtagctaaaaaaaaatttttttaaatcaaccaggaatagtgattcatgcctttagtcctacctactaggtaggctgaggtgggagaattgcttgagcccaagaattcgaggttacagtgagctatgatcatgccactgcactccagcttgggtgacagagggagatactacatttttttttaagttttattattattcagcttcatatttaatggaccaaagactttctctggttacttaactatatggcttagagagaaaaggcattctttggcaaatcttaaatgatagttgaatacattattgcttcaaaaaagtcattgctttcaaaacaactaatacaattaaacagtgatagcaatatcaaaggcagtgctatcttgtgaatcacttaggttgatcatagtaagccacagctaaaagctatctcctattattagggtgcacccataaatgtattcttccaccttttttagattttcctttataaaagtcatttctgttattggatgcagagatactcttaactgctatttctttgttgttaattgtggctttcttttatcattaaaaagcgtctttctttttcactcttatttttttaacttcaaatttattttgtcagatatcaagattgctatttgaaacctccctagtcgattattattctgtccagaattttgtaaattatgtgaaattcacaaactatagtaaaataatgatctaggaatattggttgatgggattatctctgtactacttgtttgaataaaaaattggtatgtttttctacagaacaaaattgccatctttaaatttttcctctagtcatggaagtgttaattgtatttaaaaatcactttgttccactgctattgttgtgagtaaattaaatgatcaagaaagcaactgtgagatttaacagagttttgcataaacaacttatgtttgagagtagtcctgccagcatattcctgccagaatttgtccttgtaacagcagacattacatacccatgcagggcttccagacatctaggaattaatacagattttaggacaacgatttctttgcctttcttccttctgttctcttcttccttccttccttttcttattcctcttctccttcatttgctcctttcttcatgcctgcctttctgcctgagttccttctttgaatatttgcagagccaagtgttcagaaatgcattccaaagtagctttctactgcatttaattttgtagtctatgacatttccttcattttctttcacttaaagagaggcaatgagacaattgtcctaacagttatgcataaactagtgagacactgatcatccgtgactcttcgggctttttgctatcagtaaggctcagaatcaaaggactggaaaagaagcaggagactggcttcttatcttggcactgacaaaaattaacattaggacgttgaataagtcatttatctcttctggatcagattccttaactattaaaacagaaagttagaactttgcacggtggcatgtgcctgtggtcccagctcctcaggaagctgagatgggagaatagcttgagcccaggagttccataccaaccgaggcaacatagtgcaaccccgtctctaaacaacaaaactacacaaagcaacagaaacttggatggtcttcaagtaccctctttcaatactgctcatgagagtatgcttattagacatagagattgacaggtacaatgtttaatgtggaaaaatttatagtttcttataaaaataaaagaaccacaataagagatagtgatgaggagtgaaaaaaatgtagatattggagtgcaacacatctaaaattaaatcttgctctgtaacttattagttctatgtggtaattcaacatctcattttatcttttaatctggcattgcattgttttcatagtaaagattaaatgagaaaaatagagtgtttctcacatcacttggtgtataataataaatcagcaaatggaaacaattattatgtatctgtttttaatagtttttcttgttgagccatttccacaggaatgactcaactgagaggagttttttattcccttttctatttatcttagggcaacagatggtggcttagacagtagtacttcccagggtatatcacaatgacagatttagtgacatgaactttatgaagtcctctgctaatagcttctctactgccagaatgcaaggtatcaggccaaaaggtgtgtgggaggctaatgactacgtttccacaaatattggcatgagctggatacttgattcatgagagcaacttcccaatttttggcaagttacctgtaaagaccatttagaaaaatttctggctttctctgagtagcaagtgttttatgaaacctgtagaatttttcaaacctacctaaagtataggcaatataatatgattggctagattatctatggaggcattatattgccaattcttctatctttggctttcattttcttagttgcttgcctatacagatggttttaatttggaccaaaatattttagtaatttaaaataagactttaaaacttgaggaatctttcatgatacaataacaatgattttgtttcagtgccccaatatcagcagattgtagaaaaattaagtatgaatagagaatagtaatgaatatataatcacaaatatgttaggcagtaaccttaaagattgagatagtttgccaaaagcagctcgcatatctttcattcttttacttatagaacagatgaataaaatcttgaaaacatttagacattatactaatttattttaccataaattcttacttaagaaaaaattgataattaatggagagaacaagaatgtaacctctacatgggcagagctctttgccttattcactcatatatccctagtatatagaacattaccaagcacatacttggcattaaataaatgcattgaataagtgaacaataccttgatgaaaacataaactctttgctaatactgccttcctaaatgtgttttttaaaaatcacttaagcatgctttcagaatctgaatcctgccatttatcagaaaaaatagcttaacctctttgaacttcactatttctttttctgtaatatgcatttctgttaacatgaggtaaaactaacttttatcactgtgcctggaacaaagtaggtggacattaactgtttgtggattttgtttcataaacacaatacctgcatttaagaaaatagggtcctataactttaacctagaaattgttatttataaaagaagatttgtatcaattctttatatcaataaaagaagcatatcaattgttattaacaaaagaaaataatggctctttgtgacagtttttaaaatgtagcaatagaagaagcaacgctgcctatgatttactacttaagaacaaatgttcatgatgatgcatataatctatttttcttaagcaaatgcataatttagtcagcatcatatgcagttttgaaaagtaaagcattattatttagatgtcatttctgtgatctcatgaaatatagaatccctggaatgagagaaaagaataaaatattctctttaacatatttcactgcataatataaaaggtctgtaaaattacctgaaaggcaaaggtgtcacaccatacctcagtggtgatttgcaccaaatacactgtctttcataaatttcctgagcaaacagagatttccaatgagaaatgaatactttaatcaatgcaacttttcaacctatttagtccctgatcttgaaaaattatacccagtcatgaaggatggaactaattttgaatttacagagaaactcataacaaatttaaataccataatatgcgtattatatctgcagctgtcagaaaactttatttacagtcagttgcctttctctgaataatcatattgttgtcctgaaagatatttaagacctttgccaaattagaggtatggcctatatttagtgaatcatcatcattgcacctccccagggagagcttagatgagagagctcatgttgtcgtcagctgttgttaagtggaagggatggtactgatccaaagactttaataaattgttattggaaatgtggtttacccaaagaccattgttctcaaaatgtattatcataacatccactggagagaaagtcatcaaagacgaaagatgtctgtaccattttatatgatcaagaaagactaattttttgctatggaaaagacatcatcattattttaggagataattagaataatgtttttgtttgtttgtttttaaaaactggactggtgatgtataaaatgctaaaaataaaaactggattgagtataaaataatgaagtcttctatctttgacaaaactttatatttttcatgctatgtaatctaaaagcatatctcatttgtagttataaattattttaaaaacctttcaaacataaacagtcatagagacaacagtacagtgatcctccataacaccatcatccagattcaataattattaaaattttgcaaccaatctatccctttctctttcccattctcttcgttgaattatttaaaatcatttcacattgcttcagtatctatttctaaaattgtggctatattactgcaaaaccatgatgcaattaccaccccccaaaattttaggaataattccttaatttaataccccagtccatattcaaattttatttatagtctcagaaacatctcatttttttctttttaaaatgtactttaagactggataaaactgtagaacaacatgttgatattttagcaaaattgctacaattggtctatattatagaacaagtctgtgtgatagaaactgtctccacggcactcaagtgagtggaatgatcgtgactgaattctatatatagaatctttcagtgagaagtaaaaacagatgttgtatgaagcatctgatgtttcataaatgggttattttatccaaaatttcagtgatcaatagttcatagattttttatattaggtaagttacttctccctcttgaaaaacgtgaaggaaaatattcaaacattcaaagggctttgaattattatgaaatgattatgaaatgatggtgctttggatggtggttataataaaatgtgtgtagttgtagcacctttcttttcattcctcactctcaaaacacatgcatacacacgtatacacagacacacacatacacacacagagtcatgagcaaaaggatttgaagatttgttagttcgaattttctgacaggttttattttataaattgagttgtacaggaggtactctgagagggtaagttgaagaattctccacaaatctaattagaaaatttaaaaagtgaaaatatattacatgtcatttgtggtctgatattttagctttaattacactgaggggagttataaaataggcatatcagtttcgctaaatattgacaccatctgatataacgtttgtagaactgggacaggaaacactattttcaaagttgtcaaactgaagtactatttttctccataaataaacaaaatggtagaagagtacacaaaaccataaacagattctacctgagaattaaaccactaaagtagaagccaagctttagatagctacaaaactggccattacttcttatacttcacttttctgtaaaatattctaggcagaagattttttaaaataaaatcaccaataaacaattttgtttaaaatttttatgagtctgtgtggtctcctaactctttaagaatgagaaatgtatttaaggattcatttaaggaagtagataaaggcatggtacagaatacctacatattaatttgtgggatgtgtagactgagttatgagaatactcaagttaaaagtcactttcgcattcctttcaaacaaaaggctttgtcaggtgaatgctatgttttatatttaattagcaataacaagtaagatttaattgtaaccaaactcagctatttagaagtatcttgtttgtaaaacagcgtagaataatgtcaacaatttagcaagaaaacccaattcacagcatttcagagcaaaaagggatagaggtcctctattgcaacttctgtgtcatggatgaaaacagtgaggctcaaaaagtttgagtgacacatcaagaagtggtaagagtcaagactagaactcatgtctcctactgcccagcctaatgtcctttatgctaatcacacatatttaacggctagggtgttgaatgatactagaatgaattatacattatataaattattcattatgcaaattaatttttgttgtctcagttttctgtattcatgacatatttgaatttaacaagattcatctggtacttctagctatttctacattttatgagttgtatacattttatatcaataagttataaaacaatagcagaagtcgcttcttttttccagatgagacagcaaaaccagaaactgacccttcaactttgaagtagctttttgtttgtttctttcccctttatataggatgtcttgaagccgagaaggaagagctgttggagagacgaggagttaagagttcattcggctgtccagatgtatccaagtaccctgtgttatttggcaataaatacatctgggcaactgactgaacttttcacttttcatgactcagctggaaccctccacaaccagaagagcctgttataaagtgaaaagtttgtgatctcttaatctaatgaaatgggaagtaggaattgcttgtgggtgaagagacaccattgtaaatgtaagtgggaatgtattttagtatgcaactaaattgatttttaagtgtcttgacaaaagataaagaggatttttctagcttgcaaaattaaaatcaaattaacagaaaattttgatctgctcccatcagtgacacttgtcgtgtacttaactcaccggtataaaataactattttatactgtgatggagagtagctggcaaatgctggcaaatattatttgtatattacaatatttaaaagatgtctaacctcaagctatggctatgtacatggatccatctaatgtatttaccccaatcactctttatctcatgatgcaatttcattttattcatagcaattatcacgatttgaaattatcctacatctttgtttaaatgtttattttctgtatctccagctagaatgtaagctccattggagcaggggcctggtttaccttgtttactactacatgcccagcatctggcatagtgcctggcatgtaataagcaatcgataaatatttgaatatatgaaactactattatacagcttttggtcctgcagatcggttggagttggtctccaacacagatatttagcatatggtttgctccattagctctgctctttgaaaaccttcagtttgttgtgctatgtgcatactaacactgagataattcccagatagttctgctaccacctatggagaaagcagtttcaaattgctgggcattctgcccactaaggcaaattctctccatgtctgttactaccatcatagagtgatttgcaatagctactttaagtctatcaattgggaagtgtatgtttttaaagtattattttatgtaaatggaataggtctagctgtgaaaaacataattttatatgctgtagattttgagttaactgttgtgtgaattcgcacataatttaacaataatcacgctcatggaacatgtcaaacacaagcagaggtatttagtaaatacaaatgaggagaaaaaaatttttttttccatttgaattccaagcataggaggaacaggtaaatctgtttaaataaccacttaacattatcttggaggagagagaataaaagtaatgagcctagacttgcattcaaattgaataatcactggtggaagagtagtctttaatttcattgatgataataactgaaaaactttctatcaaaataataaaaattatctgatttgactataattagcaaaggtgagtttttagtatgacaaatgtatgatttattagaaaatcgctagagtacatttgaagttgaaaggaaaacttcctacaatattcattagtcctaaggataatttttgaattaaatgagctcccccaaaattattgtaaatctgtgccacattaatataatcttcccaggactaatctgaacatttatggctaattcatttttgatttagacatctgctaaaagctcactgggtataataactagagggataatatttgaattatgagtcataatttctgaacactgaaaattgataaaaatcaaacttctatatgtattattatttattcaatttttaaatgctttgttataaaaagtgagacagaagtgatctagttgactatattctacaatttcttttttttttgagacagggtctgttgccctagctggagtagaatgatgtgatcagggctcactgcagcctcgaccacctgagttcaagggatcctcccacctcagcctctcaagtagctaggaccagaggcacacgccaccacatctggctaattttttgtattttttgtagacatggggttttgccattttgtccaggctggtcttgaactcctgagctcaagcaatccacccactccggcctcccaaagtgctgggattataggcgtgagccatcgcacatggtctattctacaatttaaaaaaatttagtgtgaaatttagtctttcagtttgatagaaaatatgctgcatcattataatgtgctaacggaatttccagaaatctagtgtaaactataccttttcatgggtgaatctagactctccaatttttgttaaaacatgagtagaaatgctggcattttttcttaagactcatcaatattatcttcaaccaggtctgggaaaaaaagaataaaaagtagtgtgagagcagaaaacgtgattgaaacacgaccaatctttcttcagtgccaaagggtggaaaaggtaatggtaaaaatgaattataaatggttagctttagaagttgcaaggcaagcgttttcaataaagatgcaagcttctatcctctccaagcacaatttgggcaaaaccacagctcttcctttattcttagatagtatcttttgacttcacaccttaaatctcctaccttcccatcaatcagccaattactttgtacccaggacttggccaaggattgtggatgttacatggaaagtacatctatatggctcttctgctcaaaatttgcctttagtattaatacaacacctttaaaaagccttgttcgtgccagcctttgtgccccacagttttttgttttctttgattttgttaatattttttgagacagggtctcactgtgtcacccagactgaagtgcagtggtgcgatcacggctcactgctgctgccacctgctggcctcaagccatcctcccacctcagtccccaagcccaccccacagtagctgggactacaggcccgcaccatcacatggggctgattttttttgcagagatggcgtcttgctctgtcccatagtttttaaacttattttttaaaattatttttgcttccaaggtgattattgatgatgacttttaagtatttctgtgagtgatacggattctgatagtttgcaatttatttccaaatttccagtggagattcgattttggttcagttgttttggagtgttcacactattttggatgacatatgctgtatgacacatggcatatagccatataagcatagatttcataggcatgaattaaatataatactcatggtatggattcatacttaattaaattttcacattaattgaggttattctgcaatatcttgtgtaaaattgtactattgaaaattatgtgaaaactaatgtttctcccccatttgtcttagcaactgtagttactgttattgatgtctgaagattttacagtgctttagagaaggcatgaaaagatctgtgatttacactgtagaaaggattgagagattggtctgagtgtgtatttagtgactagtgatcctgatcttatttctatgatttaatctgtgattttctcttcatacttgagacagctaattggttttaagttaatcaatctttttctggacacgaaattataaatatgtatgactacacaaagtaacacagaaacacacaaatgttatataagttggttgtaattataaattatattaattttatataattatatatataatataatataaattatattaatattaatattaatatttaatatatataatataatataatataataataatataaaataaataaataaaataatataataatattaataatataattataattataaattataacacttattaaattatcaaacctactttcaaggcaaatattataaaatctcattaaaaattagtcaattattccgtcaattatctcacaagtgattttaaaaaaattttacaaaacacaatccttcacaaatttgaaaacttgaatttataagcattcttttgtgttcatgcaactttaaaagttccattacacagatcagaaagttccatatatgcatatcagaaagtttcattagagttgtttcgctatgtttttcagtttctgttattgattgatcttatccaagacaagaagttttgcatcaccttcccttttagtagaattactcacagaacatttcttattgcaaaatatcatcatcacagtggcctggccatttggggaaacatgtaagataacataatttatgttacataattcatataatttattcccatcacaccatgttccgaaactcttaccaccagttcacaggtattttctatcatgtctactcagtgttcatgcaaattttaacagcatgaggagacatgattttgcctacaagtcatttttgttaataaattggaaatctatatacataatattttttgtgattattactcattcttctcaataaaattggaacttagaaaaataaatatttgatgtttaatttttctgcttatatttctcaggaatatacatgtaaaaaagcataaggaagctggctaatttttaaaggaatataatattttgagtaacagtaatggaattcatccatagctaaaaatgtggctaataaagtgcttcatgagatgattattgtatcagcttgttttgttatactctattggagcacagcatatttcactctatctttgaacctttaaaaattatactaatatttggatacataaaaataaatattgaaaatcattttaatacttttagcataaggaaaaaggaaaaagtttgatacttattgagggctaagaagcaggatgggaccttttggtttcccttaccattttttctgtcacttattttcagacctcccagagaaagagatgtctgtgttgtctggtaaaatttatgggacagtattggcctgactaatggtcagggtgatatagctctctctctctcacacagaatattttgagttcctagatattggaaggccatattttatgtattacggtagtaaggggatgatttggagattgatttttgtgtaggtagcactgatagaactgataaatgagagctaagggatgaagaagggagaaaatattaactatgtatcttgagtgacaaggatagtgctattaaatgagatggaaaacacagggagatgtgatttcttctggttaaattttacttccaaatttctagaaggagctagaagcacactaaagaaagcttatcaagacagattttcacgatcatatttctttttcttttttttttttaattatactttaagttttagggtacatgtgcacattgtgcaggttagttacatatgtatacatgtgccatgctggtgtgctgcacccactaactcgtcatcgagcattaggtatatctcccaatgctatccctcccccctccccccaccccaccacagtccccagagtgtgatattccccttcctgtgtccatgtgatctcattgttcaattcccacctatgagtgagaatatgcagtgtttggttttttgttcttgtgatagtttacagagaatgatgatttccaatttcatccatgtccctacaaaggacatgaactcatcattttttatggctgcatagtattccatggtgtatatgtgccacattttcttagtccagtctatcattgttggacatttgggttggttccaagtctttgctattgtgaataatgccgcaataaacatacgtgtgcgtgtgtctttatagcagcatgatttatagtcatttgggtatatacccagtaatgggatggctgggtcaaatggtatttccagttctagatccctgaggaatcgccacactgacttccacaatggttgaattagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttaagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtgctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccgtttattaaatagggaatcctttccccatttcttatttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtatttttttccaatattgtgaagaaagtcattggtagcttgatggggatggcattgaatctgtaaattaccttgggcagtatggccattttcacgatattgattcttcctacctatgagcatagaatgttcttccatttgtttgtatcctcttttatttctttgagcagtggtttgtagttctccttgaagaggtccttcacatcccttgtaagttggattcctaggtattttattctctttgaagcagttgtgaatgggagttcacttatgatttggctctctgtctgttattggtgtataagaatgcttgtgatttttgcacattgattttgtatcctgagactttgctgaagttgcttatcagcttaaggggatttggggctgagacaatggggttttctaaatatacaatcatgtcatctgcaaacagggacaatttgacgtcctcttttcctaattgaataccctttatttccttctcctgcctgatcgccctggccagcacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgcgagtttttagcatgaaggattgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatatcggtctaaaattctcttttttggttgtgtctctgcccagctttggtatcaggatgatgctggcctcatcaaatgagttagggaggattccctctttttctattgattggaatagtttcagaaggaatggtaccagttcctccttgtacctctggtagaatttggctgtgaatccatctggtcctggactctttttgcttggtaagctattgattattgccacaatttcagaggctgttattggtctattcagagattcaagttcttcctagtttagtcttgggagagtgtatgtgtcgaggaatttatccatttcttctagattttctagtttatttgcatagaggtgtttgtagtattctctgatggtagtttgtatttctgtgggatcagtggtaatatcccctttgtcattttttattgcgtctatttgattcttctctctttttttctttattagtcttgctagtggtctatcaattttgttgatcctttcaaaaaaccagctcccggattcaataattttttgaagggttttttgtgtctctatttccttcagttctgctctgatttaagttatttcttgccttctgctagcttttgaatgtgtttgctcttgcttttctagttcttttaattgtgatgttagggtgtcaagtttggatctttcctgctttctcttgtgggcacttagtgctataaatttccctctacacactgctttgaatgcgtcccagagattctggtatgttgtgtctttgctctcattggtttcaaagaacatctttatgtctgccttcatttccttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtcctcttggtgtagagctgagttcaattcctgggtatccttgttgactttctgtctcattgatatgtctaatgttgacagtggggtgttaaagtcctccattattattgtgtgggagtctaagtctctttgtaggtcactcaggacttgctttatgaatccgggtgctcctgtattggttgcatagatatttaggatagttagctcttcttgttgaattgatccctttaccattaagtaatggccttctttgtctcttttgatctttgttggtttaaagtctgttttatcagagactcggattgcaacccctgcctttttggttttccatttgcttggtagatcttcctccatccttttattttgagcctatgtgtgtctctgcacgtgagatgggtttcctgaatgcaacacactgatgggtcttgactctttatccaatttgccagtctgtgtcttttaattggagcatttagtccatttacatttaaagttaatattgttatgtgtgactttgatcctgtcattatgatgttagctggttattttgcttgatagttgatgcagtttcttcctagtcttgatggtctttacaatttggcatgattttgcaatggctggtaccggttgttcctttccatgtttagcccttccttcaggagctcttttagggcaggactgatggtgacaaagtctctcagcatttgcttgcctgtaaagtattttatttctccttcacttatgaagcttagtttggctggatatgaaattctgggttgaaaattcctttctttaagaatgttgaatattggtccccattctcttctggcttgtagagtttctgccaagagatctgctgttagtctgatgggcttccctttgagagtaacccgacctttctctctggctgcctttaacattttttccttcatttcaactttggtgaatctgacaagtgtgtgtcttagagttgctcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagaggtagatttggtcttttcacatagtcccatatttcttggaggctttgttggtttctttttattcttttttctctaaacttcccttctcgcttcatttcattcatttcatcttccatcactgataccctttcttccagttgattgcatcggctcctgaggcttctgcattcttcacgtagttcttgagccttggctttcagctccatcagctcctttaaggacttctctgtattggttattctagttatacattcttctaaatttttttcaaagttttcaacttctttgcctttggtttgaatttcctcccgtagctcagagtaatttgatcgtctggagccttcttctctcagctcgtcaaagtcattctccatccagctttcttccattgctggtgaggaactgcgttcctttggaggaggagaggcgctctgcattttagagtttccagtttttctactctgttttttcccatctttgtggttttatctacttttggtctttgatgatggtgatgtacagatgggtttttggtgtggatgtcctttctgtctgttagttttccttctaacagacaggaccctcagctgcaggtcttttggagtacccggccgtgtgaggtgtcagtctgcccctgctagggggtgcctcccagttaggctgctcaggggtcaggggtcaggaacccacctgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggttccacccagttcgagcttccgggctgctttgtttacctaagcaagcctgggcaatggcgggcgcccctcccccagcctcactgccaccttgcagtttgatctcagactgctgtgctagcaatcagtgagactccgtgggcataggaccctcggaaccaggtgcaggatataatctcctggtgcgccgttttttaagcctgttggaaaagcgcagtattggggtgggagtgacccgattttccaggtgccgtctgtcacccctttgtttgactaggaaagggaactccctgaccccttgcacttcccaagtgaggcaatgcctcgccctgcttcggctcgcgcacggtgcgtgcacccactgacctgcgcccactgtctggcactccctagtgagatgaacccggtatctcagatggaaatgcagaaatcacccttcttctgcgtcgctcacgctgggagctgtagaccggagctgttcctcttcggccatcttgagaagtttttgaagaatatattcttaatttctttttcaaagcattgatttgaagccatgtctactccaagagggggaaatttggtataaaccatgtataaataaaacatatacagaaaatttttaaaaactgcgatgataaataattgaaaaatctgctctctttgccatattttatcacttacacagtataacatgcttacctgtttgctgaattaataactgtttcttatcaccattaagtgcatttaagtttatttaattggttactatgcaagttatttcgatgtttaactaattttctctttcttctttttctctccccagaaaggatgatatgatgaacctagcctgttaatttcgtcttctcaattttaaactttggttgcttaagactgaagcaatcatggtgaacctgaggaatgcggtgcattcattcctgtaaggatgttactacttattattttagtgaaaagataactttgcttggtagcttgctcaacatgttaaaaaaatgcttctatatgatcagctatatttgcctaaatctgcataaatggcttgcttcccaaaagactaatattatgggtgtttcctattcaaaaataattaatggaaaaaaaaatttggactctaattaagcacttgagctcatatacttaaacaagtaatatggtgataatgccctaaattcaaataatctcaatgttcatggctactttttccatgggtaaaacttagaaaggaaaaatttctgtccttttccttcttgcatgaactgaacagttaagagaatgaaatgcctctggttttgtgaagaatagttgaggtaggaaaagaaaaggttggaagttaggggatagggcttggcgatgtagctggatgggaaaaaccaatgtcatcctcagaagtattgatgcagtgacccagttgcagccaataatatacaacataaagggtgtaggtaaagatacaggagattcaaataataagcaattctaaatttgatctaatccaggtataccttctttttacatagaaaaatgttggtttcttccgaacctgctttttgaggaacgaagcatagaaaaaaatgatccaaagcaatgtaaactctgattggtatagttgagaaaccccaaatctccttgctcctaggtagtctcctttatgattcttgtaaaagagctcacccaggaaaaagtttacaatgtggtggagatataaagttcagcaacattggatcctctgcagtgtgcatcactgtggcccatcttgagtgtcattgttgtgatgatagtttcaagtatggaagagtccaagagaactagagcagacaactgggaaagaaaagagtgaaggacagtgataaagaagggaaaagaagagttgggtatgggaaaatgaaaggacaagtgttcctgctccatgagcctgtgccaacttagtatatagccattggcccatataccaaagtgtaggactgccgtaaagggcaccaaattattctgctatgaaattaattaaagaattcatatacaattgttttaaattctattgagagaaacaaggaagaattcctgtcttctaacaatgtcctaggtcatagaaaaactcagtagattttaaatatattcaactttttaaattaaattatcattttgtttatatactaagaatgtaaagttatgttttcattaaaactttagtagcaatgagtaaattatatgcatttcagagagaaattatgacttttgtatacatattttatgagattcctatgagcttaaaaacaattaggataaactttaagagcaagacctaaattactcctcttttgtaaaaggactttataatttcactgagcatgttaagtattaaaaattagatttaattataatacagccaattcttcattacaaaactgaagaataaaggattaaactttaataaaaatcataatatcttgtctataagtagtgctcaataaaaatttattaaactgaatttaattgaaaccaggaaagtgaagtaaatactttatcaagatttatcctaacaccattaccttattttgtaattcacaacagatatgtttacatctgacaagactccttccttcaataattcagtatttgtcttacagattcttttattaaaaaaaaattttctgaccagtagggataggctagataactacttgaaacagtccaaactcaaagatactcaaattataaaattcataatttgacataattttcttcgtatatgtttctgttatatataatttgtcctgtactcctctaccatttttagagacatatgaatgaatttcgatgttttcacaatttacttagaacatttgaggcagactgcatattcccctaggaccttattctataggtttaaggataaatgtatttgtcattctgcaatcaacaactgaagacgcagtttagtatttgagataaattcttgtgggactacttgagatgatcttcagctaatttaaaacagaacattgttttttaaaatgccagcaggacaagttttttatcagctaggccagaaaggactctggaaaacgtgctggatttaagattacttttttgagtccagttcttcacacatagacatcgtctcaaaataaaatcaagacttaaattatcctggcaaattttgaaatacatgagttgggatatagcaaacataaaatacttttgtttaactacaaagcagacagaaggtacctccagcatttactgagggcctcttatgacacaggtattaaaggttgacatatatcatttaattttcacaacaaccatatgatggagattgttcttgtacagatgaagttgatgttctgataggttaagtgactggtcaaaaattactgaagtcagatagccaggacattggccacatgccacattcaataaatacagtgacagagtaatcaaagctgagagcgaataacttgcttctgtttatttggtcctttatttcactaatttttactcatattaatcacagattaattatgacatagattttggaatcctgtattatttttgcctattttttatgttttgggaaaataatacatttggaagaatttactgattacttctcatcatttgataagaattacgatttctctgataatggtagtcagcaatgagtccattaaatcacacatatattatccctgcctggagatactatcttcagttcaaagaacaagtgactgggataatgacataaaaatacataatatggggaacacatagactctgaatgttatgtcatgtgttccatctccctaatttcagaaagaatcatccttcaactatcttgcatagaaaattatgtagcatatattgtgcaaccagaggcaatttcctcctctataaataatatcaaggttgaacaaccactacatataggaaatgtatcctcatgttgctgtttaacattaattaaataactattactacacatggaataaacataaatcagtcattcacaggtaatatttcttagttttaagcaggaaatattgaacatgcttggctgtcttgtctattttatgaaggaaaaaatgtgtagctttattagacattttaggagcttacactttgagagaatacttatgtacataactcgaataaatctcatgtcgccatagggggatattaatttagaatgtgcaaatgacaaccacatccatctctggcaatagcctgccacctggcctgaaattcctactggtagaatctaccaaaggaccatcatgagaaatgtacatttctaatgtacttaaatgacttaagagatttagttccagtgcatgaaaagtaacaaatccataggcattaatcatcaccacaaatcattatctagcctagaacaaggcccacaaaatataagacaagacagaaatgtggagagtggcaggtagaaggaaagtttatagcacaaaacgttaagaaacaattgaaccagcataatggcactttgcaaatgtgagaaggtagaaaaacttctgaaaagaaatgaaagggtattcttgtcaaaacccactgtacctcttccagacgctttgccagaatttgatctgatggcaacttaattccttcttagccttggatcaatagaatgcaacttccagtttccttgttagggtcatggatgctttaagaaaatcccccttcattctgttatcagctgtctcagaacatatctaaaggaatcagtattttaaaaatataaagaatagactattacagcaaatcaagcagtactgtggtttcagatcgcagtaaaagtttaaaacatagactttgaaatcagtgggacctgagtatggaccctggccccaccacttactggctgtttaggcttgaaaaagttacttaccctttctgaactttactcagtcttctcatctacgtgatggatataaattagaactgacatcatgaggttgtttaataagatcaaatgagattatacatatatgtttcagcaaactaagtgcctaactcataataatcactcaataaaagttggtaatttttggagagaaagaagaaatactgagattaattaagagagtagaaataatgatgatgacaatgatgctgatgatgataatgatgacaatgatccatgaagaagcagttgttttgcatgagcaacgtattgtgtataagtaatataatatgtacctgattgtttttttttttcttaattttcagtgtgcacctaattggcctattggtttggcaatgtgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatggtaagtacaattttattcacttttcaatctcgtataatgtcataaatttgtgtcatagtaaacactcataaagttaattattttacttgtaacatttggaaaaagaaaaaagcaaatcgtgtgacagaaggagttggatgtatgtatcatatttattaaacaaatcagtaacagtcttccaaaagcaaaacatacattttatatatattaaaatcatacatagatgctctcttgcttagtgtctttgtaaacaatgaatgaacagttagttgccttacaatgtactgaatgagacattaacagaaacatctttcaacccctgtgttctgggcagtacacatacctactaccatctctgatacaaagaaggaaaaaccggctcatcctctttaataaatatattttaagaaatccttttttaaagctgccaaactaagtggttgacacaaaacaggcactcaataatagctattcttcttgttcatggagtctataatttgtgttattacaaagagacaagagatagcaaaattaattactaagtatataagtgtaagttcatatcatcactttaaaaattcaggcattgaaagtttcaatatattgattttaaagaggtttttaatttttcttttgattttcttccatcccttcattctgttcattttaacctaaggttttgtttctagctaatatttatgatgaacaatcaaatagtttatacaactctacaaagtatctttactaggaagttggagagcccagtttgaatttaattgctaatatgcttatctcacaaaggagtaaaatagacttccagttgcctggagtgtataatggaattagactagaagaaataatattgaaagtgtatctagttgtcgaatcctaaaagaaaataaatgcatctagaaaataatctctcatgtaatgtaaaaattaagtagcctgttctatacctatggcaacagtagattatcttaataggcattttataaagtgttctcagaatatatgcttttcatattcttcatcgagtttcaatgatgcattagccttaaagcactagtattttatctgctcagtgggcattttaccactctattgctccaaaattaagaaaagattactggaatgaagtgaaactatgatttagaaggtatactgtgttctgtggtgtctgtttcgccagcttctccctttaaaaaaatgtgagtggccaaataatgatattagcataaatccaagtctcttaacatatctattcccctgcccaaataaacaaagaacaatataaaaaacaaataaaactgcacaataccaccattaagtgtggagaacattcaaatttcaaattacctgtaagtaggaaaacaaatgggaaataacattgaactatctattagacttctaccccatgctgttgcgtagaagaagagtagtccaggaaagatagcatgaaataaactagaggaaagctattaggaagcctaagattgatctaaaaccaccacaggtggccgggcgcggttactcacgcctgtaatcctagcactttgggaggcccaggctggcggatcacttgaggtcaggagcttgaaaccagcctggccaacagggtgaaacccagtctctgctgaaaatacaaaaaaattagccgggcgtggtggtgggcgcctgtaatcccaactactcgggaggctgaggcaggagaattgcttgaacctgggaggcagaggttgcagcaactcgagatcacaacactgcactctagcttgggcgacagagcaatactccataaaaaaattaaaaaaaaaaaccaccacaagcaagtaagtctaccccaagtacgaaaatactgaaaagtttctctagaaggtcagctttcagataaggtactgaaaagtatgcataagactcaagaaagcagccttggaaaattaactctttggaggtggaaaaaggtaaaaaaggaagcaagaggtgacttgaaaaaaaaaaagcacagtgaaaggaaaaagaagcaagagggggaaatttatcatcttacagtacagaaaatgtcaaaatattaggacccatcacccctccctctactgtctcccactgtcccccaaaggccctccagtaaagaaaccatactttgatacacaaagaaaagaggatgctcttgagcttggaattttggaagctacctacaaactgtcagtcatgttcatagaaattctgagatgcaaccaatcttcatctataccaagctactatagaaaaaaatcagaatatgagaatagaaagaaggcatttgatgaacattccctccaatacagaatgatcaagccgaagaatatgctagcaaaacacttcaaaaaaaatctgcaaacaagcatgttaaggtattaaaaaatgtactttgaagtagtaatctaataactaagaatagaaatggtcaaaaaaataggacagcatgaaggaaaattaactgaattcaggacaaataaaatagaagaaaaatacatcatatcaggaatgaacataaaaagcacccaacgaagaattgattcatatgaagcttaataaggagtatagaagaaaaacagattaccaaagagaatgaagatgagacgaagaaagaagtaaaatatgttagagtgtggttgaaatagaatatcagcaaaaatgattaaatgtatgtatgagaacccttgaaaaggaacaaataggaaaacagaattaatatttaaaactataatccaataatgtcttccagatatgaaagagagtctgactctacatattgataggttcaacccagtgctagaaaattgacctgaaacaatgaactctgagataaatctgagacactggatttttcaatataaagaaaaaatcctcagggtttccaaagcaaaaagagggaaaaatttacaagagcaagagtgttagactgccttacatgtaaaaaaaaaaaaaaaaaaaaagacaaaacaaagcaatagtgaaacaatactatcaaaacacaaccatttataggacattctttgaaagacaaatctatacagacagaaaacagatcaatagtttcaatggctgaaagtgggaagatgacttcaaaaagccatttattttgttattatgaaactgttttatatcttgattgtggtgatggttatacaaatatatatatataaatttgaagagctataaattctagtatacagttttaaaaaggtgaattttactctatataatagatgccataaatttaaaaatatttttaaatacacaaaatggtttggaaatatgattctatgtctagacaagttgtccattaaggctataaaaagtttaagtcttttaaaattcagggaattatgtaccacaagcccttttaaaaaataaaatagtggaggtcaggtgtggtggctcatgcctttaatctcagcactttgggaggcctaggcgggcggatcacttgtggtcaagagttcgagaccagcctggccaaccggatttctttagtagagacccagtatctactaaaaatacaaaaaaattatctgggtatggtgctgcctgcccgtaatctcagttccttgggagactgaggcaggagaatcgcttgaacccaggaggcggaggttgtagttagccaagattgagccactgcaatccagcttgggcgacagagggagattccatctcaaataaaataaaatagaataaaataaaattacaaaataaagcaaaataaaatagtggatgggattcatctaacaaagggatgactgggaaagtttcatcaaaaagactgatgataaacatttaatatatttaactttagagctaaaataaaagaaatggtattttaagagcagaaaaataccatgtcatataatatatattatgttttatctgttctaacaatctggaaacaatgcaaccaaaaattaggaagagaaagaggaaggggaagaggagagtagaatcatttcgttgattcttctataaacgaatgataagaattaaattataaccataaaaaactggcaaatcagaaagtaatagaattaataagaaaacatgggtctagggtcattaagcatgttataaatataaagttaaccactagaacaaaaatacacacgttcttaaacaccaaaggaaatgtaattagtagaagagccaaaatcagtcaaatagaggaagaaatagaagaaaataaggctgggcgtggtggctcacgcctgtaatcagcactttgggaggccgaggtgggcagatcacgaggtcaggagatccagaccatcctggttaacatggtgaaacaccgtctctactaaaaatacaaaaaaaatagccaggtgtggtggtgggcacctgtggtcccagctactcgggaggttgaggcaggagaacggtgtgaacctgggaggcggagcttgcagtgagccgagatcgcgccactgcactccagcctgggcggcagagcgagactctatttcaaaaaaaaaaaagagaaaagaaaacataatgcacttaacattatatgatgatataatatgacagagttaaaatcaaacatatcagtaagtaataatcataaactcgaatgaagaagctatcactctattaaacataaaagatttttaattaggcatatgaagaaagacccaagtatattccatatacaaaagtaacccttacaacccagggattagtaagcgctaaaaataaaggggtaggtgaaaagtataccaagcaaatggtaacaataaagcagaaattgcgatcttgatatctgacaaaagaaatttgaagtaaaaaaatggtaagactaaaaaagaaagatgcttattaatgataaaagaaagccacaattaaagacaaagaaatggcagttaagaatatctctgcatccaataacacagaaatgacttttataaaggaaaatctaaaaacggtggaagaatacatttatgggtgcattctaatatgggagattttaatatactgtactcagtacaagaaagactggaccaaaaacaaagaatatatatcttatgaatgtatattgaactttacactcttatcgtagaaagtatagcttcttaagtgcacatgaagtacgcaaaatttaatcatatattaggtcacaagaaaaggttaaagtagaaattttataaaaagttctttttgataacaatgtaataatactagaaagtactaacaacaaaagctttaatatcatcttggaaccataaattttaaacagctcttgggtgaaaagaagaatgcaaacagaaattaccaaatttattttaaaatatgatagcataaacactgctttatcaaaatctataggatacacataaaggagtgaacagaggaacattcacaattccaattacatttattagtaaaaaaccaaagtatatgaataaatttccattaaataatcttgaaaaaggaccaaaaaagagaacaaaagaaagcacaaagcagaaaaaaaaaataataaagataagagcagtaattgactgggtagagaacagtagagaataaaaggacagtatacctaatcaagaaattaaactcctggcttttttttcttttcttttcttttctttttttttttgagatggggtctcgctctgtcacctaggctggagtgcagtggtacgatctcggctcactgcaactttcgcctcctgggttcgagtgattctcccacctcagcctcctgcgtagctgggattacacacgtgcaccgccacactcggctaattttttatgtttttggtagagacggggtttcacaatgttggccaggccactcctgacctcaagtgatccgcccgcctcagtctcccaaagtgctatgattacaggcgtgagccagcgcgccagggcactcctgactttttaaaagatttttcacaaaatagaaaattgctagctagttttaacaaggaaaaaggaatagagcataaatatatcaaatataatatgagagggcatataatcatagaaaaaaataaattttgtaaatcacaagattaccttgtagatttacatgcaaatcaatggaaaacataaaaaatagataatttatcagaggaatccaggttaacaaaattgaccccatgagatataaaaggaaacagaccaatttcagtagaagaaatagttatcaaggaaacttgcacaaaaatccctccggactcaaatagtttcactgggctcttctagttataatgcttcaaaaattgtttcagagcattgaaaacaaagtgaaacttcctaaggtttatatgaagtgagaataactttgatacataaaccaggtaaagacagtatgaagaaaggatgctatagaccaatgtcacttatgactattaatgcaaaaatactttataaaatcttagcacacagaatccaatgtcatgtgaattgaaaaaactcaaagttgtagaagcagagagtagaacagtgtcttccagaggctggggtgatatggggtggggaagggagataggaattgttgtcaaagagtacagtttcagttagacatggtgaataaattctggagacctattattgtacagtataatgacaatgcttaataatattgtattgcatgcttgaaattgttaacagtaggtcctaaatgttccagtctcaaaaaaatgtatgttaggtggtggatatgttaattagcttgatctaatcatttcacaatgcatagatatgtcaaaatatcacaatatacaccataaatgtatactaattttaattgtcaattataacttaagaaaactgaaataaaaaagaatccaactccacattaaaaaagaatacaccacgaccaactgggtggtcacactattattactattctagtaacattgtgttactagtaacacaggaacagaaaaccaaacaccacatgttctcactcataagtgggagttgaacaatgagaacacatggacacagggaggggaacatcacacaccggggcctgttggggcatagagggggcaatgggagggagagcattaagacaaaacctaatgcatgcagggcttaaaacctggatgatgggttgatgggtgcaggaaaccaccacaggacatgtatacctatgtaacaaacctgcacattcttcgcatgtatcccagaacttaaagtagaaaatatatgtatatatacacacaccatgaccaactgggtggtcacactattattctagtaacactatgttggctcaatatagggaaatattttcctaaaatatattaacatatgacattaacattattactaataagcacatattaaaaattaaagctaaaatataatgaatattgataattatattaatacattattatatttataacattaacataaaaatattaatttaaaagtatatgatttatctctaaagatactgagtgaataaacatttgccaaaatttatagcttttttgataaaaatccctcaagaatatagaaattgatattacttttttactgtgataaaagataaataactttgtcagacagctggcatcttagttcataggaaaacaataaaagcacttgttctaagatcaggaaaaatatgagcatgccttatgtttccatttccacttaacattttgctgtagatattagtcaatgcagttagataagataaattaattagagttataaaaactgaacaagtataaccatctctttttccagtgtatctcacacttcataagaaaatcaggataaaactattaaaaaataagatattcagtgagatagcaggatgtaacattagcatggaaaggtctatagaattaatatacccaaataaccagttggagaaacctccatttaaaatagcaaggaaaagagaatacattaaggagaaaatatgcaaaatctattgttaggaaaaattaaaaacacccctaaaagacaaatgattgatatcattggcataacaacaataataataataacaataatacatgccaaacaccaaaagcaaacttcaaaaacaaactcatagaaaatagttgcaaaatatattgcaaagggctaatatctctaatacataaacaattctttataactgaagtagaaatccagcactcaatagaagaaatgaactaaagatgtgagtaggcaatttggattttttaaatatattttataggccaggtgcggcagctcacacctataatcccagcactttgggaggctgaggcaggtggatcacttgagcccaggagtttgagaacagtctgggcaacatagtgaaaccccagtctctccaacaacaacaacaaaattagccaagggtggtggcgggcacctgtagtctcagctacttgggaggctgagatgggaggatggcttgagccctggaggctgaggctacagtaagccattttcatgccactacactccagcctgggtgacagccaaaccctctctctctctctcaaaaatatatattttaaatatatatataaacatgtgtgaatatttgaattatatatatacacatttatatatatatatatggtccttaaatacatgaaaatatgtttaatctcaatcattagaaggaaaatgcaaaataaatgacaccatgataccattttttaacctatcagattggcaaaatatgacaagcttgaattgcactgtggcaaggctatggggacatcagcactctcgtatattgctggtgggaatgtcaattgctacaaaccattttggaggaaaatctgacaacactgaaaaaaactacataagtaattatgttttaactcagaaaactaacatctaaagtgttcactggatgataaacgtgtgttaatagcaacatatatatgtgtgagattattcatataagcattatttgtaattgcaaaatattctaaacaatctaagttctatatagagagagattaattaaatatattacagactatccacaaaatgggatttattttttaaaataaggaatttctttattacctgatacagattataaacagaatccaaataacttaattctatttgaaactaataacataaccacactgaagtacaaaaaaatctgacccaaataactttaatacacaatatttgtacaatatacattctgtctaaatataaataaactctaaatagtaggtttgctttttattggtgttatgcaatagtgattgtataacaccaccaatattgttagtgtactctgagattgtataagtgtgtaggtataccaaagacaatagaagccagatttctcactgttgcataaggtagttaaaaattcgaaagggggaaggaaataatgaactctacatcattggactaatattcatgatatccgtgtaaattcatagtggtagtaggtgatagttagctagctagctagctagagagataacataatatttatatgtatactttgaattatgtcctagtctgtccactaagagggcctagcagcagtgtcacatgcgtagcaatgagcgaaaacagaaacagaaactccttggggaaatagtcaatttcaggaatgggacagaaaaattacagcatgagattgggagggccgggcacggtggctcatgcctgtaatcccagcactttgggaggctgaagcaggcagatcacgaggtcaggagatacagaccagccaggccaatatggtgaaaccccatctctattaaaaatataaaaattagccaggcgtggtgacacacgcctgtagtcccagctactcaggagactgaggcagaattgcttgaacccgagaggcggaggttgcagtgagccaagagctgagattgcaccactgcactccagcttgggcgacagagcaagacgactccgtctaaaaaaaaaaaaaaaaaaaaaaaaaaaaaaaaaaaaaaaaaaaaaaaaaaaaaaatatgagattggaacaccttttcagctgaaaagtaaggaagtgaacatagaataatggaaacattaaaaaaaaaaaaacccacaggagccagcttaacagagcccccactgaccaaatgtgggaacattcaaacattaagtttaaataagagttctgatgacaacaaaaatagagtaagcccactaaaaactatctcttcttttgtattcaatcaataactctgtaaaaaaattcaaaagcaactacctgaggactcagaaaaataaacaaaaacagattgaaagggaaatcaaaacttagagaagtaacctatatgggaatgaggttcccttttttttccctctcttttctctagtagctttgccccaggcaggactcagtcacttagctgcatggtggtagcccaggagtggtttaatccttatggaaacccaatctttccagccagagtaactgacaaaaggagtctctatggtctccctaatgtaggggaaatacagttttccctcccttttttgtctcctggctttgtctggagaagactctagtcagagagctttgatagtatgagcactaaaattttgaagaaaccttttctttctggccagcagaccagaaaaagaggactttgtggaccagaaagcatgaaagggaaccccatagagtagacagctggtaaaaggttttcttaattctgcgtttaaacctgaaaaagtgccagtcttaatgctgagctttaagtaaacaggacagacttcaagaagcatagaaaagctttagaaaatttaatgtatttaaacatccatccaagtcagagaccatgccctgaatgacatgtgtgtgggacagactcaaagcagcgtagccaaggttataaaaacaaaatacattgaatccactcaccacagaggcaagactgaactctaagtctgaatttaactgggttttcaatgcctactaaatcaaacaagtaaacaaaatcagcattctcaagcagattttaacaagatctaaaatctacaaaatataaaactcagaatatccaggatacaatttaaaattgcttgacataaaatatatccagaaaaaagactaacagataccaacctcagattaccaagatgttgcaactgtcagccaaagcttctaaagcagctactgttttttttttttttttaatttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacagacgtgtgcgtgtgtctttatagcagcatgatttatagtcctttgggtatatacccagtaatgggatggctgggtcaaatggtatttctagttctagatccctgaggaatcgccacactgacttcctgttggtgggactgtaaactagttcaaccattgtaaagcagctactgttacaatactctatgtagtaatgaatagaaattaatggaaatatggatgctctcaaaggaaaaataaattattaaaaattgaaaattttaggacagaaaaatacaatatctaaatttaaaaaatatatagcataggcttaataacaaagtagagatggcagaggaaagagtcaatttgaagatgaatcgatagaaattattcaaaccaaagaatagaaacactgaggaaaaatgaacaatgcctcaagaacctgtgggattcagccaaattacagaaaatttgtgccattagagtcccaaagggagaggagaaaaagacgggttggtgcagaaagaaaatttgaacaaaaatgggcaatgattgccccaatttggtgaaagaaaaatttagagattcaagaaattcagcaaacctcgaacaggataaactcaaggaaaaccatgcccagacacattataatcaaattgccaacactggcaataaaaagtaatgaactattgatacacataatgacatggaagaatcctaaaataattaagttgagttaaagaagccacacagaaagagtacatactacgtgtccatttatatagaattttagaaactgcaaactaatctacagtggcagaaagaacagcagtgattgctggggacaatcatgagtggggtggtgcagatgaaaagggttattaaatgggaagaagagaagttgaggtgcagtggatatgttgattatctagatagtagtgataatttcacaaatatacatatatatgtcaaaacatcacattgtacattttaaatatatatagtttatgtttgtcaattgtatccagtaaagctgttgttaaaaattgtaagatgtagctaaagtagtgcttagaggaagatttatggcattaattacttattttagaaagtaaggacggtctcaaatcagtaatctaaacctctactcttagaaactagaaatgaagagcaaattaaacccagtgcaagcagaagaaagaaaataagaaagttcagagcacaaattattaagattaaaaataggagaactgtagaggaaaaccagtgtgttccaaagctcattcttttttttttttttttgacggagtcacgctttgtcgcccaggctggagtgcaatggcttgatctcggctcactgcaagctctgcctcccaggttcacgccattcttctgcctcagcctcccgagtagccgggactacaggcgccggccccaatgcccggctaattttttgtatttttagtagagacggagtttcaccgtgttagccaggatggtctcgatctcctgacctcgtgatccgcccgcctcagcctccgaaagtgctgggattacaggcttgagccaccgcactcagccccccaaagctcattcttttacaaaagtaatgaaattgacaaactgccaggaagacaatcaatttaaaaagagagaaaactcaaattaccagtatcagttattaaagaagtagaatcactgcaaaacctgtagacattaaaaaattatttctatcaattcaacaacttatatgaaatgaaccaattctcttaaacatataaactcccaaagattgcatatgaaaaaatggttaaactgtttaaatagcttaactctcgttaaaagccttcagtgaagagaagacccacagaaggggagaaaaatgtttgcaaactacctatctgacaaggcattaatagccagaatatataaggagctcaaacaactccatagaaaaaagtctaataatccaataaaaaatgggctaaatatttgaatagacattaaacaggcatatgagaaggtgctcaacatcactgatcatcagagacaagcaaatcaaaactacaaattaaactacaatctcgccccagttaaaatgacttgtgtccaaaagacaggcaataacaaatgctggtgaggatgtggagaaaagggaacccctgtataccgttggtgggaatgtaaattagtacaactccattagtatggggaacagtttggaggttcctcgataaactaaaaattgagctgctatatgatctagcaatcccactgctgggaatatacacaaaagaaaggaaatcagcatgtaaagagttatctgtactcccatgtttgctgcagcactgttcacaatagccaaggtttggaagcaacctaaatgtccaccaacagatgaatggataaagaaaaggtagtacttgtacacaatggagtactatttagccataaaaaaggagaagattcagtaattttcaacaacatgaatggaactgggggtcattatgttaagtgaaataatccagacacaggaagacaaacgtcagatgttctcacttatttgtgaaatctaaaaatcaaaacaattgaacccattgagatagagagtagaaggacggttaccagaagctgggaagggtagtggggggggatgggtggtagtgggaaaggttaatgagaacaaaaaatggctagaaagaatggataagacttagtgtttgatagcacaacagtgtgactatagtcaataaaaacttaattgtacattttaaaataacttaaagagtataattggattgtttgtaagtcaatgcataaatgcttgaggggacagatatcccattcttcatgatgtgattattatgcattgtatacctatatctaaacatctcaggtaccctgtaaatatatacacactatgtacctacaacaattaaaaattaaaaattagaaaaagtttaaaagcttctaaaaatctccatgcctggatagcttcactggcaaattctactgtacatttcgggaagaaaaaaataagaattctatacaatctctcccagaaaatagaagcaaaagaatacatttatatcatgttatgagaccaggattaccctgataataaaaccggagaccttataatcaagaaaattagggatcaattgcttcattaatatagatgcaaaaataatcaagatatattaacaaatttagttcagcaatatataaaagggataatacattctgatatagcgggcccaacattaaaaaatcaattaatgttgattaattgatcatctcaatagactaaagaatataataaccatatgatcatctcaattttggattagttgatacagaaaagacatttggcaaaaatgaactccaagataaaaacgatcaattaggctcagtggctcaggcctgtaatcccagcaatctgggaggctgaggtgggaggatcacttgagcacaggagtttgagaccagcctgggcaaccaggggaaacctcaactctaaaaaaaaaaagagaggccgggcacggtggctcccacctgtaatcccagcacgttgggaggctgaggcaggtggatcacgaggtgaggagatcgagaccatccaggctaacacggtgaaactccgtctctactaaaaatacaaaaaattagccgggcatggtggcgggcgcctgtagtcccagctacttgggaggctgaggcaggagaatggtgtgaacccgggagggggagcttgcagtgagccgagatcgagccactgcactccagcctgggcgacagagcgagactccgtctcaaaaaaaaagaaagagagagagagaaagaaaaaaagaaaattagccaggcatggtggtgagtgcctgtaaccccatctgatccagaggctgagatggaaggatcacctgaacccaaggaggttgaggctgtagtgagccatgattgtgccactgcacttcagcctggatgacagaacgagaccctgtctcaaaaagaaaaaataaagattaaaattcacccagaaaactcagaatggaagggaagttcctcaacttgataaaggggatctacaattatccttaagcagacgttgtactttatggtgaaagattgaatgacttcacctgaagttcaagaataagatcaggatatccactttcaccactcttattcaacatcatactgcaggtcctagccagtgtagtaacataagaaaaattaatgaaatgcacactggaaagaaaagaacagaactgttttggtttgaagatgacataattgtctacacagaaaatcccaagggatctacaaagacgctcctagaaataatacagtagcctgcttctgaaatggcccccaatagtccctgccacaatgatcccctcccttttggtgtgagaatagagcagaagtgattggatgctacttctgagattacgttataaaagactgtgacttccatcttgcttgcactttctctcttgctggcattctctcttgctcattcactttcttgttctgatgaagcaagctgccatgttgtaaactgtcctatagagaggcccacatggcaaggaattgagagaagcctcccacatccaatgtgggtcccaggccttcaatccaaaagccagcaaattatatgagctgcatgagtgaacatagaagtggatttttctccagatgagccttaaggtggctgcaacctggctgacaccttgattgcagcctatgaaacatgctgaagaagaggatatgctgtgacccaatgcctgattcacagaaactgtgaaataatgaatgtttttataagctactaatttgggggataatttgctatgcattcacagataactaaaataattattaagtgagtttagcaagctcttaggatgcaaagcccatatgcacaaataaattgtgtttctatatagtagtggtggaaattggaagtcaaagtttcaaagagtaccatttataatatcataaaaaatcataaaattataaatgtaaatctaccaaattatgtgcaggagctgtatgctgcaaacttcaaaatactgatgaaataaattaaagacccaaataaatggagagatatatcctgattatggattagaagaagaatcaatattattaagatgtcagtttgcccccaaatgatctgtagattcaacacaattgcaaccaaaactctcagcaggtttttttaatcaaaaagctgatcctaaaatttatgcagaaaggcaaaagaactacaatagctgaaacagttttgaaaaacagcacaattggagaactcataatactggaatttaggacttactgtcaagctacagtaatcaagaagaatggtattgttggaaagaaaagtgcatatatgaatggatataaatagaggatccagaaatcaacaaatataatcaattaatatttttactaaaaggcatttcaatggagaaagaatagtcttttcaacaaatgttggaaatccacattcagaaaaaaaacctgaattcatattttacaccttctacaaaaataaactcaaaatggaatatagagctaaatttaaaatgcaaaactactaaacttctggaagaaaacagaagaaaatctttaatgatattgggttaggccaagagctcttacctatgatgtcaaaaaccacaagccataaaaagaatgggtaaattggacttcatcaaaattaaaagcttttgctctttgaacaacaggattgagccaatgaagaaaagccacagattgataaagaatattcagcagtaacatattcagtaaacgatttgtatcctgaatagataaagaactctcaaaactcaaaataagaaaaatggctaattaaaaataagaagttatttgaacagacacttcaccaaggaagatatgtagctatcaaataaatagacaataaaatgtcaaaaaaaaaaccacacaaaacaacaacaacaacaaaccacttgctgagtgtggtgcctcacacctgcaatcccagcaccttggaatgcggaggcaggaggatcgcttgagcccaggagtttgagaccagcctgggcagcatggcaaaaccctgtctctataaaaaatacaaaattagctgggcatggtggtgtgtgcctgtagtcccagctacttggaggctgaggtgggaggatggcttgagtccagagcccaggaagttgaggatgcagtgagccgaggtcacaccactgcactccagcctggttgacagagcaagtccatgtctcaaaaaaaaaaaaaaaaaaaaaagaaaaaaaaaaacagtacttaggagtcttacagtagagaggctcaaaagcagacagttaccctgaaatatggcaaataggatgaaagagaattgtaggatcaaaaaaggtggtcaatttagtgtcagaaagcttcccagaggaagtgacatctaagtggggatctaaaagatatgcaggaattaatctcattacaacctgagtgacagagtaagacactgttaaaaaacaaaaacaacaaaaaaacaaaaacaaaaaaagcatttgtagtaattaaccaaaaggatagtaatcatatatctttaaggaaaaaaataaaaaatcattgctagtctaaatctattttcattataaaccgaaagcaacctcaaattgccccttaccattacatgatatttcaatatatatgttttcattcgtagagctatttgcagattaaagctaggttataaatatgagctcattcaattcctatacagataacagactttaaggctgaagttaggtgatcatgaagacttgaacttttaaacattcttattggtttaggagctcagatcacacccattttccttgtggccgattggcatgtttttgtctgagttgacgcatctgtgtgtaagtgcaactacctcaagaaatggctaacttaaacggtaccttcagaggcactgaaacgtgaattatcattctaccccatcattgcatttcaactaacaatgaactcttgaaaaaaaagatgataaagagttttgcttctgctaaattctacttgaaaacactgaacctctaactgtcattgttcaaataatttttttccggctttcttttcccatcctgttatcctgtcattgtatgtgtatttgaggtatcacatttaatctgttctgtcttctattactttgaagaaattagatatatatctcaaatctttgtaaataaatcagttacataaagatatattattcagctgtcaacactgtctagaggcaagtctttaagaaagttgtgtataattattcgtatgtagctttgcaggaaatgacaataatcatagctaacagttgttattccttacgtgccaggcactgttttaagcactttacatgtatttcatcatttaattctcgcaaaccatatgagttagattctgttgtcatctgtagtttacatacaatagaatagaggaagaggtctatttggtaattcacagaaggacacataattcgtatattgtagagtaggaattttaaactgaggctctgtggcttttgaaccaatgtttttaaacactgcaatagataacaaagaagatatttccctctttgtcaaagaaactaaacctaagtaaatacctacaaagaaaggtagcagacacaataaaaacaccaacgtgtccagttttaatcagatagtaagttcatacacataaaagggggaggtagtgagactgaagatgtatgaaattattggactagagttgggtaaagatagttcaggaagacttcacagagatggtgagactggttaaattttgaagagcaaggtttcattagaatttgagtgcattaacatgtcaagagcttagcagttgttatcattgtattttattttatttttatttttgtggagatggggttttgctatgttgcccaggctggtctcagactcctggctcaaggttattttaaattctcacaaaaacataacattatagacatgaaaagtgaagatcattcatttggcaattatttattgagcacctacagtattaccaagcacacatctaggttctgtgtctggtgcacaaaacaaatttttgccttcatgcagcttacttatttctcatttaggcaataacttgcccagggtcacatgattagactactagacagcaaagtcagaattggaacctagatctagctgattataacacatatttttatttgtcattatagcatttcaacactcatagtttacatttaaaaggcaggagaagattttgggggagaatgagggacatgtaaacttgattagaggaaaattaaaactcaaattgttccctagaataccaagaaggtaagtatgctgtttaaagaaatgcttcaaaattggcagaaatgaaggtaattttgtgaattggatcagtgcctcaactgttcatttggtgtcatttgagtacttacttcataatatgcttcaaaatgattatttaaaaataattaggcctttgggtgtcattaaggtacttagttcacagtatgcttcaaaatgattactcttgcttccataaatatataacttttttgcagtcatgtatttccacaatgacctctgatctctagtttgaaaatattttcttgctgtaattttcttcacccttcaaattcctactcactccaaatttctggaaagatctgctatggtaagattcttacctgggctctacttttcattaaaatagaaaacaaaaacaaaaaggaaataacaactataaaacggaactaatttcaaaaagactaagaccgttaaacttaagagatgcaaactgatacctgggagcagacatatcagatatataacagcatcttcaaattgctaatgcaagtgagcatacaccattaaatttattaaagttcagacactttttaatataatgatacagaaactctcagactttagatatttagacaatgaataagttagaatgaaataaagcacttaaatcagtaatttttggatttaataccttagacagcacatgtttattttagtacaacaaaggcatgcacaaatcagaaaaatattcaaatatatttgaaaatgtattatgtaatttgtgaaaatctcagtatctcttatgcaataagctgcatttttacttacagcattattattttttcttgctattcttagaatatcttcagatccccttccaagccacctagtaaatgttctccaggtaccttttgattctctcaaaagaaaagcgcatgccttctggtccactgtaccagaattttaaggctcatgatcaataactaattgattagtgcaattcaccgaagactatcataaacaaagagtagctgacatagctctgtacataaacacagagtagctgacaaagctccatttttgcatacagattggcaaaattcccaaggggcattataatgttgcatttagttagctaccactgaagtcacaatatcaccctatttctctcccaacagaacccaaccacagatgttcccatcctctgttaccagcctagcaccccttctttttgtcactcccagttgaattgctagtcggcttcatccacagtcaattttcggaacccaagaaattgtttcaaaatatttctaagttccatagtagcaattagatcttctaggctcatctaaaaaaaaaacttgtattattatgtaatatttgataactattaaaaatacatgattcaggacaagatggagtagactcacttttccctgctgatctcctctaaatacaaccaaatacccttataaataatttgatagacatttataaaaaacactctgaaagtgcaaagaagatgaactggctggggaactcaatacttgaagaatgacactctagtgacttccctgtggttttttttttatctccagtaccctctctgggtactggagaggcctgtaactcaggatcaccaacagttgtagacaaaaaccaaagaaaccaaagcaggaacttagaaaaagactcatatccagtgacagggtgggcccatctcccaatagcagtggaaacagtcctgggcacaagacaatgcattccccctaagattaagaataaggcaaggatatcaatgttcaccactgttatacaacataggactgaaagttgttttaagtcaccaagtttgtggtaatttcttacagcagtcataggaaactaatacatttgtcttcctttgttgagtagccattgcaataaggcaaaaagaggcatatatattagaaagaaagaagtaaaacagttcccatatgcacatgatgtaattgtttttgtagaacatctcaaagaacctacaaagaaactcctagaattaatgagttcaacaaggtcacaagggtataaaatcaatgcacagaagtcaatgacatttttatattaacaatgatcatatggaaactcaaaataaaattcaatattatttactatcacttaaaatactcaggtctaaacataataaaatatgtgcggaatttatagttaacattacaaaatgttgatgcatgaaatcaaagacctaaataaatcaagaggcataccctgttcatggattggaagagtcaacatagtaaagatatcagttcttcctctattagtttgttagagctgccataacaaactaccacttactgggtggcttaaacaacagagttattttatcacagttttggaggctagaagtcagaggtcaaaatgtcggtaggattgctttcttctaaggtctttctccttggctttgtagatggccatgttcttcttgtgacttacacatggtcttccctcagtactgtgtccacttttcttcttcttaaaggatactagtcatattggattagggcccaccctaataacctcattttaacttaattacctctctaaaggcactacctctaactacagccacattctgaggtactggggttaggacttcaacatatgaatttagggggacacaattcagctcataacacttctcaaatttatttaatgcaattcctaccaaaactccaaaaaggattttaagacatgatcaagcttgttttaaaatttatatagaaagacacaggtaggtccttgaagaactaaaataaccttgaaaaagaatgcattaagaggaatcactgtacctgatattaaggattacaagacagctgcagtaatcaagataatatcatatttgcagaggaagggacacatagatcaatggaacagaacaaagaattcagaaatatacccacataaatatgtccaattgatttttgacaaaggtgcaaaagtaattcaatagaggaacaaatggtgccaaagaaaatggtcctccataggtaaaaacaaatgaactttgatctaacttgatacctatacaaaaattaaaacagaccatagacttaaatgtacaatgtaaaactataaaacttttagaaaaaaaaaacacaaaattttcagaatctagggcttggggtagttcttagatttgacagcaaaagcccaatccataaaatgtaaaaatgtgtaaattggactttatcaaaatgaaaaacttttgctctgcaaaagagccctttaaaggaattggaaaaccatctacagcgtgagagaaatatttgtaaatgatacatccaacaaaagaagaatgtattagtttcctatgtctgctgtaaaaaaattccacaaacttggtggcttaaaaccacggaagtggccgggcacggtggctcatgcctataatccctgcactttgggaggccaaggcgggtggatcacctgaggtcaggagttcgagtccagcctggccaacatggtgaagccccgtctctactaaaaatacaaaaatcagccaggtgtggtggcaggcgcctgtaatcccagttacttgggaggctgaggcaggagaattgcttgaattcaggaggtggaggttgcagtgagctgagatcgcaccattgcactccagcctgggggacaagagcgagacttcatctaaaaaaaaaaaaaaaaaacacggaaatttattgtctcccagtcctggaggtcaaaagtctgaaatcagtactattaaactgaaatcaacttgtctgcaaggtcatgctccctccctccagagattctaggagaatatcctttctttgggagttttagattctggtgactactggcattccttggcttatggccacatcactcccttctctgcctctgcaatcacattgccttcttctcatctttttgaaatctatctctgctccccttctctgaggatacaagtgtttgtattcagggcccacctacatcatccagaataatctcttcatcttaagatccttaactacctctgcaaagactcctttttattgccatatgaggtaacattcaaaggttccaggcatttggacttggctattttttggggggtcatttttcaccctactacaactggtatatagaacatataaataattctcaaatttcaacaggaaaaaaataaaattttatttagataatgagcaaaagaccaaaaaacacatttcattgtacagaatataaaagatgtttgacatgagttattagacattaaggaaatgcaaatttaaaccacaatgaagttttgtaaatcccaaaactttaagaggatagcatgagaccaggagtttgaggacagcctgggcaacattgcaagatcctatgtctacaaaacttaaaaaaaaatagctgaatgtgggggtgtgtgcctgtagccccaactacttgggaggctgaggcaggaggattgcttgagtccacgagtttaagattacagtgaagggatcaaatcactacactccaacctgggcaacagagcaagaccttatctcaaaaaaccatacaaaaaaccccccccaaatcacaatgagatactactccatatctatcagaatggctagaataaaaaatagtgacaaaactaaatgccaaggatgtggagaaactggatcactcatacattgctggtgggaatgtaaaatgggacagtagctttggaaaacactttggcagtttattacaaacctaaacaaacaactaacatgcaatccagcagttgcactcctgggcttttatcccagagaaatgaagatttatatttacacaaaaacctgtccactgatgtttatagcaacttgattcttaatagccccaaactggaaacaacatttaacaggtgaacaagctgtggtacctccataccatggaataccacgcagcaataaaaaggaatgaactattgattcttgcaacaatcaagatgattctccagagaattacgctaagtgaaaagtgccaatcccaaaacatgacatgctgtatgcttccatttataaatatttctatgacaaaattatagaaatagagaccagattaatgcttttcagggtttaaggatggggagcagagaaggaaagtgggtgtggttataaaaggccaacaggataaatccaaatggtgatgttaatgttctgccatcttggctatatcaatgtcaatatcttggttgtgctattttattataattttgcaagatgttaccattgcagcaaactgagaaaagggcacatgtgatctctcggcataatttattgcaactaactgcatgtcaatctacacttatctttaaataaaaattttaattaaaaaatgtatatataaggcatatataagttgtgaagcaatccagactcatttcatactaagacctggaacttccatctctcaggagaccttgatctctctagtgaggaataatacatagaaaatataaaaatgtataataatacatatatgtgtaatatattatttaaatgctgacagcagaaaatagatatctatatacaaattgctactattttagaaattacatccttcaatgaggacaatgtttataactaaggttataaaaatttaaaaaacaactggagttaatggtccttgtcatcattctattatggattaactcagttttcaattaaattgtgaaaagaaaaccctattttctctaaataatagtccatagactgtcacagtaccaccaactccaaatttatatttcaatcacatctcacatattttcagtagaattgtaatttttttgtcaccagtttagccacaacttcataatcttcaaaaacataatgaaacaaacaaacaaaaacaaaacaaaacaaacaaacaaaaacaggagaactccaaaatgtataaggccaagtctttatctttcttttgtaaattctactgcagccaaacaagtacccaaatcgttcaggtaaactagacactctgtgcctatgaactcaacttgaaattctatagtgatagtgctccaaaaagccacccaataaaaactaaaatctctgaaggtttgtattcaccaacataatttttttcctcgtctgcttaaagtcaccaatatgtaggtattaaatagttcaaatgtgtttagttcaaattttgctaacagaattgttatattctacaatttcaatttgcaatcatcattttattgtttaacaaaaacaatacctagcctaaatatttctattaatgcatattaggaaaccaattgcccttgccctctctacttcttgccagcctgctaagatacctgtaaagaggtagatgtgtgttctccaccttgtaaggttaggaggaataaaaccttaaaaaacatgaacacacatacacacaaacacacacacacacacagaaataataagcctttgcccagccacataccatgtaatcctatgcctctttttcctgcagatttgctactctaagttttaataatgaccacactcacatcgtgaaattatacaccagtttattcaaatcaatgtacaaattgaatattatcacatttattttgttcattggaaaagacaatatgtcatttcagtttattttcatttttaaacaccaatatttaagtcttaaaaggaaataaaagtttacaataatgatgaatgtcaaacttaaaggtgtttgttatctggctgggcatggtggctcatgcctgcaatctcagaggtttgggaggccaagacaggagaaccatttgagaccaaaatttgggaacagcctgggcaacatagttagacctctatctctacaaaaaaaaccaaaaaaatagccaagcatagtggcatgccagtagtcccagctacttaggaggctgaggtgggaggatgggttgagcctgggaattcaggctgcagtgacctatgatcatgccactgcactccagcctgggcaacagaatgagaacctgtctctaaaaaagaaaagatgttttgttatctattaggcctttcaaaaatatatggttttttctgaggttttcaagttatataagacttctatgccagccaccctaaacaaaacagaagaagcacaaatattactaaacaaattaatgcttcattaacaagcaaatcaccaatggtgaaaaaagaacacatttaaatcaaaatcagtactgatacagaggtaagaattacatccaggcacagacatttggagttattcccccatgttaaaaattccatcacaatgtgcaaaataattattaaatcttctttttgaaatatatccccccacttttgttttgcctgatacagatattttaaccttaggtgtacagaaccctattaaagaacccagattacaattttttatcatttacataacagtggcagttttctcccatgttcttgcacaaaaagaatttattttcacataaattacaccctgcatttttcaatagtaggaataaaaaatactcatgttcaggtttacatatatttaccatgactaaattggaacaaatcagctcacagcttcctcatgcctacagttcaaattaaatttcctcttttatattcctagggcttctctagttgcatgtcaaacttttcagatcagctgtcttgattcctatcttttcctctccttgaaaaataagtgtatcttccatctcaaccatcctccttttcagcagcttccatttgattggtctggtaacttactatcatgagtatctttgtgctcagaggagacatcaggctgcctagtttactagatcttcatttattccttctaattttgtggtcgctctgctagtaacacattgtaaggtttagactcaatctaccccaggcttatttaaaattaaaacacgagtatatataaatattaaggttatatgtttaaaacttaactgctttggcatataaattgcatctataaaaatattaaatgaaaatttggcttaaaaatgtaacctaaatatagaccttgtaagtttaaaataatccttgtcctcaattttctttaccaagtttccaaatatttacatcatctttaactttccacggggccccaattcgtcaatctcaactccttgagttgtttttttggattttaagtgctttgtacaaactcattgatgagtggaatggagccatgctctctggtaccttgcttgctctagggtctgatctctctttctcacacttcgtggagtaacaacttccccatacacttactgaacattggaaattaccactttattcccactccatggctctactcaacccaccacattaccatcaactcagattcatagattaggtgccatattaaatgatatgatacagcaggaacagaaaacagacatgccttcaaggagtttactatctagctggaaaagtagaggcaagacagtaacaaagatctggatggcaccctcactttggaaattggcagtcattcataagacacagatatattcggagtaaggagagggaagcaactgggaaaatatcctttccagtaataagcaaaaagcaagaggcaaaaagaaatgttaactatttaagtcacatacttgccaatctatgtagctttgcaggattaaactacaatttattattattattatacatttctatatggttttgaaatggttgttccacaaaggaagggtcctccagaaagtttctatagccttctttttgggtaatttttgcctaccaatatttgaggctaccagatgaaagtaatttctttttcaaagcaattggattaatttttacaagtacacggagtcaattcttgaacttctgattctctatctagacattatcataaaatatctgctatggagcactcatgatgctttcatatgtgttatttaatttaccacaatggaaatacacaaccccacatcttttatttttttcttttttgagacagattcttactctgtcacccaggctagagtgtggtggcacaatcacagctcactgctgccttgacctcctgggctcaggctatcctcctgcctcagcctcccaagtagttgggacaacaggcatgtgacaccatgctctgctaatttttttttattatttatttgtagagatagggtctcactctgttgcccaggctggtctctaagtcctgggctcaagcaatcctcccacctcggcctcccaaactgctggaattacaggcatgagttaccacatctggcccacatcctctttctaacagccatgatttcttttcagacaacaacatatttataattcatttgcaacacttcaaccaaactagacatacagaggatgtgggagacataggtttctcacttcattactagcatgcaacccatgcaatcaaacatctgtgccagaagtagattttaggttactttgttatggaaatgcattctccattttagtagcattttttttcttaattagaggaagtgctttcagaaattgcaaattacataatgtaattacagccattttaatgaactaaagcaagtaaacatcaatataattttaagatatttaaaattctttatagttttttgcttatctttctaagttagggctagtagtaataactacctaaataatttgaatcccttgagaatgcaaatgtattaggcttggttttctgttcacctgagtcaaaaaacctgtggatcagaaataagtctggtagctaaaattcctgtggaagttataaaagggttgttttttatcaaaatataagattatctatgtaaaaaggaactaatcaactggttaagtatgttaattggaatttggaaggatttgagaactggaagggagagaactaaaattgttgactagtaactttgtaaagccctagacaacaatcaacccatttcatctttacattaaaaataattatcattaactgagaatatactataaccccaggcattctgcaaaaaatttcacatgcgttaactcatttaactcttccaaaccctttcaaagaaatgtgtattatctattttttcatattttaaataaaggaaagtaatgtatagaagagataagtaatgtgtccaagaccttagaacttttcagtaacacaactgattattaagcacaggcctataaaactccaaagtccttgtttgtagtcattgcttcatgttatatgtcacttagaatgatcctttaatgaataactacattaaaacatagaactgataaataaggcaccctccccccaaaagattactctctatctctctctctctctctatatatatatgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatactatttgtacacatatatgtgtatatatacatggttttctagatatatacgcatgacagtgaattatctttgaaatttaattattccattaaaatggaatatatgcttataaatctttctggattttgtaattttgtcttcatttattttgaagaatgccttaaatccaaacccccttttgctagagatttatgcctttttgtaaaagatagatattgtcaaacctagaccagaactatatttgggaaagagggtttgggaatggatctagaaagtgtagatccatcatattttccactgtcatccctggggattttcaaggattccatcaaaagttactcactggagtccaagttgtcctaaatgttctcaaaacatatacagtttatgaaaataaacatgcaataaataaaatctccctgatttcttcgaattggttaatgaatggcagaagacaatcttctcatatatattaatacctccaaaatttgtataactagaggtcattctcaaagtgaaacaattttcttgtgtgtataaaggtggtaccatatccctagatagatggcatattaagccctagggtattggaacatattgttatagtggctctttggctgaattttgcctgcagataaattttgttttggcctagccaacaatttttaaactttatcatttgaatacattttaagagtgagttccaactttgctatcttttctaccactccccatcttcttatacccagctgtcctacccactgatattacctacctggtccctaaaagtgtttacatttgtgatgggcatcacagctgtgagcacagaagaaatagctttcatgttgatactccacattcacccctgtgctaacaaaggtcctctagccctctagaaaaagtacactcattttcccctaagtacttctagaagtcaccagtggttctctcgtgtgatcatgagcaaatcaattttcatcatgcactgctgcaattattctgggctttcatggagcacacatgtatccaccatcacccgtcatcattcatagtatctgctgggcattcatcatctaccactgggcatccatcatctcccatttggcattcatcatctcccactgggcatccatcatctgccactgggtatccatcatcatttgctcggcatctgctgagtaccgccatgtctgttgggcatccacagtctcccaccaggcattgtggtctccgctgacgctttgccatttcgccaccggtgccttccatgagaatgctggttacttctccagagtgctgtcacccggggctgccaaatctacaaaccctcaagataccaggtgtgctgcatttgcgtcagtattcattgtacttagctgtgttccttgcataaattaggaaaatgcccctttataactgtggcacattttgttatctaaacattgaaaaagcaatacttgtccctgtccccttcacaaagtccctctgtaaaacagctatctctgttttatctttctttgttacttatggttatcatccacagggcttacgtattccacagggctgatcttgagtctatacactgatgccttaattcctgtcctcaggcattcacccaaaaaacatccctctgaaaagcttagcaggtaacttgtcagccttgtgtacttgtatatacctagcatctactcctatatctggtctttttttttttaatggatagatgaaggcctccttcctctttgcaaatcagttcatgaggtgatattcttggaaattcccaggcccacatatcttcacctgtgaatcattactttgggtttgaaatgtcttctcccaatatcacttttccctttaacaatatccttaatcacttcactgcgggatctttatcctagagaaaaaaatttctttaccgggtaagtttccattctaaatacaaaaagaataatggtatcagtatatttaaattataatgacatatgtggaagaatacagtccagaggtcctgatttttgttcttatatctagagtcttctacctctggttatcctttgctgtttctctcttctatcctccttagaaatgtacaactttggctgggtgcggtggctcatgcctgtaaccccaaccctttgggaggccgaggcgggcagatcacctgaggttgggagttcgagaccagcctgaccaacatgaagaaaccctgtctttactaaaagtacaaaactagctgggtgtggtggcgcatgcctgtaatcccagctactcaggaggctgaggcaggagaatctcttgaacccaggaggtggaggttgcgatgagccgagatcgcaccattgcactccagcctgagggcaacaagagtgaaactccatctcaaaaaaaaaaaaaaaaaagtaaaagaaatgtacaacttttacatattaattactggtttaattccccaataaatgcacaaaataaataaataatgtaattgtagttaacattccagttctggttgcaaaaataatttcactacaggcagataggcagcactgtcaaagctaaataacaacggccaacacttgagtttttgctcagggccagacattgttccaagtattatacatgtactatccctatttaatacataaagaaaacaatgcaccaaaagtttaaatgctatcagtattctactgccaacaatgggacgcacctcctacgttttcttccttaagaggagacatcctctgtcttctcaagaaagattagaattccctctgtagtgtcaagttctggtgatttgaagattctcctcatttttctttttcttcttaaatctcactccttcatggaatcaatctttctttctttctttctttctttctttctttctttctttctttctttctttctttctttcttttccttccttccttctatctttcttccttcctttcttccttccctccattcatcccttccgtccttctctctctctttctttctttcttttttctttctttctttttttttctttcctttcttttgacagagtttcactgtgttacccaggctagttgtgaactcctgggctacaacaatctacccacctcaggttcacaaagtgctgagaatacaatcatgagccaccatgcccagccttggaaactttcagtgatttttatattgtctgctaatgtgccaattcctagagagctaagttctcagtccttacttcatgaacttttccctcaaagcctgtatgtctatgccaagagccttttaactgggttgaatgatggtggtgaaggaagctattataacaagtactataatagctaactttaattgaacacttactctgtccatttatcttattcaatccacacaaccaacatataagtatttttcccactttacagatgagggaaattgaggtatacaattttacctcattttagggccacaaaaggctaatatccatcctcacatcactggtattaaaggtcccattctcccagctagccagagtgctatttctgccaccaacccatggaaatgttgaacatactatgttcctgaaaaacaacaacaacaacaacaacaaatattgattcttgcttgatgtcttgatatggctctagagacacagagtaacataactaaggaaatagtcttttgtatatttaagggtaatttctccaagccctaccataatactaatagttaatagttattgtgtacttattagtactgtacatggtcctagctgatacacactgttttagaaccatagctttactcaaaataattttatttcagttcagttcagactctattaacacctgcctaagacagtttgaaggcccagattgcaatgcctctgctatcatgcaattagaaatggaattaaggagaaatgggaggggtcatgatatatcttcaaagacttgaaggattttcatactcatacgcttccaaagacaaaagcaagataaatggtaaaagatacggaaagaatcagcttagggttcaataaaagctctgtctttcaaagagaggacaccaccagccatcactagtggttatgcaaagaatttgtgcctggaataagagcttgaactagattttttttgaggttgtcttttatgtcttaagattctataattaagatacctagttatgccactttgaacaagttactcaaaatctgaaagtatcattatgaagttagaagtttagtgcttttgtcaatgatagggagatgaaaataagaacttctatttcatacaatagtgttaatttcatatgtgcttttatgttcctatgatctttataatcagtttggttagtcccagcaagagatcatagatgaaaaacctagtcattaattatacattattttaatactcagaagacattttatccttgttgccatctaagtgaacataaaagaaaatttgcttagaatgaatggactatatatccataatcctcactcttaaacattatgcgatgaataagaatagcctacttagcttttatcttaaagggcagtaactctatcttgaaagttgtctttcatatgctgaatagaatatattacaactatggatcttaattgttcgcatttttctgtatgtactcctaacagagtgcttgaactgtgtagtaaaaggatcattgggctaatcattaaaagttagtttctttcttttcctctttagtcaaatttccatattccttgtgtgctgaagtttgttttgtatttcaaataaaacctatcaaaaatctaaaatctttgccatctagttattctgcattcaaaatgtagtaaagacaagctgcttactcaatgctcatataacattaagtccccaaagtaaacttaatgaattaagttttcccatgacccaatgccattgtttcttttaaaggaagagcatcaacaagacaatcaagtttgaatgaaattgattttctaatggagttctttttactgagaaatatttagtaacacagatattggagacagaatttttattttcatcctgtttatttctgtttttattctgtagtaacatgttatgggatatataagagtttttatgggagcatgtacaattgcaaattagccaagccactgaagattttatattgctgttttttatgtaattgataagatcatgacaaatgtggttttttgccctatttagaataaagcagaaagagtattctgagttcgtacttagagtatacatgggataattagaacaggctgtcttctgcagagcaagaggtttccttattctagatcatattcattcttggaacccaaaagcttgcactggctaagaaaaaacctattttctcctcaaaattctgtagaacaaaactttaaaggggaattaatttagaggcatttgatattcattaagcacttattcattttctattttactttaaccctatcttataccccatattttactttaaccccatcttagcttaatatctcctttatattgatagggaggaaaaagtttctggatttactattttaagagcaagtacaaaggacaaagctgaatatgttctattaaactaatagctgaagctaacttttatgtatttaattttgtatgaaaatatattcaaaatagaaggtatataaaatatatataatgaaatatatatataaatcaaatatatttaaaatatatataaaataaataaatgaaatatataatgaaaagtaaattccctgttgtttgaagtgtttcttgtgatggaagaaaatgaagtgtctaattttgaattcctcataaacctgattacaaactctgtgtatacatgaatttcaccagtgagtggcacatataaaccgttgtaatcaacctcagtgttctgttgaagggcaactggagtaaaaaataaagatgacaaattatttccactaaacattatagtataatttgtttggttactaataaaaaggaaattgctcaatagaaaattacataaaagctaaacattgataagttaatcatatacatatttaaatttgatagtttatagcctttagcattaattctggctaagaaatactcttttttaactaagtctttttgatcaaatgactcttaagtaatgttatattagtattttgattttggtaagtcactggttatctctacaaactagattctcttttataaatgacttttactgtgcatctatcttgataagtattttaacctacagtatctcacttagcatctgcttcacaggtatttgtgaatattaaaagctgaatgtgaaaatatttagtaaattttaacttactatacaattttaaggttatcattatttttagtattacattaaaccaaacccctatttacaaacaaaaagatattatgcatataaaaatgtaaattatgtattttcacgtgtaccaaaacaaatgttctagaagtagtatattggttcaaatataatgtaatataatataacataacataaatatatattttctcagtttaaatacaatggagtaaggtaagcttcttgttatttaagtggaatatgaaaattaaatgaccatttccccaaacttatttcattgaaaaatattaaggcaatttttgaagaccagtgtttcataaataaactttttagcgtgtattactatgacaagttactcaattggcttttactctgggttattcaactaaaagtttcattttcagtgactcataatattgtttacacataatttgtaagctctatttaattacttatgtaaatgactaaacaaaagatggcaaatgcagtgaatctaagactgtacttaattctggtgtaaactattctaacaatgtaattaagagctgtccaatttacactttgaagtaaacaaaagatcttacaagagattgcaagtgccatcatatgacacttctagctttacctcatgttcccttgcagtttttttcagacatgtgttaaaactatttgaaaaaaaaagcagttaatttaacagtacacaaaggtgatagttaataggaaaaataaaattgtaaataaaaaagtagtgaaacagcaaagttaaacctagactcaccttactttcttacctattgctattatttattcaatgactactacagcaaagctgtggccttgaggaaatgattttatgctatgaatacaataacaataacaaaaataaggctaataatacatataggtacagtatattggattccagctagatgccaagcagttaagcataacaaaattaggaaaggtagttattattattcattaaattcctttttggatttttttcactatgtttttattttattttatttacttaaaaatagtattagtgtttgctctggggcttacaatatacatcttttaatttttattcctttttaaaattgagatataaatcttataccataaaattcaccctttaaagtgtacaattcagtgatttttagcatattcacaatgttaggcaaccatcaactttatttaattacagtagaatttcattatcccattttcagtcactccatatataatatgcatcttaatttgaaacaatcttgttaagattaacattaaacttcaatagtatgtagacatattgctccaatatacttccatttcttcccccttctttgtgatatcattgtcatgcaaattacatttttatacattataatgcatcaaaatagttttgtgttttttttcatggagttgtcttttaaaccatttggaaagagaaaagagttttcattcatgtggattcaagttaccatctaccttttcatttcagttgaaagattccctttggtagatataggttaggtatgctgactacaacttctatctatttttttattttgaaacatctttctctttcatttttttaagaaatagttttactggaaatagaattcttggtagacagtatttttctatcagcccttcaaatatgtcatcccaatgctttctggctctcacagcttctgatgaagtcaactgttaatcttatttgggtccctttgtatatattgagtcatttatctcttgcttcttccagaatttgctctttgtcattgcctttcaactatttgactatgaagtatctaggtttgtatccctgagtttatcctaattggtgttcattgagctttttgatgtgtaaattagtgtcttctatcaaatttgggaaaatttcagccattgttttttcaaatatcttttctgtatctttctaacctatccttctggactcccattatgcataatttgatggtgtctcacaggcctttgaggctctgttcattttcctttattctctctgttcttcagatgggataatctcttttgacttatcttcaagtttatcttcaagtttattgtttctttcttctgcctcctgaaatgttctattaagcctatctaatgaatttaccatttcagttattgtacttttcaacttcggaatttttgttcttttaaatattaaattaatttgtatatctttactgattttctctatttagtgagcattatcatcatagttttctttaattctttaaagatagtcttctttagttctttaaacatatttatatagctgatttaaactccttgtctgataagtccaacatctaggccccctctgtacactttctattgacttctttaattcctgcctttatgccatactttcctgtttcttttctcttttctttctttcttcctttttttttttttttttttgaggtagggtctcattctgttgcccaggctggagtgcagtggcatgacctcagctcactgcaacctccgcctcccaggttcaagtgattgtcatgcctcagcctactgagcagctgagattacaagtgcctgccacgacacccggctattgtttgtatttttaatagagacgaggtttcaccatgttggtcaggctggtctcgaactcctgacctcaagtgatccacccacattggcctcccaaagtgctgggattacaggcgtgaaccaccatgcctggcatacttccctgtttatttgtatgtcttacaatttcttgttgaaactcggacattttaaataatatattgtagtaactttgaaatcagatctactccaacctctagtgtttattgttgtttatgagattttgtcctcattgctgcttgcttcagttactttcctagaatacttctatagattctgtattccttgcaatatgtggctgctattttctctggtagcatttttctttgatatttgtttttatttttaatccttcttaagagttgcccctgaatcagcattgtttgtagtcagctaatgattgttcagaatattctgttaaatgctatgagccagtttttcttttaccctgttccaaggagatttttgtgggaggtcacaccttcaaatttcagagaatttacaagtcaatattagcttttacttcctgctcgagtccagcatcaaaggtagctagagatgagttgttggtgtcctctctgagttttcttgggcatgtgtacagacatacacatttgtgcagccttttagatttcctgaaatatgctggagcattttagaatcccttatgttggtccttttgccattaccgatgtattccttttacatttttagccaacttcttgtttgttacaactgagttcacaggcttaggcaactgcaatgttattaaatccagctcatgttattgttttcaaaactctggagataaagctttttctgaagaactgaactcagagtcaggacaaatagcccaattacctgggaataatgtgtttcaaaggaattattgtaaatattgttgaaatattgaaagtgttctaaggatggggctttacatgaagctccaaaacaaatcagtccccactcaactggctggttactgtgctctgttactgtggtgagaggggaatgaaagtagccccaagtgaaaacaacatagatcccactgttctaactgaagttcagtagactgtttttaaatgaatatcttttaagccaaatctatacctttagttaatttccaagattctaaaacagttgatttttgtagttttgcaagtatttttatagcttttgtgagagaaagaattcaccaaggttgccattctgtaagttctgttctcataagtacttctttatacaccttgaattataatgacattttaaacataatagcataaaatgattttactgcataaagttaaaatgattatttcatatcatctactacctaatctgtattcacttttaacaaatgactcaaattaggatataaattagttgctttatttaaattaggtttccaacaaggttcacattttgcatttgttttttatgaaactagatttttgtgtatgtgtggtggcggggcggggcgtggtggggggggccttgattctgacctttaggagaggaaacatttttcagagggagacaaaaagtcaaagaagtacttcaattgttggggagacttgtacatgtttatgggatcaagggaaatcactatactttctggcttaagaaacagccctattcatgtcttgtccaacaaaggctagtaattccaggttagcctagggcccaagagatgaagcaaaagctgaaactgggaaaagaataaatttagaaagggacaaggtcaatgaggagagttggtagggatataatattattaagcaaatcatcaataatgtaacttggatttactttgggatgccagactcttggtggattactctttcttgtgaactatttcaccattctgcatttttacattttccttcagttggttaaaactacgggatggtagagtactgaagtcctagcttcaatttccagcttttccagtaactgtgtgatccaggttcagccacatggcttctttgagcctcctttgatttgtgaaatgagaggactgggttagatgtctctaaacttgattttgtctccaaagtatgatttttctaagacctttcttaagcaggtatatgcaataagtaaaaactgtttttagtaactgagcttaacatttttgctttcctcaccctgaaaatcaggtacacaagaacttctttccccctttcccattataacttgttttatggaaagaatcttaaatcagaattaaaaactggtaaacacagtattaataagatagaaatattaccctttcctcccactcaaatctcaaaataaagcaatattactgcaacaaggtatacttcatttttgtagtaagagccagtttcataagtgaaactatatgaaaaaataactatgggagttaaagcaaaatagcgtattgtgatttggaatagccaaatacattttatgcgtcagttttccaaaagttaaattttaaagtaatcttggttaaattagaatacagactcttaaataatctacaaacagacaatttttcagataccatggaatcataccttttatcaagaataacagttgtttgtcagtgcactttgggatattgagcagatattttggagatcacttatgctgaacaatatgatgcatttattccaaaaattacaattgcatattttttgtattacatattttagtcagcaaataaaacaactgcaaccacagaatctattcaggaactagaattaaacaagttcctttagaaactgattaaataaaccacataatttccaaaatgcctttcactttgtgcacttagctttggtttctaaaccccttctgaaacagatatctaaatgaaattaaaatctttattttacacagaggcttcccatcccatcccaccctgtgtccaaactccatcatctttaacactttaagcagttattatgaacccagaagccactaggatagagatgttctaacaaagatcaaagaaaacaaaaatcattgttaaattattataacccgtgggtcaaaccacaatcaatataaagacacttattgagtatctgctctttgtcagcactgaacaaaacacagtgggatgtcataatatattagtcccaatccctgcttatgagggagtttataatataattatgtgtatgcatatgtgtgtttgtgtgtgttggttggaggcagaaatttatgtaaaaaataatgaacaacatgaggttatgtgctaatgatggaatgcatcgaataaataataggtggttaagaagttcagaggaggtacatgtctccctagtcaattggtaagaatagggctcacaatggtgcaatttaaattactataataaagtaaatgggatattttcccagctcccaaattaccacatagacgattgttttcatacttattatatatagtcataacgtcaacccaactttgaagggaaatagagaaacccaattttattgtagttacaccttcaggattgcattttgctactaataatttatacaaaatgtaagtgcttatatctctgtaacttttagagatatattcttaacgcagtgttaaactatatatttttgtgccaattttaaatagttttatttaagacattgcattttccacttacagtacagtgcttataaagtgcaatgttatttccctcccctgtgcacatgttgcatattcaagtattgagaattcctagtaacttactacagcagctgaacttttaaacactgccacagaatttgctacaaatttaggtccttcaatgttttaaatgtgtggaacaatgctacatctatatttatgttggcttaatcaacctcttcagtgatgggccttgaggaagcaccactagagggaggagctccaccaccagggaatcccccaggcattcctccaggcatgcctcctgcactctggtaccgcttgctaatgatgagattgcagactttctccagctctgtctgctgatgttcaaattcttccttcttagcagcctgattcttatccagccatttgataacttcattaaacttgtccagaatcttctgtttgtcctcaccattaatcttaccttgaagcttctcatctttgactgttgctttcatgtggaatgcataggactcaagtgaattcttggatgacactttgtccctctgcctcttatcttcagctttgtacttctcagcttaccggaccatatgttcatgtcttccttgctcaaacggtgcttgtcattagtggtagtaatcgtgttctcttttcctacactcttgtccacagcagagacattgaggatgccattggcatcaatgtcaaaagtgacttcaatctgaggaacaccatggggtgcagaaggtatgcctgtgagttcaaacttgtcaagcaggttgtcatccttggtcatagcacactcaccttcataaacctgaatcagcacaccaggctggttgtcagaatagataggctgtcagaaggtctctgtctgcttggtaggaatggtagtactatgcttgatgaggacaggaggacagtcatgactccaccagcaagttcaataccaaaggaaagaggattgacatccaagagcagcaaatcttgaacgttttcagatttgtctccagataggatggctgcctggacagctgcaccataagcaacagcttcatcaaggttgatgctcttattcagttcttttctattgaagatgtcttggagaagcttctgaatcttggggatatgagtataaccaccaatagagacaatatcatgaatctgtgacttgtctagtttgacatctcgaatggctttttatacagggccaagggtgccatggaacaggtcagcattcagttctttaaattgggcacaggcaatggatgtacagaagtcaattcattcttagagagaatcgacctcaatactggcctgggtcctggaagagagagtatgcttagtgtgttcacaagcagtacagaggcgtcttatagctctcttcttctcactgatgtctttcttatacttatgcttgaactcagcaataaaatggctgacaattcggttgtcaaagtcttcttcacccaagtgggtgtctccagatttgacctcaaagattccatcctgaataatgaggattgacacatcaaaagtgccacctctcaggtcaaagataaacacatttctttcagctccaacctttttgtctaagccgtaagcaatatcagcagcacttggctcattgataattctaagtacattgagaccagcaatagttccagcatctttggtagcctgatgctgagagttattaaagtaagctggcactgtgaccacagcattggtaacagtcttcccaaggtaggcttctgcaatttccttcatctttgtcaggaccatagaggacacctcctctggatagaagattttggtctctcccttgtattctacttggaccttgggcctgtcagtatcattcaccatcatgaagggccaatgcttcatatcagactagacaacagcatcatcaaatctgcatccaatcagatgtttggcatcaaaaaccgtgttggtggggttcattgcagcttgattctttgcggcatcaccaatcaatcattcagtgttcataaaggtgacatagcttggagtggttcagtttccctgatcattggtaattatctctacttttccatgctggaaaacacccacacaagagtatgcagtgtcaagatcaataccaactgcaggtcccttcgacatggttgctggcgtgtagggccggctctgactacaaagaaagacacagaaacctccagaactgtgggcgcattcaatgagctatatttacttcttgaaagggaaaatagatgtaatttaaaatttcatagcaaatactatggaacaaaaaaatgatgtcaaaaacactacgattaaaaactcactgatatgctgacaaacatattacctcaactatcatctgctgaattaaaacagcaccaaagcgtaagtaaaatgacaatgaataaaatgaccaataaatgtactaatgcccttacaagggctccctgtagtacttagtaatgacaattaagaagtattgtgattaggtactaaaaagttgatctatttccatactttttctgaagattttcctgactgcccttttctgcatttatatttcatctacttctagtccagttagttttatatttatgttctaagacatgctttagtctgaacagttcataaggtctaagaggaaaatgacctttgaaggcactttctgggataatgtgtcaaaatttcaggccaccaaatattattgaatgcccattctgtgttaagcattgcacttggcattatggaatacagagatgtgtaccagggccctagcctccaagaaaatgcttcacttttagaaatatatttaaataatttaaaagggttatatagtgtagaattttctaacttggtgtgactagataaaatatctaattttcaacatcagctttgaataacttgtggagaattttctattggtatttatttattcatttattaagacagagttttgctctgtcacccaggctggagtgcagtgacacaatcttggctcactgcaaactccgcctcctgggttcaagcgattccccttccgcagcctcccgagtagctgggattacaggcacgcaccaccacacctggctaatttttgtatttttagtagagacagggtttccctatgttggccaggctggtgtcaaactcctgacctcaggtgatccacctgcctcggcctcccaaagtgctgggattacagggtggagaggtttttaaattagtattgtccaaattcagtgactctgactaatggtagctaatggaaagctgaaatgttcagttccaacgaaaatcctgaggcaaatagtggttttgttacattctttaagagacagaatgaattcctgtagaaatgcataatgcctatatttacataacagaaaatgtttggcagaaaataaagtgctgtcattgtacgagttagtatctttctttctctgaagatattttttaataatgaaagtagaatgtactggaggtgccatgtcagttcatctgtcaataaacataaaataccattaactcaatggtattttccgaggtgttgtagtgaagtagaacttgagttttggtatcacatgaacataagtttaaatccctacaatctcacctttttaaatgacctcttatttctaaataaacattttctcacccacattagcagggaaatagcatggtattgagggttagaggttaagctcataaagtatctggattttagtacatgtgatattttaattattaacaaaattattcttaggaattgattttattagaacattattttagaagtgatcaggcaaattatattgaagttcacatggtagaaacttctgagaatctgtcctagttgagtggtaatacagtaggatgagataaagcaatgaggaaaaaaaggagaaaatcagccttttccaaaaaaaaaacaggcaaaaactgcaatatctcataagtcagcttacaaatggaagtgccttccagaccacagtacagtattggattagtgtttttgtatgctacatatatgtcttagtgaagacagaaatgattatacacaattcatttcccatttttcatgtaaaaaaaaagtttatgtctgccattatattatagaaacagagctatctagataaagcctcatctgtaagagataatgtctgaccttcaggacacagatggaaggctgtgctattgggccaggaaaatttgctattccaagtcagcaatagaaaacattaagttcctggctagtagtccagttcccattttaattctctttactatctttttgaactcttcataaacaaaagaaatgaagaatagatatatatagggccaagtgattaaacagaattaaaagttccgtatataaatcttatgttcttaattatagactgactaggctccccaggattccattttagaagatatttggcaaaacatcaaattgccacttggtgcaacatcattttttaattttctttaattgtctagacctgaatttagctcagtacagtagatatcaggacagtggaagcgcaggcagttaaagtttgtcatcttggggggaggctgcagctgatatcttaaatatttgacatattcataatatcttttgaatatatctctgaacaaccttgtaaagtgaataaaataggcaattttctcaaattttagacaggaaaactagattttgaaattacagatagtatgtggcagaacaggtactaaaagaagacttctttcccccttacctacaaccattacaaccacagaatatgttttttctcttgtgtctttcagagtgtacctgttaacagtactgatgttttccatataggttggtgcaaaagtcattgcagtttttgcagttacttttaatgacaaaagctgcacctccaatgcagctttttattctaagtaaaaatccttccaactcaagcagggtaactctttcacatggacattagggtcttgagcacattcagactcaacattgccagtactctggaaggccacagggatattttcgtagtcaggtactagcagctatctcaaacaacaagcctatacttggattacaacatctcttcagctcagattcttgttatcttttgttgcatgtcaacttatttgtaggaggattggagacattgggtacaagaagatactttgtaagtttatgaatgaattctgctctatgtaagatgatagactaggtttttggaggtaacactatcaaacaagtatattggatgtatatgtatatgtgtgtgtgtgtgtgtgcatatgtgtatatgtgtgtatatactgtcagccttttgcatctggaagttcaaccaaccatagatcaaaaatattttaaaaacaacgaaactaacaaaacaatgataaaaaataatacaaataaaaacaatacagtataacaagtattcacataagatttacattgtattaggtattataagtaatctagagatgatttaaagtatacaagaggacgtgcatcagttatatgcaaatattatgttattttatgtaagggactaaagcatttgcagattttggtatctgcgggtgtcctggaaccaatccctcatgaataccgggaaacaactgcgtgtatgtatatacactcacacacataggtatgtatgcatgtatgaaagtatcaaagagctcacatgagagtaaggaattagagagtaaaatctatatgaaggatggaacccagatgtgggcagctcaggactgagcagctattgtcttgtggaaatttgcttaacaagggaatttttaagtatgcagacaaggattcaaatagaaggttatcctcctttaagctgacaccctaaagagctataccataagtataaggataaaacagaggtaaacatgaaccacaacctcacccttagggtctgcaagaaaaggtgccttagaattgaggggaggagtaaacctgtccctgatcattttaaaccacaagccagaactcacagtgatttgtcatccagattcatatcaactgggttgtccagaaatctcaagctataaattttgttgataataattttggaatgtatgcccctaaaggtctcaaagaagcaaatgcaaatattctctgaaaagcaaccccattctaaaaataattttccaaagagaataagtagctccttgggaaacagcaacaattaggcacgcacaagttcaaagtaccactggtaagaggcagaaaaacaacaaatataataaatatacctgaaaaacttcaggcattgtatcatcagacattattgctatcaataaagaaaaaaactataagatgaaaaatttctacagggaacaacaacatctgttgttctgcttttaatttttagaagatccactttgttctttttcagataatccaggccatttttatagtaatttgtagagtaaattaagagcagtttaggcaaagctgaagagagaattcataaacagaaaattatcagaagaaagtgtcaaaaatgcaaaagagagggagatgttgaaaacataagagaggttaagaaatatgtaacataggctgggttcagtggctcatacttgtattctcagcatgttggaaggctgaggtgggaggatcacttgaggctacgattttgtgaccagcccggataacataacaagacgctgactctacaaaaaaattaaaaaataaaaaaattagcctggtgtggtggtgtgtgcctgtagtcctacctacttgagaggctgaagtgggaggatccgttcagcccaggagttcaaggttacagtgagctctgattgcatttctgcactctagcctggatggcagagcaagaccccaatctctctctctctctcttttttttttgagacaaaatctcactctttcgcccactttggagtgcagtggcgtgatcacagcccactgcagccttgatgtcctcggctcaagtaatcctcctgccccagcctcctgaatagctgggactatgagtgtataccaccacacccagttaatttttaaattttttgtagagatagtatctcgctatgttgcccaggctggtcttaaactcctgagctcaagtgatcctcccgcctcagcctctgaaagtgctgagattacaagcgtgagccaccacatcccagtcaaccccgccgtctaaaaaaaaaaaaaaaagtaacatacagtgagaagtaaccaaatgtctaattgggattgaataggaacagagaaagagattgggttagaggcagtatttggaaacaatatagttagaattttctggagataatcaaagacatcaaagacttaagaagaccaatgattacccaagcaaaacagataaaaataaatctacacctagatatgtcacagtggaactgcagataaccaaagacaaaattaaatcacaaaagcagtctgacaaaaatgcatattactcaaagggaactattaaactaatagctgacttctccaaaaaaaaaaaaaaaaagccaaaataatatattcaatatgttaaatgaaaataactgccaagttaaaattctgtatttagtgaagttatacaagcatgggtgtaaaataaatacagatgaaaacagaggaactttctaaccagtaattcctgtttcaggaatttgaaaaggaagtatttcagtaaaaaggaaagtgaatctagatagaaggtctgaggagcaaaaaagaatgaagagccaagtaaatgatgaatgtgtgaataattctaatgaaatattgacttataaaacaaaattaataatattctgggtgggcatggtggctcatgtctgaaatcccaacactttgggaggccaacgtgggaggaatgccttagcccaagagtttgagactagcctgggcaacataggaagaccctgtctccacaaaaaaattaaaagattagctgggcatggtgatgcacacctgtggtcccaactacttgggaagctgatgtgggaggattgcttgaccccacaagatcaaggctgtagtgagctgtgattgcaccaacgcactccagcttgggtgacagagtgagaccctgtataaaaaaaaaaggtgtcaaaatagtgtcgtaagtgagtacatattttaagaagataaaatacaaggcaagaataacataattcaaagttgaatttaaatgttctaaattcattgtattgtccaagaggaaagacacttattaacttcagactttatgaaacacacacacacacaaacacacattaatttaatttataaaataaccagtaaaagaaaaggaaaaatgtgtacaactttgaaagagaggcagacagaaaaactgagatgttaaaaaatgattaatataaaaagggtaagaaaggaaaggaaacaaaaaattagcagaataagtagactgcattaaataaaagagtagctataaacccaatgatatcagtatttacattaaatgtaaatggtctaaaatttcaggaaaaagttttcagactgggttaaaataacaaaataaaataaacataataacaagacaaaatgaaataagacaaaataaaaatgaaatctaaatctacaccatctattataaatacgtttaaagcataggatacagaaattttgacattaaaaagacagcaaaatacaccatataattagtaactgaaagaaagatggtatagctactgaaatagataaaatagctaagagagtaaaagaacattactggagacgtagctgttaacttcatagttatacaaagttctattcatcaggaagatacagcaatttgaaacgtgtatttatgcaatagcatgattaccaaatatataaagtaaaaactgacaggaatatgaaaacaaatagataatttcactaattgatagaacaagctggaaaaaaaatctaagtttataaaatatttgaaaaacatgactgacaaaagtgaaatgactatataatattctgcacccaaatgtagaatacaaattattttcatgcatacagggaacattgacaaaagttgactatttactaggccactgagaaagtttcaataaaattaatgaaatttaattcatacaaacactgttctctgaccgtaaacatataagttaaaatcatatataaaatgacaactagaaaattagcaagtatttggaaattactaaacattttgaaataatccatgaatcaaaaatcatattgaaaattagaaaaatttaaaaaactgaactataacaaaatactagatatcaaaacttgccagatgaatctaaagcagtgtttaaagcaaaattatcaggcttaaatgcatacattgtcaagaataaggctgaaaattaatgagcaaagcataccctcaaaaattaggaattgcagactaaattaaacctaaggaaaatagaatggagacaatgataaagacatgagcagaaattaattaaataaaaacaaaactgtatcaaatcaaaccaaacattggttctctgaaaaaaaaaaaaagacagacaaaccactgactagattgattaatagagaaaaaaaaaagaaagagaaggcaaaaacagtgaatatcaggaattgaaacaaaaggatatcactgaaaatgctacataaattaacataacaaaaggatattataaatgattttatgcccaaaattgaaaagttagaaatatgtacaaatatctagacaaacataacttgacaatactggcagtcgtagcttgtgaggtctttccaaggaaattaccacacattcgtggcttaaaacaacagaaatgtattctctcacagtctggaggccaaaagtccaaaatctaggttggttctttctggagtgtctaaaggaaaaatcatcctagcttgtggtagttgccggcaatccttgacggtccttggcttgcagatgcattacttcagtctctgcctccgtcttcacatggccttcttcttgtacatctcctgcttgcttaagttgccttcctttttttttttctcgctctgtcgcccagggtggagtgcagtggcgcgatctcagctcactgcaagctccgcctcccgggttcacgccattctcctacctcagcctcccgagtatctgggactacaggcgcccgccaccgcgcccggctaattttttgtatttttagtagagacggggtttcaccgcgttagccaggatgatctcgatctcctgaactcgtgatccgcccgcctcggcctcccaaagtgctgggattacaggcgtgagccaccacgcctggccaccttcttcttataaggagactagtcatattggattttgagcccaacataatccaatatgacttatcttaagtaattatatctgcaaagactgtatttaccaataaggtcacattttgaggttctagatggacatgaatttgaagggacactattcaactgagaacactgacttaatgggtcacagaaaatgttaatgcttttataatcattaaaagaaccaaatttctttccactatggcaattccagaagtagatggctttatgtggctggagagtgccacaaaacattaaggaaccaaaaatgtccaatcttatataaagcattacaaagaaatgaaagcaaaatgtcactcccaattttatgaatatagaataaccttgatattagtgagaaaaaaatacaagagtagctcagttatcaacatacatgcaaaaaatccttaaagaattagaaaattggtctcaaaaaattagaaaattgaaggaagcgacttatgaaaagaaaaatacattattaccacattaggtttatcttaggaatgcaaagttgatttaacattagaaaatcaattagtgtatttacagctttaacagattagatttgcagattgatatggagagaatggacttttccataagtggctctggaaacacagggtatcaatatggaaaaaaaatcaggccactccctcatactataccccaaataaattagagttgcattatagacctaaatataaagtacaaaactatgaggatttcagaaaatgatataggagaatatttacatgatcttgcagtaaatgaaggatttcagaaagcagcaatttaaagaagcaataaatctgactacattaaaatacagaactttggttcatcagaaaacaccctgcagtgaatttttatggaaattatacttcaataaaagatggggaaaattcaaaaactgtatgacacctggcagggtcaaaaaacaagccacagaggtggcaaacatatttgtaatacaagtacccagaataagagtagtaaccagagcatataaaaaacattgataaattaataagaaaatagcaaacaatgcaatttgagaaaaggacaaaggatttcaaggggcacttcacaaaagaaatgcaagtggacaattaatatttgtaaagatgctcaaacttagtaatcagggaaattaaaatcgcaattaaatgccagttagtagtcaccagactggcaaaaattaaaagtgtgacaatacttatgttggcaggcatatggagccataggaactcttatatacttcttgtggaaatgtaaattgatacaaactatactaaaaagcaatttagcattatatagcagtagaaaagtgtgaaccccatgatccagaaattccatgcttaggtgtatagcctacagaaagggttacacatgagcaccaagatccatataaaagaattatttgtagcagtattgctagtaattatcccaagctgaaacaacttctacattgtaaaagcagcagcaaaaaatactgaaatttatgcctttagtaatacaatcaagtattgtgcaggtgaagaagctgaggtgcaaagaaatgcaaatgtttaccccaaatcacaataattaagtgacagaggtaaccacttaattgtggctgcaagcaatctaacaccaaacctttagctattatattacactctgctgcctctcatgaatttgttatgggtggaaaggaataaaattaggttgaggtatatgaaattgatatttttgaaggttagggagttgaatattagcaatttgatatgactcagactaatagtttaaaagttctgagcccaattggcctgaaatcacatagtccagtgtaacagcctacttctccttaggggtctcagtttctaagttgtgttttattagtttaaaaaaaggtgggatttttgtttttttgtttttgtttttgggtgttttttgttttgttttgttttgttttttgcttttttcccctaaaagccatcattgctaagtattctggttgattctttctcctggttttcattttattaagtggctgtggcacaaaacacaggcgactgaagtgaaagcaattacaattttcgacatctgccaagaaatatagtctttggcatgcatttgtactagtcacccacttttgggcaacagagagtctttccaaattcaaagacccagacgaatctttttctggaccgcattatatcctgaataagaaggagccatctgtccttgggcctggttccccagaggactatatacaacacaaatccaccaataaaattgaaagagccttccaagatgttacagaagccaattgttgtagtacacattgcatcagtttgcatgcaataacacattgcatcaattttcatgcagaaaaatatctaccagaactgtattttaaggttttaagaaggcagtagaacacagaggagtatgaaaagcaggtcacgaaaaattgggttccagaaaatatttatgatttcacaagtcagaaatctgttgggtatggaaaaaatgaactgaaagtttataaatgctcgagagacctcatcttgaatacaggagattgaattaaatagcttagaaaaggaaaaatataaaacggccattcagttttgccctaaatggttctaatggttgaaagccagggttttcttttcatgcagaaataaagacatcaaaactaaattagaagtcttcaaaataggccaggcgcggtggctcacgcctgtaatcccagcactgtgggaggccgaggcaggcggatcacgaggtcaggagatcgagaccatcctggctaacacggtgaaaccccatctctactaaaaatacaaaaaattagccaggcgtggtggcaggcgcctgtagtcccagctactcgggaggctgaggcaagagaatggcgtgaacccgggaggcagagcttgcagtgggccaagatcgtgccactgcactccagcctgggcaacagagcgagactctgtctcaaaaaaaaaaaaaaaaaaagaaatcctaaaaaaattccctggaataatggggaaattaattttttgatacattttgagttcagataagggtttgaagaatgagaaaatcctgttaaagttcagggataagtcctgttgttgtttttttacccaatagtattaattaaactaagagaaaactaagtaatttcctgttcctacccctgcatttcctctcttctatctccggaccaactacagatttagactaaccatatacagtttggattctaataacgtttttacccttcatgagttcatgagtatggattcttttttatttttattttttgagatggagtttcatccttgttgcccaggctggagtgcaatggcgccttctcgactcactgcaacctctgcttcccgggttcaagcaattctcctgcctcagcctcccaggtagctgggattagaggtgtccatcagctgcccagctaaattttttgtatttttagtcgagatggggtttcactatgttggccaggctggtctcgaactcctgacctcaagtgatccacctgcctcggcctcccaaagtgatgggattacaggggtgagccacctcacctggccccatgagtatggattctaataacatttttacccttaatgaatataatcttcccaattcagatgaaatgaggtatagatacaagcaaagtcagggacatttttttcagacagtatcttgctctgttgtccaagatggagtgctatggcataatcacggctcactgcagcctcaatttcccagggttcaagtgatcctcccacctcagactcctgggtagctgggactacaggcatatgccaccatgccgagctaatttttgtattttttgtagagatggggttttgccatgttgctcaggctggtctcaaactcacagggtcaagcaatctgcctgtgtcagcctcccaaagtgttgggattacaggcatgaggcaccatgcccagtgggatatttttggaaaatattgtcaatatatctcatattcaaattttcatcttcctactttaacttaagtttggcatgaaatgactttattaatgtcagtcttttcaaagtaaactgaaagaactattcgaaaaattacagttctcaagaaagctgaggcctcctccttagtgacattatctcaagaagaaaattatttgcttcacacttttggcgcagggataattctataggaaagaatttgcaacagtttaattacccttttgtgataatttaaaaagaagactacttgagattttagctgtgccacagaatgccaaatattttagtgtaggtcttgttttgttactatgtaagagatttaagattaatgttttatcatactttacacttacaaggaacggaatatcctcgtgcttctcactgactgcaggcatacaccctataaaatgttgaggcagatattcccagggcttcaatttctcattggaatttaaagctttcgaaagtgtcattaattctttctcagttgattcctgcagggaggctgatctgttccaggcctttctcagaaagaaagaaaataattaactaattaacaataattagaagtgaccttgattgttaagatttaaaaaaatgttaacgacctctgaaaattaaaaaaaaagggctttgagcttagaacatagagaccatagaggtcacaaaaggaattattgctagcatacccacaactaaggtcaatattgataagaaggataagaagtttgtgtcttatccaaggactctcataaactcatgattcctcatctttaaaatggggatgatcatagtatgtgcctcacttgatatgcggactaaggcaccttaggtatgggatataaggaatcgtgtatgacgacaaagcacctgtaacagtgcctggcacatagtaagcaacatgtaagtattgcctactattattgtaaaataatatgtttagcattctaagaattttgttttatttcctatcaagtttttatatttatgtgcaggtacttaaagtgtcttttgaacaatatgctgagttaggtttgcacttctaagcgtttatattttggttacattttgcataaaataaattgtttattctgagatagactataagtggttgagtagtttgtgagagatattattgcattgtttttgttattcagtcatattagaacctaaaaatatctgtatggtacatggagttagatgtctgtcctctttttacagatctctagggacaagatcccatcccactcttctttttcaggataatcaaaaaccttatggtattcaagaagttccacaatagtttaaatgtgaatattcagttctatgtccttccaaatccttactcctactcattttattgcatttataatgagttttaaatgcaatttcttccctgttatatgcatatgtttgaaggaaataaagtttaaaaataccattacagtgaaatgttttacaaaatcaaaaagattcctaatcccagccaattaaccacttaggttaggtaatattgaagttgacccacctcattacagcaaaaataattttctactttatgggaattcattgtaataggatgtttgatagataaatagactttcattctatttgtaaaaattaattttagaagtttaaaaataagcacttaaaccaatgtacatgtctattagaggcatagcgtagaaaatgaataccccttttctttctctcatttagaaaatagcactgcttaacttccaacaatatattaaatagattatgacattttgtttcatctgcacttaatgaattacatgaagatttaatcacaaaaaagagtattttgcccatttcttcttattcacaagttttattatggaaaaaatataactattctttacgctcaagattatttagttcatcactggaacatttggaatttttaaaataagcaaatgagaggttgcaatgagctgaaatcacatcactgcattccagcctgggcggccaggggagaccctgtctccaaaaaaaaaaaagaaaagcaaacaaaatgtttcatatattcttctagcagtatcaaagaaaagaaattgccaagatccttttaaattctgaataaatatggctttctgaccatgccaattaatagcgccatgagcgcatcaaccaaacccataaatgggcttacataatacataataataattcaatcatattatagaattgatcataagatttgcagaaaaattaaatggaccaacacatttatcatgttctggtacgttaatctgaatgtgcttatgaatattcagatacaaacatataaatgagtataggaatgcatacttacataaaacatgtacaccaacacatcaaaattgacaaagcagtctatgcaaattttcttagtcggtctttaatccacaggaaatgaaactattattactttaagaagagataatccattgcattggtatgagggagagggagggtatggggtagaagaaagaagtgaattcttcctctcttctcagaaaacactggaaaatttcctcccactcccaagtttataactatttaattcaaaactataagcaggaaaatggaatagcttgagccaaattttcttcaatatttgccaattagagatcagaagttcattcattcattcattcattcagatactgagtatatatactaggtgctgggtttacagtgataaacaaaaagcatagtacttaccttaaaggaaattgaaatcttgtagagaaccacagacaataaacacacagacacacacacacacacgcacacacaccaaaagaactattatctaatgttttaattaaataattataaaatggctaaggaatttggtaaatttgagtttactagtccgtatttcccatacgtaaacttgatgcgtgatctttagatggccattttcattcattgtagtcacaattcttagaacatgaccatgtgcatcagaatttcttgatttttggatcagcattcaaaactcactgttccgtgtgatctttcttttagaaagacaaattctactactaagccccaaggtctatccattattgtccagacaaataatacttttccatttttggttttatttttattttaatttttttattttactttaagttctggatacatgtgcagaacgtgcaagtttgttacataggtaaatgtgtgtcatggtagtttgctgcacctatcaacccgtcacctaggtattaagcaccacatgcatcagctatttgtcctgatgttctccctcccctcacccacaccaacagaccctagtgtgtgttgttcccttcactgtggccatgtgttctcgttgttcagctcccacttatgagtgaaaacgaggtgtttggttttctgttcctgtgttagtttgctgaggatgatgacttccagcttcatccatgtccctgcaaaggacatgatctcattcctttttttggctgcatagtattccatggtatatatgtaccacattttctttatccactcaatcattgatgggcatttgggttgatctcatgtctttggtattgtgaatagtgctgcaataaacatacgtgtgcatgtatttttataatagaatgatttatattcccttgggtatacccagtagtggaattgctgggtcaaatggtatttctggttctagatccttgaggaattgccacactatcttccacaatggttgaactaatttcattcccaccaacagtgtaaaagcattcctatttctccacaacctcaccagcatctactgtttcttaactttttaatcatcactattctgactggtgtgagatggtatctcattgcggttttgatttgcattcctctaatgatcagtgatgttgagcttttattcatatgtttgttgtctgcataaatatcttcttttgagaagtgtctgttcatatcctttgccccatttttgatggggttgtttgtttttcacttgttcatttaagttccttttaaatgctagatattagacatatgtcagatgggtagattgcagaaattttctcccattctgtaggtggcgtgttcagtctgatgataggatttgtgtgtgtgtgctgtgcaggagctctttagtttaattagatcccatttttcaatttttgcttttgttgcagttgcttttggtgaattcatcataaaatttttgcccatgcctacagacatataatacttttctaaagatcatcttgttattgttttcatcatgatcccatacattaatatatttatctcagccagtctagaagacagagtgagattttgcaccatctttaaaaaaaattatttaagagtgaggctccttggaggacattgacgtgttactgatctaatctctatactttcagttatttgaagctatgcatcactgtcttctttttgtttcttggacataggacaattaacttttcataggaaatgttcctagatcaattaatagtcttcaaatagttttcaaatcaaatagtcctcaaagaataatcttttcattacatttattagctgtattatcctattcccaccctcctttaatgggagattattatggattttcatacttatctttctctttcattcatagggagtacgggattgaaagtcaggaaatctggtatctagatctggctctattattgaataatgcataaacacagaaaaatcagtaaacaacaccttaggcttttttttttatttattcatccatccatccatccatccattaattcagccaatatatattaagcacttactactttgtattatacactctcctaatcattgcagctagagtggtgaatataaacagacataaagcttatattcatgggagaagagagacaataaataaaataaaggagtcagtatagagtaagttagatgttagtgagtgctatgaaaaaaaataaaatggtgagaatagcgagtatcagagagagagagagaagtatgtacagtgttttgttagtgatgcctgtacaagatcacttgatcatgatcagtgattttagtatttgattagtgtttgtgacaactttaaaagtctatgctttactgtttcctgcctcaatcagaaaataacatgaaaatagcaaaagcttaaggaagactcactaataattcaaaccccaaaattatataaccaaaatgcctgcaccttatttctagatgtgttctttgttgcttgtgtaaaaggcaggcaataataaacacctattatgcttgtttttgctaatttatggctacctcttttaagcagcagaatacaatctggtaatattctaaggatgtgttcttcttcaatttactgttgagtttagccacatgtctttttttattttattattattatactttaagttttagggtacatgtgcacaacatgcaggttagttacatatgtatacatgtgccatgttgttgtgctgcacccattaactcatcatttagcattaggtatatctcctaatgctatccctcccccctccccccaccccacaacagtccctggtgtgtgatattctccttcctgtgtccatgtgttctcgttgttcaattcccacctatgagtgagaacatgcggtgtttggttttctgtccttgcaatactttgctcagaatgatggtttccagtttcatccatgtccctacgaaggacatgaactcatcattttttatggctgcatagtattccatggtgtatatgtgccacattttcttaatccagtctatcattgttggacatttaggttggttccaagtctttgctattgtgaatagtgccacaataaacaaacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaaaagtgtaaaagtgttcctatttctccacatcctctccagcacctgttgtttcctgactttttaatgattgccattctaactggtgtgaaatggtatctcattgtggttttgatttgcatttctctgatggccagtgatgatgagcattttttcatgtgtcttttggctgcataaaggtcttcttttgtgaagtgtctgttcatatcctttgcccactttttgatggggttgtttgtttttttcttgtaaatttgtagattctggatattagccctttgtcagatgagcaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattacctagcttttcttctagggtttctatggttttaggtctaacatttaagtctttaatctatcttgaattaatttttgtataaggtgtaaggaagggatccagtttcagctttctacatatggctagccagttttcccagcaccatttattaaataaggaatcctttccccatttcttgtttttgtcaggtttatcaaagatcagatagttgtaaatatgtggcattatttctgagggctctgttctgttccattggtctatatctctgttttggtaccagtaccatgctgttttggtgactgtagccttgtagtatagtttgaagtcatgtagcgtgagtttagccacatttctttgaaatgtaagaggctatcctggatctacgtcaaacagaccaactcaccacaaatcaaagatctatgttccagactggaaggatttttctcatatttgttgtgctgacagagagctgttgtttctcagctaagaatactgggtgttgggattgaaggaacataataccttagagctaatgttgttgctgttgttttcccttgagttttcttcttaagatatatagcatatatagatatagagataaacttggataccttcctgccaagatcttaggatacttatttacaaagagagaattttcgggaatggcctaagtagctgcaaacatctgagagatgcaatgaatgctagaggtgtgatttgctaattattgccacttttgaaattctaattcacataaagattaagtgttaggtataggaaaaccgcagaaaacttcttggatttgtagaagtgtctgtaaagtctgattcaaacaactcaggacaaataaaaactaaaaataaatttgcagaagctcaggattgggtattttacatgtataatctctgtagcacataacctggcagtgtgaattccgttttggacaggtaaggctgttaaatgcagcagaggtcgctgaaaggatctgcatttgacactttggagatggatatgcatggattctgatcctaattcctgttacttaatgtctatattactttaatcagttcttaaacttatctgaacctcaccttctaaaacatctataaactgcagaggaggcaaactgcatttagttatgaatagcaggcaccacatgctccacaccacagggccatctaataaatttctcagatataaatacaattgttttctttcatttggctccttgtgatgtcaaagggctcccattcagacaacagatctctcttctctttgtcttcctaagacctgatcttcttgactcagtaccttctgtgcctcactttccactacccagtgatcacgtacaagggcaaaagctactgttatctgaggatagaatgcccccgtcacctcactgaggataagtctttagttagttgtatctggtcatgcagatgcatattccaagaaaatgtgactctcatctaataacagcataaattaaattgttaaggagaatgtccactgtcgtgagaaatactccttggataaatgtgagatatccctaaaataattcatgctggtaaggttagtttcattgaaattggctccaaacatctgtttttgcaaatctgcagctggaaaaaggttgtgatgcagtaatttgtcttgaaagaagacattcttattaatgcataagccaaagttagttgacttcctttagcttactttcattatcaccttatttcctggccatagcttcttgcatcttataagcctttagtcaagcaacatttttttaaaatagtatcctgttctggtaagaccaatatgttgtcacctgaaatctatttggtaatatttttgtctctctatatcttgaattttgatgcctgtagagacattctttctgccaagttgtggatttctttactccaatctacctgtatttgtcctgaggtaaattcttgtgaataccatttaatatagggttttctaattattaagagttcagtttcactgattggtcaacactgtgtcttgaatttctaacctatgccacagtgtatataaactaaacatccatgggcacagaagtggccttcagattttacttcctggccttaaagtaattaaaggaaaaattccttgttgtgcaatcagggttaaatagggttagtgtctataaaggagcacattgttccataagtgttctcacttgggaagttggcaacaagtatttaatcaagctaaagaaaagtttgccaaggcagacagtgggtgactgaaataaccttagtcagactggaatgaagtctgttctcataaatggagtacctggctgtagccaagaacagtatatatgaaaaagaataattcctgggatttgaggactgaacgatcagcaattagggaacaggcaatgtctgactgggaaacaagagtaaaattaattttgtagttattacctacaccagatgttctggcgtgcatgtggtaaaatagaggtcttcggaaatcacaaattttggtaagaacatttgcttacttcatgtggtttcaaacaagtataaatataaatcttgctgtagattagtagtattagtattaacattgccctgttaatctcattgagcctataagaatgatttggacagctctatattcctcagataattaggaagacaattactagtttatactcagagtcttagaactagaagagaccttaaaattcaaagcgctctgttccttcattttgcagatctggaaaccaaggcttagtgaggtgaattgattgttctaatgacacagagctaagtattatgaaagccaggagtggagtccatatccagggtttgtccactgaaccagaccacagtcctttacaatcaagagaaccctaggcacttagggcttctcaagaatacctggccttggttatgccaagaacttattaatctgataaattcacagtgtttggggtattaatgtcagaaaatcatgtaattattgattttccctaggatgtatgtattttagcatgctttaaacattcatgctttaatgtctaaagtgttcagttgcatgtaataatttttaaagtgtggatgttagcagaaggctgcataacttaacgggatttgactgatgtttcaggccagaagtaggttgcctacacaaagagaaatttcaaacagggctcatagtctttaaatttagttaagtgaaaacccattatgttttctctgcaatgttaaaaatgttatgttagttatcacataaaaatactacttaaccataatatgttattgcaggtcatagtaaagacaacacattatcttagcactgaataaaaagctttctcattctacacaaatctaccttatatgtctaaatccttgactcctaaaacattaggaaacatctcctgttaattaagtagctaattactgaataaagtattttgataaagttatttccataaggttaaacagcccagagcgcacacacacacatatatatgtacacttaggtgccccaggtacgagtgacacagaaccataacacatgattcctaaccttgatgtttccagaaaaaaaaataaaaagcaatgcagagtagtctagatcaagtgacaaagctataataagtgccatatgaagtaagagaagggagagatgactaagaattagtcatcagagagaggctttattgagacattatcaaactcaaatgacattttcttgaagttcaaagttaccactagtgaatttcaagggatggaaaacttttaactttatgttcaatatgttctcttaagataatattctgtagagaaacaatttctgccacaacccactaaaaccaaatgctgctcaaaattataaaataacagtaagataaatctcagcattgtgaaccctttggcatttgttatcattacttgtttcaccccttgtgagttacaaagagttagcatgaaccataagtccaaaggtcactcgaaatccctcctctctggaaaaaaaaaagaattactttaattacaaaaaaaaggtatttttagggatatttcaaaaattttagtacatatgcattcttaccacaatgggcagaaaaataagcctttttcaatatcttaaatatatactataaataattcattaactaaaaaggaataaccagtagtatagacttgaattcagcagtagatgtattcattcaagaagttagtactaagtaagacacttactttgaattacagaattttctaggttctagaaaataaaagtgaataagtccacgtcagtgttttcaaggaatcatataattataatttgtctatttgtatacaaatcatataatttgtcttatttgtatgtttatatatatgtacatattccactatgataatatttgataaatgctaaactagaggtatacacaaacttctaagaggaatatatcagttcagaagtctgattcattaatttgttcatttattaatttaactgatattcatttagggcccactatgtgtgaggcactgttctagatgtttcccaaaaaaggtgacttttgagtagggtcttaaaatgtaactgggtttttgagaggcagaaaagaggagataaggcttgattttatagacagtgggaatgacataggaattaatgaaaatgtaagagtgtgatgtcatcagggaacctagccctttgagtcaatgtcagaggaagctggaaaaggtgggtagatgttaaattataatatgctttgaatttcaactgaaattaaagtaaatttggagattattgtttggaccatagaacaccatatttttcctgttaaaactttttgaagctataacagaaataatatgatttctattttagaaaaatacattttgtgggaatactggattcaagtagaggaagactgaaggcatttatcttttacccacatccatcttttatacattttctcaagccttctcaaatcatcatcctatctgaaggacatttatgccccggaagtaactcgtggcatcagactgaccttggccacacttcagattgatggagaatgtaagcattagcatttaattcattggcacttctttggctagccatatatattttttcttggctgtccttatttttctcatatattatgccaaagagcatctcagacatcagtagctggtaataagctgaaatagctccatgtgtcactgcaacatttacgtaaaaatagatattactagcagaatctttacagtgtggtcctcgcctttgcaataaagacaaagaccaatctggcttagaaatcaactcacagtattggtgatcatataatatatactgacttatcccataggaacaagtttctttagcaatttatttagctgtcttctcacagaagcaactcacatttcacaataagatatgactcaatagtctctctgcgcatgcgtgtcagccaataatgcttagtcagaagaactcaagacagtctatgaagcagtagggaatataaggcagcagtgaaagaacttagagagcccattaataggaaatggagagcatttggccgtctttattgggagtggggagaagcagacctgtatattcacatagctaccaaggcctaattcaggatttttttcctcaaatgttatttctgatgttaatatttttcctctggcttttctatgttgcttaagcatacagtattaacccgtaagcatttaaaaatacttgtctagatcacatggaagaggttccactcagaattgtacatgttctcccaaggttcatccatcatcagtgtatccaagaaaatgtaagcactaatttacctggaatctaaggatagaaagaaatgcaacatcattcattagttgctatagatagatgtggtatcctgatgtggtaaaataaactccaatcaggagtaattttcgtgcatgactctgactattggggatgtatctgcctgcctattaacgtggtgtactttacatagatttttttaattttgtgagttagatcttagaaaataaacactggctccttaatagaatttgagcatttggggacagctgtaaccaatctgacaaattctatcaaataacttccttgtcaggaaagcctggtttgaatacacatattataaaggtattcaattgaataactttaattgattcagtctttaaaaaatatttttaatatttgtgggtacatggtagatgtgttcgtttatggggtgtacatgagatcttttgatacaagagtacaatgcataataatcacaacagggtgaatggggtatccatcacctcaagcatttatgctttctttgtgatacaatctaattataatcctttagttatttaaaaatgtatgataaattattattgactgtagtcaccctgctgtgctatcaaatactagatcttatttgattcaaacttttaatcaaatggtttaattaaatcattttaatttgaatgatttaatttaaatattaatttggttacattttcaaaaccacaaagaaacagtctctgatgaaagtagtagtgcaatgagatacaggggcaacaaagaattctcccccacttcaaaaaggtccatttatgaaatttcttgcatcattttttcaagagatctgcctaataaattaatttaaattgaggcaccgtaattttggaatcagcaacagggattttgtaatagaattatgggagccatttagcactggctatggtgtattcatatgtgattttaattgcatgaagttccaaatacaagatcatgaactttcttatctatctcttttacttaacagataggggcctctggaagctagctgcaaagttcaatctaatgatactgttagatactatgatgggaaatcatagatgagagcaggagcttttgcactgaatttctgtgccatttcctggcactcatattaaaattataaactacttaaatccaaaatgtagccatcttagaatgtgccacagagttttacaattttttctcagaaatatggttcagtatttccagagagctaaattaattgctagaaactcctctgacaacccaaccaaacacaagctgttatgaagcccatgatgataattaagacttaatgaaattttgctcatgatgatgcctttagctttatattttctggcctgattttattgccatgctatgcttagattctttctttctttctttctttctttctttctttctttctttctttctttctttcttattattatactttaagttttagggtacatgtgcacaatgtgcaggttagttacatatgtattcatgtgccatgctggtgagttgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggcgtatatgtgccacattttcttaatccagtctatcattgttggacatttgggttggtcccaagtctttgctattgtgaataatgccgcaataaacatacgtgtgcgtgtgtctttatagcagcatgatttatagtcctttgggtatatacccagtaatgggatggctgggtcaaatggcatttctagttctagatccctgaggaatcgccacactgacttccacaatggttgaactagtttacagttccaccaacagtgtaaaagcgttcctatttctccacatcctctccagcacctgttgtttcctgactttttaatgattgccattctaactggtgtgaaatggtatctcattgtggttttgatttgcatttctctgatggccagtgatggtgagcattttttcatgtgttttttggctgcataaaggtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctcttcagtttaattagatcccatttgtcaattttgtcttttgtttccattgcttttggtgttttagacatgaagtccttgcccatgcctatgtcctgaatggcttagattctttttgtccacatagctgaaaaaaatattataattcctctattttcactcttcctttaagaaaaataaatcaagccacttaaatattgcttattcacctgccttttcaaatatttaaaggaacacctaaattgtgctgagctgtgtgttgagtgctggagatataatagtaaacaaatgctccttcgttttaaggagttgtaattgaggaaactgacatggtagctaatcattttaatagaaggtgggataattgtaaagctggatctatgccagagtttcttgtgaatataaaaggaaaataactcatgaacgaggggacagttccaagaaaggatttgtggaggtggttacacctaagctactgatattctgtctcaaacttaggtttttctagtctcaaagtccacacttattccactgtatcacattatagtagaggctgtacaatgccgaactaacagctaaatgtggctgaacaataagtttcttaatctaataataatatgcttctatttctcataaggttgttgagatgacaagaatgaaaatcattaagaaatagttctctccaagatgatgtaatgctaaaattgcatatgattactttgtttctgcaaaatgttgcaatagccaagagactttaaagtgatcaaaagaaataaaataaaaattaaaaacccttcagctttagtatatggattctggagtaagatactgttatctactttttaagaaggattaaacaacattattaaaaacatttcaaatgaatgcttacaccagaagactgtagaatgctgaacaattatcagtgatcttaagtggcaagtaagctagtcttttgccccatagcatcctgtgttagtggtccatttaacaccttcagctagtatttccagggacttgttacagggacataaatttcaagcagaaaacaattcaaaaactattgaagtccttggtctggtgtctgcttcctctacattctttccctaggcaatacaaccactttcattttttatgctaccatttgttgatgacacctagatctaaaatccaggccacaggctttttccagactttcccttcaagtgttatgaagattttttatgccaagaggaaggcttatctttggtgaaaaagtatgtcaaagaaaaaggaaaccggtcattgtcctgggaacgaaatataaaagttgagagttaggtatatagccaaatagttcatttaatctgcaggaaagaagcagaacagaaactaggctctgccataggtacaaatggattaaatgaagcttttttgctattatgtttatgctggtgtttcccatggggtgccatgattgttctattttactctgtagccattttttcttgccctttttgcttttgtttctgcgtgcctgattctcaaactttgacatatgaccaatctgtttctcaggctgtagacatacaccttcattccttggctaaccttttttcttccttcaccagaactgaggcccttctcttgtgatagagtgccaaagtcaatccattattacaactctgcacctgtctccacccctttttttttttttttgccatttcctgacttcaattttaattgtgaagcaagattttatttcttttaaattttaaattttggtgggtacattgtaggtttgtagatatatatatgcaccatatatatatggtatatggtgtatatatatacacaccatatagatacacaccatatatatacaccatatatataccatatatatacacatcatatatataccatatatataccatatatatacaccatatatataccatatatatacaccatatatataccatatatatacaccatatatataccatatatataccatatatacaccatatatacaccatatatacacctatatatacaccatatctataccatgtatatacaccatatatataccatgtatatacaccatatatataccatatatataccatatataccatatatataccatatatataccatatatatacaccatatgtataccatatatatacatcatatatataccatatatatatacaccatatatataccatatatatatacaccatatatataccatatatatacaccatatatatacaccatatatatactatatataccatatctatacaccatatatataccatatataccatatgcataccatatatacaccatatatacaccatatatataccacatatatacaccatatataccatatatgcaccatatgtatacatatatacaccctatatatacaccatatgtatacatatatacaccctatatatacaccatatatataccatatatatacactctatataccatatatataccatatatataccatatatatacaccacatatatacaccatatatatacacaccatatagatacacaccatatatatacactacatatatacaccatatatatacaccatatatatacacaccatatatataccgtatatatacacaccatatatatatactgtatatatatacaccatatatatatactgtatatatatacaccatatatatatactgtatatatatacaccatatatatatactgtatatatatacaccatatatatacaccatatatacaccacatatatacaccatatatataccgtatatataccatatataccatatacatcatatatatcatatatatcatatatatcatatatacaccatatatacaccatatatataccatatatacactatatataccatatatatacactatatatactatatatacaccacatatatacaccatatatacacaccatatagatatatacaccatatatatacacaccatatatatacaccatatatatacacaccatatatatacacaccatatatataccatatatatacaccatatatatactgtatatatatacaccacatatatacaccatatatataccgtatatataccatgtatatacaccatatatataccatatatacacacaccatatgtatataccatatatataccatatgtatataccatatataccatatgtatataccatatataccatatatataccacatatatataccatatatatcacatatataccatatataccatatacaccatatatataccatatatacaccatatatataccatatatacaccatatatataccccatatatacaccatgtatatatataccatatatacaccatatatataccatatatacaccatatatataccccatatatacaccatgtatatatacaccatatatatatacaccatatatataccatgtatatatacaccatatatataccatgtatatatacaccatatatataccatgtatatatacaccatatatataccatgtatatacaccatatatctataccatatatatacaccatgtatctataccatatatatacaccatatatctataccatatatatacgccatatctataccatatatatacgccatatctataccatatatatacgccatatatataccatatatatacgccatatatatataccatatatatacatcatatatataccatatatatacaccatatatatatataccatatatatatatggtacataagatattttgatacagacatacaatggctaataatcacatctaggtaaatggggtatccattaccttaaatatgtatcctttctttgtgttacaaacaatccaattacattcttagttattttttatttattcattttttttttttgagacggagtctcactctatcaccaagctggagtgcagtagtgcgatcttggctcactgcaacctctgcctccagagttcatgcgattctcctgcctcagcctccccagtagctgggactacaggcgcataccaccacgcccagctaatttttgtatttttagtagagacggggtttcaccatgttggccaggatggtctcgatctcttgacctcatgatccacccgcctcggcctcccaaagtgctgggattacaggcgtgagccaccgcgcccgccccattcttagttatttttaaatgtacaatataaattattgttgactatagtcaccctgttgtgctgtcaaatactagatcttactcattcttcctaactatattattgaaactattaaacatccccacttctctctcccctcccccaaacccactacccttcccagcctctggtaactgtcattttaccctatctccatgagttcaattgttttaatttttttagctcccatttataagcgagaacatgtgaagtttgtctttctgtgcaaggcttattttgcgtaacacaattacccccagttccatccatgttgttgcaaatggcaggatctcttttttttatggctgaatatactccattgtgtatgtgtacattttctttcttcattcatctgctgattgacacttaggttacttccaagtcttacctgttgtgaacagtgttgcaacaaatatgggagtgcagatatctcttcgatatactgatttcccttattttgggtatctactcagcagtgggattgctggatcatatggtagctcaatttttagcttttggaggaacttccaaattgttcccatagtggttatattcatttacatttccaccaacagtgtaccaggcttccgttttctccacatcctcgccagtgtttgttattgcctgtcttttagatgtaaggcattttaaccggggtgagatgataccttactgtagttttgatttgcatttttctgatgatcaatgatagtgagcccctttttgtatgactgtttgccattcatgtgtcttctttggagaagtatctattcaaatcttttgcgcattgttcgattattttactagatttttcctatagagttttttgagctccttatacattctgcttattaatgccttgtcagatgggtagtttgaaaatattttctcccaacctgtggccaccaccactgggactgtactaggtcagacctgaggccaacacagaaatgggtctgcccaggtcctgcaatgaccactgcctggctactgtctatgtttgctcaaggcccaagggctccacaattatttgatgacaaatccagccaggcctgtgtccttcccttcagggtggtgagtttccttggccctgggcaggcctggagttgctgtctgggagccagggtctggagtcggttaccttaggaatctacctggtgctctagtctattgcagctgagctgacacccaagctacgggacaaagttcttcccattcttcccttccctttcatccagcagaggaatcacttcccatggccgccaccaccccatgcacgtgacgagtactgcctggctacccctagcaatcactcaaggcccatggggctcttcagtcagcttatggtaaatgctgccagtccagtgccttttttttgttgttttttttttgacagagtttcgatcttgtcacccaggctggagtgcagtggcgcgatctcgggtcactgcaacctctgcctcctgggttcaagcgattctcctgcctcagcctcccgagtagccgggcttacaggcgcccgccaccacgcctggctaatttttgtgtttttagtagagacagggtttcactgtgttggccaggctggtctcgaactcctaacctcaggtgatctgcccacctcagcctcccaatccagtgccttttcattcaggccagtgggctccactctggctcaaggaaggtccagaaatgctgtccaagaaccaaggcctggaaccggggaccccaagagcccacttggtgctctgccctactgtcaccaagctgttacccaagctacaagacaaaatcccctttactgttccctctcctttcctcaatcagaaagagtctctctccatgaccatcacagctgggaatgtgctgggtcacatctgaagccagcagggctctgagtctcacccaaggcccatggcaaattctgctcggctaccactgctgattattcagggacaaaaggttctttagtcaggaggtgatgagttcttccaggacttggtcctgcccttcaaggcagtgggttctcttctggcctaggtgtgttaagaaatgttatccaaaactaaaacctggaatgagggcatcaggactctgcctggtatcctattctactgtggtggagctggtatccagattgcaggacaaagtcctcaatcctctccccttttctctcctcaagctgagggaaggagtctctcccagagctgtgagctatggtgtcagggattaggggaggggtgatgcaaacattcccttggccacgccagctgatatctcactaggtctcatgcaccccaagtgcactggctccaagcccagcacagcaccaggacttgcctcatagcctagactgcctttcaagtttatttaggacccggggggcacttttgcccatggtggtggggcttgccagacagaactcaggttctgaccactgggatggacaatttgcctctagctagggctcatctaaatgctctctcagtgggcgctggctgatttctgccccatgttgcttaccagcactgagttccaatgcaaagtcccacagtcactgcattctccctccaacaagcatacagattctttctctgcaccatgtgaccactgccagaggatggggcagtggtggtggtgtaggcaattcaagactgtctttcctaccctctccagtgcctctttccttaatacaatgttaaaaccaggtactgtgatcgctcacctgatttttctttgtatgaaggtgcttttttttgtgtgtggatagttgttcaatttggtgttcctgtgagtgggggacaattgctggaggcttctattcagccatcttgctccacctccctgaagcaaataaaaaagctttagaaaaatttgtacccctcacaccaaagtgattaaatgatagtgatagtccacctaaaatgtatagtttctgatttttaaaaccagtttatatattttatatttcattacataaatgtacaccaataaaatggccaaaaatgatatagtaaggctaattatgtcattgaatggccagttgtgttctttgaaggcttggagttcttgaagttccaagaaagcctctgagctggtgtgatttggggggcactgctaaagttgtctttcccgcatcaggcaaaatgtcttgctatcacctgtcactctttatagtcccaataatagtcatttaactttaattcaaagtgcctaattaaaatataagcactattaatgggagaaagaggtttgaagtaaagaaagggcccaaaggccagtctttttttttttttcatggtttccctcagaccccacccaatacgtttttttggaagattaacatgctaatgtttatagaatgctgtaaagtcttcgtataacaaaagagatctacatactccaatggcaatagtaatacagtataatgttcaaagaacatatagatgtcacatatgtggaatattcctatcagggaaacccttacatattccctctgttacctttacatggcatttcttcttctattattcctggcaatgtctgccttagtgaaaagacaggggtcaagccaatatgttcccattgcatgcactcgttacaaagatttaattcgctgataaacatgttaccatattaaatctgcagcttgcctaccaagagtaaatgttttgtgtgagtgtgtatctaaatgcatagtctgaaaagaagatagggggcaagttattgcaggaaaattcttcgtgggaaactattgccttctgatgagctactatctgttcccagcatgtgctttcattagtcatccattaacaaccaccagttcatctcctaaacattcagggttcctcatggtaaaataactgtttcttcctagtgtcacgtttttcctactgtgctatgcagccataatttttgagattttttaaaatttttatttttaagttctggggtacatgtgcaggatgtgcaggtttgttacataggtaaacatctgccatggtggtttgctgcacctatcaacccatcacctaggtattaagcccagcatgttttagctatttttcctaaagctctctctccccctacccaccccccacaacaggacccagtgtgtgtttttccctccctgtgtccatgtaatcttattgttcagctcccatttttaatcttgctaccttctcttctgctcccttactattctatgagtgattatctacctacctaaattgtttttcagtagaaagaaagcattatatagagtggcagccatcccaaaactctgtggttacccccaactttttccccaccctctacatgggttataaacttaacaaacgaacattatgaaaaccaggctatattccatgaagacaccctccagtagttcagacagagcaagaatgtttaagcagaataatgaaaaggctatcttgggccgggctcggtggcttacacctataatcccaggactttgggaggccgaggtgggtggatcacttgaggtcaggagttcgagaccagcctggccaacatggtgaaaccccatctctactaaaactacgaaaattagccgggcgtggtggtgagccctgtaatcccagctacttgtgatgctgaggcaggagaattgcttgaacccaagaggtggaggttacagtgacccgagattgcgccactgcactccagcctgggcgacagagtgagactccatcccaaaagaaacaaacaaacaaacaaacaaaaaaaaaaacaaaaaaacaaggctatcttgttaaacccaaataacctggtagtgaattgaagtagctgatagtaattttcagttttcctctgagtaataccagtttataaattgaattattatggtaaatagtggatattttgtcaagtaaaaataaaaatataaaatagtataataaacatttgcatgtatttaccagacaagtggccctttaatatttacatttacgattaatttttaaaaatataacatagacttatgaagtagaaaaggactttacagttttgtctaattaaattatttgcactcataaaaatagtcatgccaccccacttataaatatctacccccgcaataaaatccttatatacaaccaaaatatatttcacaatgtcctttattaatgcataacacttaaaagtcttcccttgatgattaaataatgtcaaaaacagacttaaaaaataaggatttggaaatttttgataacaatttagtgggggcgatccatcaataacttcataaatttcttccagagtaggataacatagttgaaccacaaatcctgttcccatcttggagtctcactcagacagttgaattcaaattcacaagtctaaagtaccaagatacagtccaaattggagtacctggagagtccaagaaagctgtttgtgatgtcacatgaggtgtcttcaatagtgttgatattcaatcctgagagaagatgtaacccaggcgaagattttaatgtagaggaatctggaactgaggtgagatctggaaagccaaatgtaggtactctgctaccagacagaagtaagttttgtctctggtcagacaacgatctctttctgtagcaaggacgctgtaacagctaggctttaggaacctaagcagtgagaccagctgctaaacagcccggccacagagggcaagagtcatttgagaagagcttcttatatactactaggtcttctctcattggttgagagtctgggtggggctgattatgtcaataatcaggtgaattgtgatatcatagaccatgtaagtactgacatatatgttattatattaaccaagctatgttgtacattacagagtacaagggcagattgtaatgtcataaagtttacagtgtaccaggagatataaacagaaaattacaatacaatatatatgctaggatacagatatatgtaaggtactgagagaagacatagcaaggagtaattaactctgtgtgtggaggtttagaaagggcttcccagataaagtactgtctcagctgggtctttaattatgggtagacatttgcctgtgtgtacaggaaggaggtttgaaaaaggggtatattacagatgtcattctaggcaagacagacaaaagtatacaaaagcacagaaaaatgaaagggaaaaaatagctggagatgaggctggagtagaaagcatatctcagacctcaaagtaacctaattcttcatgatatagtatgcctttttagtcaagttttattcttaatgaaatgaggaaatatttgtgtaagaatacttacaagtcatcaccaatgttgtatttccctaaaagctacagaacataatctattaaaatcctatagatttactttaataatgcaatgctgtcatcataaggactttcctgtgaagtcatggaacctaaaactataatttgtatacatctatccagtgttaacaatttgtagggcatcagaccaggaaggaggtttggaaagttagtagcaagtcaaaatgtgacttcagtactactaagaaaatagggtgatattagataatcaacatttataatgttatggaattattaatagaatatcaaaatattaatgaaacataaattgtcctgatccaaaatggaaccatgcattattcaaattatttactgaaagaaaacctgtgttcatctaccaagtttcacagaacatctatcaagtttcacagaacatctaatatatagtatatatattatagtatatataataatattatatagtatatatcatatagtatatatcatatagtatatatcatatatactatagaatatatattataatactctatagtatatatgatatatactatagaatatatattataatattatatagtatatatcatatagtatatatcatatatcatatatactatattatatattatagtatatatacatataatacattatatattatagtatatatacatataatactttatacatagtatattgtatatcatataataaatggcattctgctttataagcatttcttttccctgctaaaatataattttactcatcctcaacaggttttcctaggaatattgagtaaagtgccttttctgtacctctttcatttttctctgcttttacttgtcagcatctctttatttcaatctatttgatcataggttttcaaaatcaatgtattatgtttagaagggctgaagtgttatttggatgatgactagaaagagatactgctacttctaacaaataggcacacctttctttttgatcctttcctccaaccccaggccacaactaaaactgcttcttttgaattaccttcaagtaacagagtatgtaaacgtggtggagactgttcttaaaatcttgtgcaaatcctgtaaaaccaaacagaaaaaaatctaaagtcctaccagaaattaatgagcactgaatacatggtagaattttgaagcatttgtaaaaactacattgaagaaactagagttagaaacagtaccaaagttctgcctcctaagccaggatgaggacatggtaaaagaatatcttgatgacctccaaccatcgtgcctaaattattgataaattaaggaagctggaggatgagaaaatctgtaaatctgtattaacctaagaaattggcagaggagaaagtatagtatatagatagagtgtatgtcaaataaggcagcaataaatatttttaaaagcaaaaccatctggcaaatttagaaactatatgacttttatggctactcttagaatttgccaaagattaagaattgcccctcctctgtgatcagttttctgcttctcaatgtaaagttcttccttccagcttttcaacacttttattcacaaatatcattctatgacatcattactgatctccttgacattttcgacaaatctcttgcttcctccaaacttcactctcttccctctccagcctgctttgaaaaagcttatctcataagcttgaagagaattaagtatatcatacacagtactcccagaacatcatgtgtactgcctctgtcatagaatttacaatgatgtactgaaatttgcttgcatgtctgtctctctactacacagtaaattcctacttactaatatataaaaattcaaatgaaatataatacgaattgtatgaccaggatggaatcataactttgaagatgagagatgatagatagataggtagatagatagatgatagatagatagatagatagatagatattcaaatccaaatgaccaaccgcatcactttgggcatttaatattgccaaatctcagtttgtttgtttgtttctttttagttttaatctgtaactactttataaggttgttgtgaggagtaaacgagataatgtaaagtttcccagaaaaaaaaaatagttaactcatgctagtttcattcatctcatgattttaggggttgttcaatacattatgaaatatataaatatggtactgcagtaggttaaacaccataaactatagttcatcctggtagaagctgaaaatcatttaataaacttcaatgtatatttataataaatacatttcaaatatgaaaataggaaggccatcccttactatattacaaagtaacaaccagtataattataataatgtgtggctataggattaggaagattaagcataaaaaaattacagcaataagtcctactatgagtgataaatgaagcatcaaaatcaatgataaaagaaaacatgttagataaattcagcttctcatctcatctcacatataaaagtaaattctgggaagatgaaaatgttgacgatttaaaacctattcaaagaaaaacaagaataatagaatagaatatttatccaactatgtatttatccagcatctaagattaaaaaaaaatagatgattacacaaatgagaagactgacagatttgcatgtaaatataaaatgtttatctatgataacttttgttaatgtgaagtggattgggattaaataattgcagcaaacataaacataagcaaaattaaaagataaagactggcataaaatatttgagacaatttttaataagttagaatattatatcataaaatgtgtctgtaggttttttttaggacagtgtataatgcacctcctatatactggaaaatgaatagaaatgtaatatttacatattctcatttataattcttttcaaaaccaccattgtctacattactctaaattagtaatatgctttcattgtacagaattttctacaaatgcaatttctaaactctgtgagattatagaagtataaaatgtgttcataacacaaaacttacattggaggcatcagcaaaaatggctaagtactttcaaaattctctccttcataaaagcagtaagaaaatttacagaaattctctgaatcaactatttcgggactttgaaaattaactaaatgcttgcagcaacccagaatgtgtttgtttaagaaaatggctgaatgttgttaagaatagcaatctccgtgacattttaacttgtcctattcccattcccccttcaagtgccatggtagccttaaaaaccaacatcctacaatcatgttgaaaacctgcagcctggcagctactggatgggggaagggaaggggtagaatgaggttgcagctccttcagagcctcatttccagagaattttcattatttgacttgtctggtagttccctggaagcattaacaccaatccttcaaaaactaccaaaaaacaaaaatgggaagaatatttcccaattctgtttatgaggccaatattatcctgatgccaaaatcaaacaaggacatcacaagaaaactacagaccaaaaccccttacaaatatagatgaaacaaatcctgagcaaattactagcaaactgaatccagcagtatataagaaagattgaacactgtgacaatggtgttatctcagaaatgcaaggttgtttcaacatatgaaaataaatcattataatacactatattaatagagtgaaaaacataaactacctgattacttaaatggacacccaaagaaaccatttgagaaaatccaatacactttcatggtaaaacaacaaactaggaatagaagggaacttccacaacctgatcaagagctttgtgaaaagtgaggctttgtgtaaagtgaaggacacacgtatatgagtttgttgtgtttatttgattagagaaccttcactactactgaaaatagaggatctcagtatctaatgaaattaaacttcaggtgttcaagttcctcatgaaattttcttagtggtttgagtgaattgctttttaaagccttctctctttcaaatagtaatgtctttcatgaaagctaatgactatccttatcaatatgcttattctatgcagctaaagcagataccttttgtgtgcctggattattttttcaattgtaccctaatatacatagcatttgctctatccctgatcacttcaagcaacagcattgaacataagaataaatcatctccatcaatcaatacatccaccacatctcagcttcacccttcctagctctctaggtcagaggtcagctaaccacagcccatgggccaaatcctgctggctgcctctttggtaaaaacaggcatactagaataaaaccacatccattattttaaagattgtctatggctgatttcatcctgcaatagtagagttgagtagttgcaatgaagattgtattgcccacaaagactaaaatagatactatttggccctttacagaaaatgtttgctgttgtttggcctaagatgcagtgtttttatttgttagttttgttttatgtgtgtatttatttatttattttgctttggctttcttctcttaattgctgcaattttttaaatgccttttctactccaatgtgcatttatttgcccaatttattatttaactaattttgaccacataatactcctcactatattataaaaccatgagaacaagtataattttaccttctgaatcattatctccttctgcccagtagattttaacaactaaatatttattaaatacataaataaatgctacatgggtaaaatacttcaaatttattttggaataacaaagagaataaatttattaaatactccagttctcctaaaacccatttcaatattgttctaatcatactagcaagttgaataatttactactctgaaaatgacatttctgttattaaatatagtagttactgtcaactgaaataaatgcatacatttagaaaaggagagaaaaaaatttatttcttataaagggttacagcatttggaaggaggaggtgtgggggtaggtgctttatgatgaacaggttagctaaacatacatattcagcagattacaggatgatctgtgaatattcatgaaaggggttgtgacacatgcatattgaatacacatgcatataacatatgacccatgtttactttgggatgaagacttaacttttacatgtattacaattaggccctctatatcaaaaggtcttttcaggacatgaaggtgcacaagtgcacaatctccgtaagccagccagaaccagttcatagtcagtggtcttatctggagaaagctaatgaaatcagtctcttgtccagtcagagctgtagttatagcttgtggaacacgggctgaggatcagcctagtcagcagctggtggaactgaaaattgttttaatatcacttgttttgagaccagtgcttgtttagctgctagagaaaaagaaaatccttgtgacagttagaacatagtttattctttaagtgcaggaatgtgtgatttaacctttgcctggcatgtccttagataatgtttataatctaatatcttattgtcacatagagtctgttctgtcagccttttaatctctattttaacattaatgctggtcagttgttctgtccaaaccacaaaatggagggggtgtaacaaggtgtgtctgaccttccattctgtcatggctgggaactcagttttaaggattttctgcgttcccctttgccaagagagggtctgttctttcagtggggggcataggattttatttttaaattttaaaatttttaactttgttttctttggggtacatagtagatatataaatattataaaatattataaataaatattatggggtacatgaaatgttttgatacaggaatggaatgtataatagtcacatcatgaagaagggggtaggagttttttttagtttacattactttaatattggacccctgaaacacactgtcctttgtttaaaaaagtaaatttgaaaaacttttagggaaatcttaaaaaatggcaataatttaattttaaaccacaatttatcagtcatatatacatgactgatatatagagaacacagctttatatatacagtgtttagctattgatatggtttggctgtgtccccacccaaatctcaacttgaattgtatctcccagaattcccacgtgttatgggagggacccagggggaggtaattgaatcatggggcccagtctttcttgtgatagtgaataagtctcatgagatctcatgagtttattaggggtttccgcttttgcttcttcctcattttctcttgctgctgccatgtaagaagggccttttgcctcctgtcatgattctgaggcctccccagccatgtggaactataagtccaattcaacctcttttacttcccagtctcgggtatgtctttagcagtagcatgaaaacggcctaacacagctgtgaagttgtatatcaatatcactttctggttccccttagaaccctcaggagtttctcttttctgttaattaaaatttcacagtcacttttaatctattatcattattctgcagagtgaactgtttgaatagagaatcaattaaaagcatagcacagtaaaacgtggggatgttttgcaacttgggcatatgaaaagtagtgaataagaatcattttcaacctatgatatgaaagaagggagatcctgggggcatccatagtcaaacacttggttgtacacttggagatgttttttcaagccttggattattactaacagtaaacaagaaattcactaactagagaaagcagatatgagtacgtacagactatcagatcacaaacagcagttagtaaggtgatctaactaaaagctgtagatggtgtctctttgaactaatgctactttgagcggtctaaaagcatgattgctacatgatgctttaagaaatctgcctagtacctgacagcatattgttcatactagtatctgtagctgtaaatttagattttaataattgtttggtacatattaatatataattttaagataaaaaggaaattgattttataggttatatcctatatctttggcttaaaatatattgtagaaaataatgtatcccatcaaattccatggtaaattagtgagtcacagcgaaagttagaaacactggcctacaacttttaatgattaattacttggccatgaataagccatacattatttagatgtatatttaattttaaagaaatctgcattttaatatttctgaatatgtcattagttattaagaagattactataaaaagcagtattcaaaaatatattttacagtttactttagtttttagtgaacattagaatgatagcatggccatgttgtttatcactgaagcacctaggagagttagcaaatgttaatcctgctagtgtcatcaagactaaacaaattataaagactaaatatccttttttttttttttttttgagatggagtctcactctgtctctgaggctggagtgcagtggcacgattttggcttactcctacctcagcctcccaagtagctgggcttacaggcacgcaacatcacccctagataatttttgtatttttagtagagatggggtttcgccatgttggccaggctggtctcgaactcctgacctcaggtgatccacccactttggcctcctaaagtgctgggattataggcgtgagccaacatgcctggcaagattaaatatacttttaaaaaattatatttttttctattgacttagaaatcactctacattaatgacatagtcaaagagattttacttttgttctcttgtaaataaaataccagattaaaggtatgcttaatgtgataaagtaaagccaaaatccaaaccagaaaatctagagtcataaagttaaagccacaattatatcttattctcttacctactcatttctttttccccactactgagaggatagagtcacatagtacaaatcagcagaagtcctcattattatattcttgcttaggcaagaattcatgattgcttctttgtccttatcccttttccaccactcaagatccatacaatagaagaaatagagaatcatttaataaagttgtcttccattcaactctgaagaaaatatcaacagagaaatggaagtcttttccatgcactcataggtaaagttttgagatcagcttgaaaggaggtagctcaattggaaattacataaaaaattccaggaaagatgggttgtgagactatctcagaagagaaaatctagggtttgtttgtttgtttgtttgaagatattgtagattgtattgaacctctcaggtgtcaggtcctgatgaaattgtaggctcacaaaattttgcagataggaaagttcttggtgctgagagacttgagatgagcaagtacataatgcagaatttgctaagctaaatgaacagggctgattgaatttgtccttagctaagtttctttattttgtaatgtggtggtcacattgcagagccgcagagcctaggatctcatgatgcttctaggcctgtgtttttggcaactaaattgtgatacatctgggatagctttggtaaaaagtgtgtgcagcccatctggggtcttccagccatagaattcctctactgtcatgtaagaagtctgtttatatgatttagaagcaggtaatacaggttgactaaattggaagtggagctgggcagtgtttgtaacccagaaaatatcttggtacctataagtgtcaggagatttttctccttttatttaattggtgggaaatgatatttttgagataaggggtttaagttcaagtaagagatgagttattggttgacaagcttttggatcatttaggctacttgtaatcacaaccagttcatcaggaaaagaccaccaggccagaagaggctttcatgacagcatttacacagagaagcatcaatcaatgtcaagcctttcagcagaaactggaacttcatggtgcagcagttcatcttcgcatgggccgggaggttgaacatcctgcatagtgctgccaggaaatccctatttcatataagagggggctggctggttgcatatgtaggatgtcccatctcccagcccacttcgtcatgacagacaccagaaacaccactctgcttcactgaagaacaataaaatctgcgtgtcatggaaacacagatgctagagctgcatcactagaaaggcattctgacaaatgtatttagaggagggtagagtactgactgctatgaccttggctcataagaggcagtgggtatgtgagtggatctttaagctcagggccagtagatctgcattaaaccatattagcaacaacactggccacacagataatgcctccagaattgtgccacctactctcagagctacaccgaattagggagattcaatagttgggcatatttatttaggctagccagagccaaatacctagaggtagagagaatctaattcttaattatagaaaaaaacaaagattatatcctgaaaagcagcctagaatttcaagtctgagggtcaaggtaagatagtaaattaaaaaatatgtctcaaagtcagaagaaggatatttgggaggagtattccagagaagaactaacaattctaaattgagcagaaacagtctattacactttgaggcaagaatcaagttacaaggaagtaggtgtgattgcaaagggagaaagttagcggcatgtccctacaaatatttcagagatataatttctgtcagctgcagtatccaatcatatccagggaattctgtcaaaagcaaggtgataggaaatatcgagagcagggcccagctcttaaaaacatagggcaggattaaaagtaatgcaaaatccagccaatcctagcggcccttctacttctggattggtacaggaaggatataatctcagaatagaaataagccatttaaatggaatatatttagctttataaataattggctgttatacataattttccattttcactttagactgctgaaatttcactatggatctttatatgaaaatgactaatctgtaggagatgctactggcagagaatcaattatgtcaacagcacaaacttgagttgtatcctgggatgctatcgagttttccactgactttaaattagggtcaagttaaacaggccatctccaaagactttggggttctaaaaaatgttgatttgctatgcattcgaatctgggatgagtttctagtcaaccatcctggctttggcattcttcacagtggatggtaagtgggccaatcttaggctgaaaaacaggctgatttagggtttgggatttagagcatttatatctctttattttcctcagcagcacagactctccattggaattaggggcttagtgaatagttcaaaaaacgtatggtttcatatacaaggaccccaaagttccatgcaaatgtatgagcatactgttatgtataatacccatgtaatttctgtagagtctatagagatatcacctctttgatcactgataattgataatgtgtggcttctacctttaattcttagtcgatctgttgagaggtttatcagttttattgatctattcccaataaagtgcagcattttatttcattgaattctcaatattatagtattgcctaaattttattgatttctgcttttatatttatttatttcttctggtacttggatttcatttttccttttttgcctagcactttaattttggaagcttagatcatggatttgagttttcttttctaaaataaaccattaacgttagaaaattccctttgagtactactttagcaccatcagacaaattttagtacgttttgttttcattttaatttacttcaaattattttttaacttcatttgccttttccttttgaaacatgaattatttagaattgtgttatttaatttgcaaatatttgaacattttcaagatatctgttttatttgttttcaggttaattctgttatactcagacaacacacgttgtttgattgcaaccattttaatttcttcaggtatattttatgagccagaatatggtctttcctggtcaattttccatagttcttgaaaagaatgtgtactttcctgttgtcaggtggtatgttttatcaatgtcaattaggtcaagtttgttggtaatgctgttcagttcttttacctcagtgataattttctgtatgcttttctgtcaattaactgaggaaggggtgttgaaatcttgaagtgtaattgtaattctacttttgatttcttctttctgctctaccattgttgtgcttcatgaattttgaagccctgttattatattttaaatgttattatattttaaatgtattataaacgtttaggactgttatattccctcgatgaattgacacctttatcattataaaatggtctgtgttacctctggtgatatccgatgatctgcaatttactttatctgttattaatataaaaattctagcatttgtttaattagtgtttgcacagtatatcttttatccatacttttattatacaggttgagcatctctagtcccaaaatctgaaatctgaaataatccaaaatcaaaaactttttttttttttttgagacagggtttttctttgttgcccagtctggagggccatggcacaatcatgcagcctcaaactcctaggctcaggtgatcctcctgcctcagcctcctgagtagctgggaccacaggtgtatgccacgatgccgggctaagtttttaaagtatttgtagagacaggatctccctatgtttcccaggctggtctcctgggttcaagtgatcctcccacctcagcctcccaaagtgctgagattacaggcatgagccaccatgaccagccaaaatacaaagctttttgaacatctatatggtgccacaagtagaaaatttctcagctgacctcatgtgactggtcacagtcaaaatgccatcaaaactttgtttcatgcacaaaattatttgcaatattgcataaaattaacttcaggccaaaaaataaatgaatttcacgtgtagacttgagttccatccccaacatgtcttattatgtatatgcaaatattccaaaatatcaaaatgtccaaaatctgagactcttctaatcccaggcatttcagataaaggatgctcagcttgtacaactatctatattattaaatttaaatttgtagagtttcttatagacagcatataattgtgtcttgtttatttttattctcaattttaatccaaaatcgctatctctttccttgaattggtgtgtttataccatttagatttaatgcaattattgatttgtttggacttatgtctaccgtgttttgttttctatttatcccttgtcttttccactcttttatttcctataggaatgggaaacattcttttgtttcctaattctgatttattatgtttttttctttttatttgagtatttcaattttattgatctattggcttttttactatatttctttgtacagtttttttgtttgttaagtgacaatgctctgaattaaaatatacctgtatattataagtatcccttatccaaaattcttgggaccacaatgctttggattttgaattttattagattttggaatattttcattatagttaacagttcagcatccctaatccaaaattccaaaatccaaactgctccaatgagtatttcccttaagcattatctcagtgctcaaaaagtttagattttggagaatttgggatttcaggttttcagattagaaatattcaacctatatatacatattttttccaagtttcttacccttaatattttatcacatcaagtgaaagataaaaccatatatgctcctttatcctcctttttttggtcttagttgtaatatggattacatctacatgcattgagaaccttatcagacaatgttacaaaatttttgcttctgagaatcatatgtattttaaagacttaagaaaaattattatattttctaagatatttaccgtttctgttgttcttcctttgttcctgatgttttcctttagtgtaattttcctttagtgtaatttcctttagtgttttcctttagtgtaatttccttctgcctgaaaaacatcctttaacatttttagaccaagtctcctagtttagagagacttgttttagagcaatgagttcctagtttcccttcacctgagaatctctttatttcacattcatttgtgaaatatatttccactggatatggaattttgaattgatagctcctttctttcaggcttttaaatttgtggttacactaccttctggttttcatggtttctgatgcaaaatctgaagatatgcaactttcaatgtttttgtctttatcttttattttgaccagtttgattatgatgatctaggtatgattttttttttggtttaaacatttgagttttacagaacttcttaaatctgtaaattttttccccccaaatgcggcatgttttggaccattatttcttcaaatagtatttcttcatcaatttttctcctctccttataaaattccaatgatacaaatgttaaacatatagttattgtcccacagatccccactatgttcatttatttttaattttttcacactgttgttcagattatataatttatatggatctaactttagttttcatgactctttatctgtcatctctactcttctattgagtccattcaatgatcttttttcaaatattgtattttttgagctccaagctttcagttggttctttttaataaattatactcattatttgagaactcctacctttctattcatttcaagagaggccgccttccttcactgagcatgattagggtagctgccttgaagtctttgtctacaaattccaacatttgcgttatcgaagggttgctgtctttgattctctttttccttaagaatttttgagatttttctaattctgtgtatatttggataaaacattttgtatctttgacactttgaatattatgtcttgagatctggatcctttattattgagataaaattcatataacaaaattaacaattaaccatttaaaagtatacaattctgtggtatttagtacattcacaatgatgtccaaccgtcatctctatccagtaccaagatattttatcactacttccaaaaaaattccatatccattaagtagcttttctacattgccccattcctcagcctctggaaaacactagtctcctatctgtctttaaggatttacctattctgaatatttcgtataaataaagtcatacaatatgtgatcttttgcatctggcttctttcacttagcatgatgctttcaaagttcaaccataatgtgccatgtatttgtaattcactctttttatggttgaataatactccattatctgaatatagtacattctgtttattcatctgtcagttgatagatatttgggttgtttcctccttttggctatagtgaaaagtaccactataaagagtcatgtcaaatacttgcttgagtatctataaatagaattgctaggtcatatggtaattccgtgtttggcttttaaaggaactaacaagctgttttccacagtgacggcaccgtttcactttatcaccaacaatgtatgaggtttccaattttttctccacatcctcaccaagacttgacatttctcattttgtttttggttttgtgtttacggtcaacctggtgggagtgaagtggtttctcatggtggttttcatttatatttctctaatgactaatgatgctgagcatattttcatatgcttgttggccatttgtatatctcatttggagaaatgtctattcaagttccttacccattttttatttgcaaatattttcttgcattctgtgggctgtttttacactcttctgatagcactctgatgcagaaaaaatttttaatttaatgatgtccaatttttctatcttttctgctaatgctactggtgtcatatctaagaaaccattgccaaatccaaggtcactaagatttacccctgtgtccttttctaagtgttttgtacctttggtttttatatctggatctttggaccattttgagttaaattttgtgtatgttgtgaggtgagggttcaacttcaatcttttgcacgtgatatctacatgcaattttcccagcattatttgttgaagggactgttgttttccattggaaggtattgtcacaagtgtaaaactcagctgactgcagataaataggtttatttctggcctctcaatcctattctattaatctatgtctatccttatacttgtaccacattgtttgattataatagctttccagtgaatcttgaaattgggaattctgagtcctaaaatttttttctccttttcaagattgttttggctattcgagatcccttaagattaaatatttattttaggattagcatttccatttctgccaacaaacacattagggttttgatagggattgcattaaatctgtaggtcactttgaaaagtattgccattttaacaatattaaatgttccaatccatgaacatggcctaactttcaaaattttagttgcctgcagagctcctggtgtatagtggtgttgccactatagatgggcaatttaatgatcgatgcttgcctccttttatgccaggatagaaaaagtgaagcaaagaaatctctctgttttatgcctgtcctcttgtcccctgggaagacagtatttttcttggaggtttctttctgcacatccactacacagtttgaagatttcgggccgtactaaaatctaagccaggaggtaagggaagtgggaagggaaaggaaaataattcttttattggtcattgtttaacttttattgtcttgcccaattagtctgctgttatttatttttcacatacctcagttacttgttttgggtatatgtgcacaggttttagttgtaatctataggagagataggatgaaatgtgcttacttcagttttgccagacctgaaagacttttaattggtaactttttatttttttatttatttattttttttagtttctttatattttattttattttttttaagagttaaagagataaactttattttatttttttatggagagtgctgttttttgttttttttattattatactttaagttttagtgtacatgtgcacattgtgcaggttagttacatatgtatacatgtgccatgctggtgcgctgcacccactaactcatcatctagcattaggtatatctcccaatgctatccctcccccctcccccccaccccacaacagtccccagagtgtgatattccccttcctgtgtccatgtgatctcattgttcaattcccacctatgagtgagaatatgcggtgtttggttttttgttctcgcgatagtttactgagaatgataatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttagagttctttgggtatatacccagtaatgggatggctgggtcaaatggtatttctagttctagatccctgaggaatcgccacactgacttccacaatggttgaactagtttacagtcccaccaacagtgtaaaagtgttcctatttctccacattctctccagcacctgttgtttcctgactttttaatgattgccattctaactggtgtgagatggtatctcctagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgttggagtttattgtagattctggatattagccctttgtcagatgagtaggttgcgaaaattttctcccattttgcaggttgcttgttcactctgatggtagtttcttttgctgtgcagaagctctttagtttaattagatcccatttgtcaattttggcttttgttgccattgcttttgatgttttagacatgaagtccttgcccatgcctatgtcctgaatggtaatgcctaggttttcttctagggtttttatggttttaggtctaacgtttaagtctttaatccatcttggattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttctttccaattctgtgaagaaaggcattggtagcttgatgggtatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttgtctctctgtttgtctgttgttggtgtataagaatgcttgtgatttttgtacattgattttgtatcctgagactttgctgaagttgcttatgaccttaaggagattttgggctgagacaatggggttttctagatatacaatcatgtcgtctgcaaacaggggcaatttgacttcctcttttcctaattgaataccctttatttctttctcctgcctaattgtcctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacaattattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcctttttggttgtgtctctacccggctttggtatcagaatgatgctggcctcataaaatgacttagggaggattccctctttttctattgattggaataatttcagaaggaatggtaccagttcctccttgtacctctggtagaattcgcctgtgaatccatctggtcctggactctttttggttggtaaactattgattattgccacaatttcagatcctgttattggtctgttcagagattcaacttcttcctggtttagtcttgtgagagtgtatgtgtcgaggaatttatccatttctgctagattttctagtttatttgcgtagaggtgtttgtagtattctctgatggtagtttgtatttcggtgggattagtggtgatatcccctttatcattttttattgtgtctatttgattcttctctctttttttctttattagtcttgctagcagtctatcaattttgttgatcctttcaaaaaaccagctcctggattcattaattttttgaagggttttttgtgtctctatttccttcagttctgctcttattttagttatctcttgccttctgctagcttttgaatgtgtttgctcttgcttttctagttctttcaattgtgatgttagggtgtcaattttggatctttcctgctttctcttgtgggcatttagtgctataagtttccctctacatactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgcagtgtggtctgagagatagtttattataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttgatgcaaggctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttaaattgatccctttaccattatgtaatggccttgtttgtctcttctgatctttgttgatttaaagtctgttttatcagagactaggattgcaacccctgcttttctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgggtattttgctcgttagttgatgcagtttcttcctagtctcgatggtctttacattttggcatgattttgcagcggctggtaccagttgttcctttccatgtttagcgcttccttcaggagctcttttagggcaggactggtggtgacaaaatctctcagcatttgcttgtctgtaaagtattttatttctccttcacttatgaagcttaatttggctggatatgaaattctgggttgaaaattcttttctttaagaatgttgaatattggccctcactctcttctggcttgtagggtttctgccgagagatccgctgttagtctgatgggcttccctttgaggataacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacaccaatcagacctagatttggtcttttcacatagtcccatatttcttggaggcttttttggtttccttttattcttttttctctaaacttcccttctcacttcatttcattcatttcatcttccattgctgataccctttcttccagttgatcgcatcggctcctgaggcttctgcattcttcaggtagttctcgagccttggttttcagttccatcagctcctttaagcacttccctgtattggttattctagttatacattcttctaaatttttttcaaagttttcaacttgtttgcctttggtctgaatgtcctcccgtagctcagagtaatttgatcgtctgaagccttcttctctcagctcatcaaagtcattctctatccagctttgttccattgctggtgaggaactgcgttccttttgaggaggagaggcgctctgctttttagagtttccagtttttctgttctgttttttccccatctttgtggttttatctacttttggtctttgatgatggtgatgtacagatgggtttttggtgtggatgtcctttctgtctgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgtgagaaccactgctctcttcaaagctgtcagacagggacatttaagtctgcagaggttactgctatctttttgtttgtctgtgccctgcccccggaggtggagcctacagaggcaggcaggcctccttgagctgtggtgggctccacccagttcgagcttcctggctgctttgtttacctaatcaagcctgggcaatggcgggcgcccctcccccagcctcgctgccgccttgcagtttgatctcagactgctgtgctagcaatcagcgagactccgtgggcgtaggaccctccaaaccaggtgcgggatataatctggtggtgcgccgttttttaagccggtcggaaaagcgcagtattcgggtgagagtgacccgattttccaggtgtgtctgtcacccctttctttgactcagaaagggaactccctgaccccttgcgcttcccaagtgaggcaatgcctcgccctgcttcggctcgtgcacggtgcgtgcacccactgacctgcgcccactgtctgttactccctagtgagatgaacccagtacctcagatggaaatgcagaaatcacccgtcttctgcatcgctcaggctgggagctgtagaccagagctgttcctattcggccatcttggctcctccccctcggtaactttttaaaacatgtcattttatcattgtatgttgttttatgaaaacaaaattgattgatttttttcagatattgactttatatacaacaacctttctaaactcgttaatgctcaacatttatctgtaaatttttttatgtacacaatcatgttttcatttttccttttaagtcctgaacatttttactttcataacacagtaataagtaactctagtacaatgcacaatggatgttgtgatggtagactttcttgtttttttccaacatttaattattaaatatttgagagacatactttagtttaagaaagttagaatcttagtttgctgaaatttattcaacttgaactacgttgagttatatttaaaaatgtgtgcctacattgacttactcacataattttctccttatttgtttactgtgatacatcttcaagctttattttcaaagttatactggcctcatgaagtatgttgggaaataatccccttatttattcaaagaatctgtgtatggttgatgttatttttttcttacatagttgatatcacaagtaaatacatttggatctacattgtgccatccaaagaatatagtatgatataatatctctttagatgtagatttatatttttccataagatttggtggttattttgttgttgctgtttaatctttctaattttaaattaagagagtacgtgtgcaggttttgtgattgtattttcatgtaggacctgtaattatcttgttaaagttttaataagatttttaatgaattttgtcactgttgcaaatagactattttccctttttctatctctggcacttgttcttggactagttaaacctctagattattttatatttatcttgtatccagccagactattatattctctcagtaaatccagcatagtttttagaagagtctcagattcgctagtcctacagtcaaaaaaaaaaaatcaccgataaacaagagatcattttataccttgttttccaaagttatacaagttagtttatactcttatcatagtgaaaattaataacataatgatgagtaatggggtaaactggcatcttgtccaatttctaaatttaatgtaattgaaatacatttattgtattgctatttataatatttgttgtaggttcttagtaagttatctttatcaaaattaagggcactgcctttatcccttcattattaaaattttaattaggaatggcttctgtatttaatcaaattactcttcaatatctattaaaagaccaaaaatttcttcacaaatgctaatatcagggattatattggtagatttcatgatgataaatcgcctttgcattcctggaagaactcttgttttttctgatgtgttattcttttggtacttttttgggctttatttgttaatattttattttgaactttgaatctataataatgaatgctattttctctagtctcctgttttagtgtttttcaagttttgctattgacactgtattgttttataaaatgtgttgaggaatttttaaactttcatggctattcatcttttcatatatgttaacttagagattgattataattttttgtttccaagtgctagctttgggattacttcacagttgtccccacattcccatacatcttaattaaattatcagaatactgaacttttattcttttctcaaaggcaaaaattgtctacattacttcatgaaaataaagtccttttgtattttctttgaacagaagagctgaaagattaatgtcttgtattcagtctttgcctttttttattattggtggggatacctgtgattgctggagtcattaaaaatcatgtaacatttgaatgaatgaacaaacatataaaaatgtcttatgaagcactatacacaattttttcccctgaaaataagatttcatttcactcaactatgaattggcctcccctatggaaagtgtgctatagcctcttggctattcaactcccttcaaaccttttacatattaattgtataaaatattgctggctcacataattccacacattgttctatgctctatggataatggaaaaataaacaataattactgacccaatggagcttatgttctaatggttatggcaacagaattctccacatagtgataatcaggatatacttgtgcatttgaagcacaattggaaacataatttctgcaagtgaaacatgtcaaggagaatacaaaaaccctccacatgatcaacttccatggtggatacaatctgagggagttataggaaaatgatgaacaataatgaacttttggttagaagaacttctcatgatgtatttcctttccttattgcactggttgaattctaataattggtagtttgatttctagtatggccatataagcacttctattgttaaccttttggcaaataaaagctactaacttggaacaaaacacaaagaacaactaccttaaggtattggacaggaatccaaaacagagatattggcaatcacaacacttggaaaaaagaaacaacagaggttgagtttccaactttcaagacttatagcttaagaggaagatgcaatttctgccagaagaggtggctaaaactccaataaaaaaatctttagtttttttggttgggtgtgggggcttatgcctgtaatcccagcactttgggaagccaagacaggtggatcacttgaggccaggagttagagacccacctgggcaacatggcaaaaccccatctctacaaaaaatacaaaaattagccaggcagggtggctggtgcctgtagtcccagctactcaggaggctgagataagacgattgtttgagtctgggaggtggagattgcagtgagctgaaatagtgtcacggcacaccagcctgggtgacagagccagatcctgtctcaaaaacaaaacaaaacaaaacaaaacaaaacaaaacaaaaagtcttcagtttttatggcctgaagaacctgaggaatttgcaactggaaggtgaaggagcacctaggaaaaggtaaagatagagagaaccacaaattcttctctgggaaactataaactctgcctaaatctctagatgacatttaaaccgtgcttgcctgggatatcctacaagcaacctaagaaatgataaatgaactgaattgacatttgagctgtagcccaaatgaaagagactgcagtttgagtccaaccaagctgattgctggaaaaacaaaaacaaaaacaaaaacaccaatactctttggagcaaaagaaccaaatccagcatctcaacgacatggcattcacaatgtttagtttacaatctaaaatattttactttaagaagaaacagggaaagacaactcattcacacacacactaacacacacacatatatacacacacacaacttttaagagacctatcctgagaatacccagatgttaaaattcaccgagaaagattttattgctgctattatatttatatcaataccatcaaagaaaatatgctcataattattgaaaatggaaaacctcagaagataaataaaaacaacaaaaataattgaatggcaatttgtgggctaaaaaataatatatgaaatataaaattatcctggatgagtttaacagtataatggagatgacagacaagaaaagccagtgcatttgaagatagatctatagaaatcgtccgaaattaagatcagagcgaaacacattgagaaaaaaaagaatggactctcaggaatctgtgaaacaatatcaaatgctctaacatgcatgtgatttgagacccagagaatgagagggaaaatgggaccaaaaactatttgcaaaaaaataaggactgaaaaattttcaaatttggtgaaagccgtaagtttatagactcatgaagctcagcaaataccaagcatcataagtataaattctgatgattaatctaagaaaattttactatccaaatatgtataaataattcatatagattgaagcagcaccatttataatggaaaaaacaaaaaatggcaattttactgcctttaatagacatctaagaacttgttatatactggtgaaggttgagcatgtcgccaacctaaacaagagtattataaaagaacaatgagttatacaagatctcttactaatggacaataatgttcacattaaaagtagaggggtttgatcgctgcttcattattatcaagaatgaagcaccagttcatcagtctgtatcttgacatatccttcagcccattctggaagaaaccaaaaatgtccaaaggaaggatgctggttaaccttccagaatatttcaacagccacatttcaccttacttttccttacttccccaagaaaacaagattctgaattgtttatttatcctgtaaggtagtcatgcctactaaggttgcataggagaagagcccagtatctaagataattctcactaacaactccagcagactagaatatgacacatcgtaaaacaattcaccaacagcagatttacaagttggttttttgcctgattcagttgctagattctagatgccaatgtcattacaaaaactttaaacttttaatgatgctccaatatggaaactttaacactactgaaaatagtttagatctcaagttttcaagtaagaacaccaatgttaaaaacaacttacttgcggctgggcgcagtggctcatgcttgtagtcccagcactttgggaagccgaggcaggccgatcatgaggtcaggagatcgagaccatcctggctaacaaggtgaaaccctgtctctactaaaaatacaaaaaattcgcctggagcgatggtgggcacctgtagtcccagctacttgggaggccgaggcaggagaatggcttgaacccggaaggcagagcttgcagtgaggggagattgcgccactgcactccagcctgggtgacagagtgagactccgtctcaaaaaaaaaaaaaaattttacttgaaatgttctgctaatttcggcaccagctcaaagtcagacttaatgccacaccagagactatcatgaaaatggcaacagtaattcatctggtaactgttaaaagtaaaaataacaagagtttctgccacttattaatctttacttctagtatctaacaaaatgtttggcatatagaaaacaaatagctaacatagggtaaattaaggaataaataagtaacgttaaagtaatttatatgaggaggaactttattgttctgtctctccaaaagagcaagaaaatgacctggaaatagttgtcagaatcaactattatgaaactcaaacatcaaatcaaaaatttaaaacaaacaaggtaatgctaaatgaagaagaaacccactgctttgcagtaagggagcactgtagggttttaagctgcctgctaccatatcccatttccagatatgcagctaatttgaggatgaaagcctgcactcctgatgcaagttgctagtgccaaagaaatacagatcttttcctcaaagaaatgtgcttgtctttttagacttctctgatggccccctgaaggactgggacagtaacttcctttgttttgcctgactcagagcatttccagggctcagatgatgttctggttggagtttgccaaaagtattaaaaggcacaagcattgtttgcaacagactaggacaagtaacactagaccacacaaacaagaaacaggctgaatggcctgggaagaaagaggttgggaatggagatacgttgggaaagaaaactttatttttaaggaactcaaatataacagagaatggaaaaagctacacatggcgtgcctaaggatgtcagaatgctcagaagaagcctggaaagacactattcttccacctgtgaccgggctgtccatcagcctctgagattctgctgaagtataaagttgaggctgaggcagagttataaacaacctcattaagcattgaaggaaggtcccaaacagacccaacctgcaaaaagtaagaaagcattcattccttttttttctttgcctaccggtatttaagaaacccctgtaaaagtgctaggtaaccaccaaactaacaggatgctgattttagctgccacagaagaccaagaaaaaagaaaacagactttataaaaatagttttgaaaaatcactaaacagtcaaacaaaatcagtccaaaacaagtagcaacaacttcaggaagggaagaaaatctgatttacagatctgccacattgtaatattaagatgtccaagttttaccaagattaaaaagcatgcaaataaactaggaaatatgacctattttcagaaaacaaaatagaatagaaactgatcatgaggaagcccaagcattggacttaatagacaaagactttacatcaactgtctcaaatgtactcaaagagctgaaggaaaccatggagtaagaattaaagcaaaccagaagaacaatgtctcaagggatagagaatataattaaagggataaaattgtaaacaaaaaacaatggaaatatggcagctaaaaattataataactgaaatgaaaaattcacatgagggaatcaataacagactttagcagacagaagaaagaatcagagaacatgaaaacaggtcaattgtgattatccagtccaaggagcataaagagaaaataataaataaaaatgaacaatgcctaagggacctttgagacactatcaagtttaccaatatatgcacaatgggatttccgggacatgagagattaaaaggatcagaaaaaaatatttaaagaaataatggccacaaactttccaactttgaataaagacatgactataaatccaggaagctcaatgaactctaagcaagaattactccaaaatatccaaaccaaggtgcagtataatcaaactcttgaaaggcaaagagagaatcttaaaagctgcaacagacaagcatctcatcaaatacaaagtatctttaacaagataaacagtgaatttctctacagagaccatggaggccggaagcagtgagatgacatatttaaagtgctgaaagaaaaattgtcaactaaatgctctaaatctggcaaagctatccttcaaaaatagagaaattaaaacactcctggtaaaagagcaaaaacaaaaacaaaaaatcagaaggagttaattactagtggacctaccctaaaaaaaaatgctaaagggagtccttcaggatgaaatgaaaggacgccaaaaagtaccttgaaggcatataaagaaataaaaaacaacaaaagtagctacaaagcaaatataaaatccagtggaattgtactatgggtttcttacacctgttttgactttctatttcctttaaaaggcaaatacataaaacaataattataaatctatattaatgagcaccaaatgtataaaaaatgtaatttatgaccaatagcaacataaaaaaggatgaagatgtaaagaagcaaaatctttgtatagtattgaaactgagtatctataattaaaacttgattgttatggaagaaagattataattgtaatccccaggttaaccaaagtaaacaattaaaataatacaaagagaaagagacaagaagagaatccctacaaaaaaatcagttaatcacaaaaaaatcacttaatcacaagtgaaggcagtgacagaaaaaaatgatagtatatgttatagataaaatggtgcaagtgtcttttctttactgtaattactttaaatgtgaaagaattaaattttccagttaaaaggcagacactagcaaaatggataaaaatacatgatccaattatatgctttcaataagagactcactttagacataaggacacatgtatgttgaaagtgaaaggatggaaaaagatattccatacaaacagtaaccaaaatagagttgaggtggctgaacttgtcagacaaaatagaacttacaaagatagttgttgtgaacaacatcaactaaaagaagaacatcatctattgatttcaagccatcaagaacatataacaattataaacatatatgtacctaacaacagagcccaacaattatacgaagtgaaaaataaaagaattaatgggagaaaaaggtagatctataataatatttggagatatcaatactccattttcaataatggacagaacaacaagacagaaaatcaatgaggaaaatagaggacttgaacaacactataaaacaactaattctaacagacagatacagaacattccatctaataacaacaataaatacattttttctcatgtgcacatggaacattctctgggatggaccataagttttaccacaaaacaaatgtcaatacatttaaaatattattattatttaaagtatcctaatacatttaaaatattattattcaaagtagaaatcagtaacagaaagaaaactaaaaaatttacaaatatgcaaaaattaaacaatattaaacaaccaataagtgaaagaagaaaatacaaatgaaattcaaaaatattttgagaatggcagaataaaaacttaatataccaaaaaattatgggatgcatcaaaagctgcgctcagagggaaatttatatctgtaaatggctacatttaaaaataaaatgaactcaattaatgacctaactttataccataagaaactagaaaagtagagcaagtttaacccaaactcacaaaataactgaaatgatgaagtttagtggaaatataaaaaataaagaataggaaaaatataaggacaattaataaaaccaaacgttttcctttttttgaaaagatcaaaaaagttgacaaatctttagatagacagactaaggaaaaaagagaagacacaaattacaaaaatcagaaatgaaagtgggggtattactactaaccttacagaaattaaaaggattggctggccaatcctcctggtgtggtatctcatgcctgtaatcctcgcaccttgggaggccaaggtgggaggattacttgagcctatgagttcaagagcagcctaggcaacatggtgaaaacccatctctacaaaaaaaaatttaaaaattagacaggtatggtgccacatgtttgtggccctagctactcaggaggcttagttaggaagattgcttgagcccaggaggttgagactgcagtgagccattattacaccactgcaaactagcccagacaacagagcaagatcctatctcaaaaaaaattaaaaggattataaaacaatacaatgaacaattatacaccagtaaattaaataacctggatgaaatgtaaaaatttctaaaaacacacatactaccaaaagtgactcaaggagaaataatctgaagagtcatataaaaagtaactacattgaatcagtgatcaaatacctctcaacaatgaaagctcaagacaagaagttttccttttgaatttcaccgaacatttcaaaaattaacaccaattcttctcaaactcttctaaaaaatagaagatgaagaaacattttgtaatatattctattagactggcattatcttaatatcaaagccagctaaagacattacaagaaaattatagattagtattgtttattaatataaatgcaaaagtcttcaataaaatactagcaaactaaattcagcaccatattatatacccattactaaatgggatttatctcagggatgcaagagggattcaacatacagaaactaatcaatgtaatgtatcacattaatagaatgaaggtatgcaaaccacatgattatgtcaattgatgcagaaaaagcatttgcaaaagtccatcacttttttatgataaaaaaatgttcaacaaactaggaataaaagaaaatgtccttgacaggcatttataaaaaacaaaaacaaaacccagtcaatagtgaaagactgattttcctctaagatcagggaaaaaaggcagaatgcccaacttcattagttctatttatcatggtactgaaaattccatgtagagaaattaggcaaagagaggaaataaaaggcagaggaaaattggaaaagaataaatcaaattatttctatttgcagaagacatgatcttatatatggaaaatcccaaagagtcaacacaaaacatagctctaataaatgaattcagcaaagttgcaggacatttgtagttctatacacagtgatgaacaatccatgaaagaatttaagaaaacaattctatttacaacagcttccaaaaaaacctcaattgataacagcatcagccacaaagaagaattaagtattgatacatgctacgaaatagataaacctcaaaaacattagctaggtgaaagaagccagacccaaaaagtcacaaattgtatgattctatttatatgaaatatccaaattagttaaatccatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtggggggaggggggaggggtagcattaggatatatacctaatgctaaatgacgagttaatgggtgcagcacaccagcatagcacatgtatacatatgtaactaacctgcacattgtgcacatgtaccctaaaacttaaagtataataataattaaaaaaaaaagataaaaagcaaattagagattgccaggagctggttgatgggagaatgggaagtaactgcttaacggtatgcagtttccttttggagtgatgaaatgtttctgaactagagacagatgctagttgcacaatattgtgaatgtactagatgccattggattgtacactttaaagagattaattttatgttgtgtaaattttacctcaataaaatatatgtcacgctgaaggtatcattatcatgatcaccatcatcatccctatagaaaataatgcttcctaaatttcactttctttaaaaggtttagattatgagaaaatataagcagactaaaatttgagactatagtcagtacaatttggatgacgtgttcttgtcttctctctgttctctttcagattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtaaataaaactttttggccataagaattgcagcggctatgctcaatactttcggattatgtactgtgaacaacgtacagacgtcgactggtaacatttgcgtttgatcgggttcttttatttagtaattattcttaacctatttatctgatatttaggttaacaataatgaaaggaatgtaatgtgtattaatatgtaaatataaagtttccatttatgctgctaaattattttatgcattagtatgccaatgaattctgcaacacagatacaaaatgtttgaaatatttaaaatgctttgaaaatgagaaagacataaagtctaattaaagtctaaattttaaaaatataacatttcaatcttatattgaaaagttacatgtatcccagaatattaaccttagtatttttattctaaattcctatccttttcagtagaaaaattaataatgcaatctaaatcatcatcaagtaaatatgtctaaatttttgttgctatgacacctaaaatgtactattttctctcagttttaattgtcttcttgaattctgggtatacaaaaagaaaaaaaaatttgtttctttaaagatttgtagcagtttaaagggaaagaaatgatcatttattgcttatatttgaggtattcataaatgccttaacagtgctaatattaaagccaagaaatttaaacaattggactttaggggttttactttcatgtttttttccttttccagttggtgtaaataatttttcttcatatttatgtttttgtaaagattgaggtaaagtgtgcaacaagatcaagacttctatttaatcttcactaatatcatctaaatattttgactctgggtttattgatcaaatacatttaagttttaagattgttctattgtagattgttctgcctgtgtatagcatagacacctttgaataaaaagtcgtgaagcttgtcccaaaagacaaaaatgaatttacgtaagtttgacttacaaattcaagagttcacagattttgccctagccatcacaaagagttcatctaaaaagatgccagcttttatggtgcttacaaaggaaatacacagacagaatattgttgcatcagcttctagtaatgaaagactgagtaatttgcaatgactcttgtgctaaaggcaaataaacacatggataaaacactaaaagccctaagaagctaatgaaatagaaattgctattggctaagatccagaaaaagacaaaaacccaagaaaaatgattatgacttctagttcacttttgccaatgatgcattataaacctgaagatatgactgacaggtggagacgatcatttcagactcgcaagcaatggaggactagagtaggaatacagagtctggcaagggccaaccaacctgaatttaattctgggatcacaaaaaaaccagacactaggaataaggatcgaccaggattaaatcaccatagacatggaattcagccctggttcaagtcatctatgtaaatgagagaaatcttgggccttaaaattggattaagatgatttcgtattattcaggtttccaattttggggcataaacaaacaaaaaaaaccccataatcctagatttcaacttatttctttcaataattttcaaatgctgtcactgaaatacaatgatatgcagatatatgaggagacaatacaacatgaatcaggtatgggacaataagagataacagaaataaacttacaaacacttcagataattgaattatcagacatacactttaaataatcatttggaatgtgcacatggaaattacatgctgatcttaaacacttcagcaagaaactgcaaactataacaaatgacattaagatttgagaaacacctagaaaatatggaacttaagcataatatgaaaaactaagggccaggcagtgtcttacacctgtaattccagcactttgggaggccgatgcaggcggatcacttgtggccaggagttcaagactagcctggacaacatgatgaaaccccatctctactaaaaatacaaaaattagccaggtatggtagcacacgcctgtaatcccagctacttgggaggctgtggtgggaggatcacttgaccctcagaggtcaagtctgcagtgagctgagatcatgccactgcgctccagcctgggcaacagagtgagactctgtcacacacacaaaaaaaattaattaattaaaaaatgaaaacctaagaactctgtggcagattagagatggcgaatttccaaatttacagaagattattataaaatattaaaaattagctgggtatggtggcatgtgcctgtagccctagctactcagaaggttgaggcaggagcatcacttgaactcaagtgtcttgaggttgcagtgagctatgatcgtgctatgacacttcagccttgatgagaaagcaacactttgtctctacaaataaaagataaaatgaaataataagataaatccaaaaggagtcaataaaagatagaaaaatataaaacgtatactgaatggcagaattaaaaccaaatatatccctaattatatgaattactaaggattctaagactgtcatataggctttcaaaaaaataagacaactatatgttacaagaggcatatataaagcataaagaaagtaaaaggataaaaacaaacaaaaaaattcctccatctaaacactatccaagagaaagactgtatagctatattaatatttgtcaaaatagacttttcggcaaaaaacaaatactccagtgaaagaagattacttactatgaaagatttaatacatctggaagacataaggtaataaatttgtatgtacataattatatgtagatacatatgtaatatacatagtatatacattataaagtaaaagaggacagaacttcagggacagatagacaagtctacaatcatcgcataagatcttagcacatccttctcagcgattgtatgaaaacaattaacaaacctgaactcactgacaagtgaagaatacatattcccatcattgcacaagaaatatttatcaaaactgaccataaagtaattcctcaacacattccaaagggttggaataaattgtttattctttgactgaaattcaaaagaaatagaaatgacttcaaaatagtagaaaaaccttcgtatatttggaaattaagaaattgtttcccaataaactttgacctaatggatttcaaatccattgatgattcttccctaagctatctattactaaggtgatacaatgataatttttctcattttattattcttcctgcctttatttgttggtattatactgtaaggaagtgttttccctccaagtctttgttatttattagttcatgttggtggagactcctggattcttttgtattcagtgtaatatatatgattcattattgcccttaattattttgatgctcaaattgtctcatatttttctaataagaactccttttcatatatcccatcagcttttgagcatttgccagactcaccttttactttccatgccccagttccgaaattagccatttcttacaagaaacccttttagtgggcaatggttttataaagcaggatgcagaagctcagtatgctcattgctaataggatatcattgctcctatatatcaatacctttaatcccaattcacgaacacaggactcttgctactttccaattctttatttttcctcatttttctcacagtgagtaactttgtccccaaaccattgatatatttattatttatattttctatatcctaccatacaagaaattaatttcagaatttctatacccataccactaccaataaatgaaatgcaatgtttaaaatttcattgcaattttatctttagaatgttttccaccaatggcatatagtcaaagcattgtcttcaaaatgctaggattagtttgaattttttttctctgtggttctgataccaattgttcacatttagggattttgttttgtttttgcatgtattccccaaccttgttgactttattttttaatatgtaaaactttaatatgatgctccaacagtcaaaactaggcaaataaaatactcagagaagagtcagttcctcttctattccgtggttaacccattcattagtttctagggcatacttcttgaatttatttttgcaaaaaaaaaaaagattatacacaaatacacgtattgttatttttccattcttaaattaaaagttaaaatgctacatacaaattaatactttgttttgctttgttcttttacttggaaatatgtcctggaaatcactctatcaatttgtaagatgatagatatgcacccaactttatcatgtaaatggcctaaatactccaattaaaagctaaattcattctattattttttacactcactaataatagattgtgttgatatactttatttaaccaatcttctgtgtataatcaggtaagttgtttccaacatttggaagttgccaataattctactaagaataattgtgtgtgtgtgtgtgtgtgtgtgtgtgtcctttgtgtgtgcgtgcgtgcatgtgtgtctgtcttgtgtgtttgtgtgcgcgcgcgcgtgcatgtgtgtgtttcatattattggaagtttaacttttaaataaattcttgctcaaatgtattcagaatttatcttctaaataaattcttagaggaggagttgattgatcaaagggtacatgtagttaggagttgaaccattttgcattcccaccagcaatgcaagaaagcctctgtttccccaaagccttgctaatgaagtttattttcaaactttttagattttgcaaatcccataagtgagaaatgttacctcagtgtaattttaatttgcatctattttatttggctgaagttcatatgattaaatgtatgaaaaccacttcagtgccattgctaaatcagttttaagtgtccttttgctcattttttctgattttttttcatttttatttcttaatttaatagctctttataagttatagacactaaccatttaacatgttataaatgaaaatattttctgtttgctatttgatatagctatggtattttgccatacaaaattattttattttcatgtagttcatcttgtcaatcagatttcctttttatgttgagagtaatggcaacaaattctttcccctaactcaggttggacaataaatcacacatatttttctcatttttacatttagacctctgatacatttggagtttattcttgtacgttgtgacatacacattcaattttagtctcttaaaactaattcttccattgtctcatgctatttatttaaaaagtccatctgtcctgtgatatgagatgccatctttatagtatattaaatattcttatatgcctggacatgtttctgaagttcacattttattccactacactgtctaatcaaatgccaatttcacacttttaattataaatgctattacataaatgttattatctgatatggttagtccctattcattaggcattttttagagcttgtgtagacattactgaaagtttaattttccatattaacgttaacattaacttgccttgttctattctaaaagcctggatattttgacagggatctccttaaatttataatttaatttaagaaaaaatgaacaactgaattttaaaaatgctttctctaatctgtatactaatttaggtggtggccactctgtcttccaaactttactgccaaacctatatgtcactctcatgtcttccttatcaacatttataatgtatctcataagaatcaattttttagctttaccacaaaccaaatctgtcttctatgcattcactagtgactacttaattgtttaatttatgaattttcaaactttttggtctagtgatctctgtatactcaaacattattaaggattccagagagtttgcctttatatgagctatatccatcagcatttaatgtctttgaaattaaaattgaaattttaaattatttttgtctacatttatttaaaataacaatagtaaatccattacatgttaacataaataattagctctattaaaaaaagctatattttccaaaacaaaatcaacaagaagagtgacattgttttagttttttctttttttgacttttataaatttagggggtacaagtgcagttttgatatatgaatatagagtatagtggtgaagcctgggcttttagtgtaaccatgactcggtaacgtacaatgtacccattaaataatttctcatccctctcaccatatacaaaaattaacacaaaatggatgaaatccttaaatgtaatatctgaaactacaaaaacactagaagaaaacctaggaaaaaactctgctggacaatggcctaggcaaaaattcgtgactaagaccttgaaagcacaaacaacgaaaacaataatagacaaatgggatttaaactaaaaaacttctatgcagaaaataaataatccacagagtgaacagataacctgcagaatgggaaaaaatatttgcaaactatacatccaacaagggactaaaatccagagtctataaggaactcaaacaactcaacaacaacaaaagacaaccccattaaaaactggggaacagacatgaccaaacatttttcaaaagaaggcatacaaatggctaacaagcatatgaagaaaatgttcgatgtcactaatcgttagagaaatgttttacagtttttcaaggtgctttaatcatctgacttaatagaagatagctagattctcatctctgtttttttcatccaatttattgcaacaatttgctgtggttcagataattgcggtcattcttatttgacagtgcactaaaactctgcaagtagtagtttcttaagttctgtggcaatgtacaatcagaaaccaaatcactgacttttttatatactgttacattaaaatccactaatgtatctagaaatggatatttcaaatgaatactttacttcagtacttcacatggatattttacccatgatttatattgtaacatcaggcataggtcattaagaaaatattggttcaccgagttacacatattttctcaatgttggtatatttcactatacaatgtcaaaaatcatatacgttgataatcttcatcaaccttaatggaaaaatcttaagatattgggaaagttcaatctcccagagatgaatagacattttccaaaaattacattattcacttgaaacctcagattttatcattggcagcaaatagcatctattttttgcttaacttgacaggctcaagtcatccattattgagaaagtagctgccaaatacccaagtctgaataactctagtgtgtctaacagtcaagtaaagatgttagtctatgaaaaaatacatggctagttaatcttgcaactctaacaattgcataggtactttttctcaaagcaaccatctttttttttttttttttttttttttttttttttttttttaccaaagctgtacatatattttaaacatgaagatattttggaaaatcaggtctaagttttctttctccaaacaggtatgtttaaattctttataatttttttccatacaagagaaactttttcatggtacaaaggatgaaggtaaattacagtcctgtaggcagtcctgttagagtgactgttctatacatattattgaacattttaaataaagggtattcaattaggaaaagaggaagtcaaattgtccctgtttgcagacgacatgattgtatatctagaaaaccccatcgtctcagcccaaaatctccttaagctgataagcaacttcagcaaagtccaggatacaaaatcaatgtacaaaaatcacaagcattcttatacaccaacaacacacaaacagagagacaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtatcaaagcaaccatcttatatcagtatgcagaagatgcgctcttcctgtacttctcattttcttacataggttgttaagaagatgtgtacccacatgttgagatttaataaaattaatattttttactacttcataaagtatattcttaagtaatagtggcttctttccccaaaagtacatagtgataaagaatacaataacttcttgtacagtttggtgtcatctgcttgattcatgccaaggcaccagcagtttcacccaccattacattggcattatcagtaaaattgtaaacacattgaaaatagcaaataacatattaatatttctatggaaatacttttgacttcatgaaactattgaaaaggtttcagagatacataaatgttcatggaacacactttaaaaactaagtttccggtgctagctccctttgtggtatttgatatagtcaatgatgttttgttcataattctccgattctttgctacctatgacacaattttcatttggtttccttttctcctatttctctgtctgctccaaatcattttcttcattttctgctttatccccgttcttccccaggattctgttccttccaattgcttatatacttttcctggcttgcatcatccacagaaataattaaaatctatctaccaatgactcttgaataattatttctattaatttctatctggattatatgcagatctatagcttgtagaaaaactcttagctcatgttccatataaaatagactacagaccagatttggccgatgaaccatagtttgccaaaccctggtcctaataattgtgttctggcaagtatatagtgacatctagtcctggtatttatctttaattccctactgactcataatgttgggcactttttgttatggtttttaagcatttcgacgtcctcttttgtgatgaatttttaacaccatttgcctattttcaattttttaattctagtgtttttttgtatagtctagataagagttctttgtcggatatgtatagtgaaaatattttttcccaatctgtgcatgaccttacactcgtttaaagttcaatttgtcagcgttttctttaatggccagtgattttttatccggtttatgaaaagttttctcatccagagttcaagaggatattcaagaggataacctcctctgtctttgtatttccttcctttcttaagtgtttgatcatcttagctttcacatttaggtccaggagccatcttaacttaatgtatacgtctgatgcgagctagagattgaattttttccctatgtgaatatccagttgactcagcatcatttattggaaagattattcttgcctaccgaattacaatggcgtcattctcataagtcaggttaccttatatatgttgtttctcctgggctataagttctgttctattgatctaatattctgtccttgtactagtattacaatgtcctaattactatagctttatactaagtcttctaatctagttgagtaagtctgtcagctgtgttcttcttcaaaattttctgggctagcctaaggccttttcattttcatataaaactaaaattagcttgtcaacccccaaaacaaaatatgctattgttttaaaattggtattgcattaaatctataagtcagctaagtgaggatttgtcttaacaatactatggcttccaatccatgtacgtatgcatatgtacatgtaaataatctactatttatttaggccttctttaatactctgttatgttttatttaatttagaggtcttgcacatctttgttagatttatcgttaggtacttgatttcctaggatgctattgtaaatatttctagttgcttgctgctagcatataaaaataaaatacatttgatatttttgcatttactctatacccagctatctaaattcacttaacatttcttggagtttgttaaaagattcattggaattttcagcgtacctagtggtgtcacttgtgaatgacgacagatgtatttctttttcttctatcttaaaaatttttttaattaattgttcttgcttgattgcactggtaggacttagaaaatagtgtttaatacaagtggaagtagtagacatcttttttttttagtggaaaactgctcagtatttcaacattaagaataatatttgtaagttttgtaaaatgtctttcatcaaattaaattcccttttattctatattttctgtgtcttttttatcataaatatgtgtaacttttccaaatccttttttctgaatccactgagatgattataggatttatttcttcctttattctgttagcatggtaaattgtatacatttttgaattatatcttgcattcttgaaataaatcccactttgtaatgggctttttttttctatatcattggattattttttatattttagttaggatgttttaatccattccaatgagagattttgccttgtcattttactttctttagtggtatccttgtctagttttggtagcagggtatgcaagcctcataaaatgagtttgaagctgtcccttttgacctaccttatatgtttgtgtaaagtttgcatctttttattttaaaatgtttggaagaattaatgaatgtagtcatttgatactgtcaccatctgagcctgcagggtggtatgtgtctgtgtgtgtgtgtgtgtgtgcgtgtgcatgcatgtgcacatatgtgtaaaggttcttaattatagattcaattgcttcaacatgaatggcaatattaatattttcttttgtgtgtgttagttttggtaaattgtaattgtcaaagaatttcttctaaggtttctaatttattggcatcaagtggtgtaattaccatccttttaatgtctatataatgtgtagtgacttcctgtttcgcccagagaatggttatctctgttttctctctttttgtgtttagtttactaagagtttataatttttttttaacttctccaagaattatcttttggagtcatcaattttctccattgtttgtccattttctatgtcattgacatctaattttacctccttctttctacttactttgggtttcattttctcttttttaacttcttaaggaagaaagttaagtcagtgactctgggccttacttgatttctaatatacacatttaaatccataaatttttctctaaattctactttagctgtatctcataactgttgatgtgtattttaatttcagctcaaaatatttactaattcccttttttaatccatggattatttggaaacttgtagtttaattttcagacttcaggaaattttcaaggtatctttcttattgagttgtaattaatgccacagtggccagggtatatacactttatgtttccatcatttgacttttattgtcattgccttttggccagcatatggtttacagtgataaatgttctatgtctacctcaaaagactatatatattatgatgttgatagacgtagtaacagaatgtgtgttttgtaacttttctatgtgtattttctagttactgcaagagttgtgttaaaatctctgacaatcatcatggatttgtctatctctccttttagtttttttaacatttgttctataaattttgaggttatgttatttggtttctttaataaataagattatatctttccataggattgacacttttatagttatgaaatattcctctttatctctcctaatactttttgccctaagaactaatttttatgatatatcagctttctttcagttagtgtttccatagcataacattttctatatttttaaaacaggctctgtctttatatttttaaataattcacttataaagagcatatagttatttcttaatataatctgaaagtatttcatttttagttgaagtttttaaaccacttaaacgatatactttagtttacatctattaatttttgttagttttttctttgtttctttattattctttcttttgtaaaaagattcatttaggtaaatttgatgtaagataacctgcactttttaaaatgtataatttgacaaatattacaatgtgcataaacccatgaaaacatcaccacactcaagatcataaagatagccatccccatcaagtttcctcatgcccacttgtaatacttccctccctcaatcatacttcactgtccctgaacaatcactgatctgctttctgtcactatgctctagcttgcattttctaaaatgcaatacgtatactttaaaaatatatatttaaggtatacaacaggatgttatgagatacatagagatagtaaaaaggttactatagtgaagcaaatgaatatattcatcatctcatatagttacctatttttgtgtgtatggcaagaacagctacaatccactcatttagcatgaatcccatacatagtataattttattacctatcgtccacatgttgtacattagatctctagacttgttcagcctacatatctactactttgtactctgacctgtgtctccccatcacccaactcccactgttttattctctatctctgtatatttcaatttttctttagtttccacatagaagtgagatcatacaaaatgcttctttctgtgtctggcttatttcatttagcatgtcttccaggctaatccatgttgtagcaaatggcatgatctcattctgttttagggctgaacagtattccattgtgtatacatatgtgccaccgcttatttatttattcattcattcatggattcttagattgtttccatatcttagctattgtgaataatgctgcaatgagcatgggagagcacatatctttacaatgtgacgatctcatttctatttctaatatttctaaaatattaattttgaagaacctccatactgttttccatgatggctgtactaatctacatccccacaagcagtgtacaagtgttgcctttcctccacgcatttgccaacacaggttatattttgattttttataatagctatcctaactggtatctcataacggttttgacttgcatccctgatgattaattgatgttgcgcacctctacatatacctgttggagatttttatgtcttccacagagaagtgtctattcttgtcttttttctaatttttaaacaggatatttgtttttccattattgtgtgaacaagttattgataaattttggatattaaccctttaacagatatatggtttgcaaatatttttttctcaattcataggaaccatttcatcttgtggattatttccttcactgtttagaagctttttaattcgatttaatcccatttatttatttttgcttttgtagcctgcacttttgacatgatatacaaaaattcatttccaagcctaatgtacaagagcttttcctttatgttctcttctaagagatttacagtgtctagtgttgtatgtaggccttttatacattttgagttgatttttgtgcatgatgtcagataagggtcaaatttcattcttttgcatatggaaatagagtttttacagcatcatttatttaagaaattatccttttcctattgggctttattgatgcccttgtcaaaaacaaattgacaatttgtgtttggatttatctctgggctctctattctgttttactggtctgtgtgtctgtatttctgcctggaccatacgatattgattactatagttttgtaatactatcttaaaaaaggaagtatgatgcctccaacttcatttgttctcagaattattttggctatttggggtcttttattattccatacaaattttattattgcttttgctatttctgataaggaaggcatcgggatttttaaaagggttgtgttgaatctctatattgctttgggcagtatgaacattttaacaatattaattctttatgtatatataatagttgtacatatttttctttatgtatatataatagttgtacatattttgtcacatacttgtgacattttgattcttgtgtagaatgtgtaatgagcaaatcagggtaactgggatatccaccacctcacatttatatttgttttggcgacgttacaattcttctcatctagctattttaaaatatacaataggttattgttaactatagtctcccaactgaactatcaaatactagaatgtattccatctatctaactgtatctttgaacttcttaaccaacttctcgtcatctccctcaactcccctacccttctaagcttctggtaacctgtcttactatgcctggcttatctcatttcacataattacctctaggtctactcatgctactgcaaatgacaggatttcattcttcttatggctgaataatattccaattgttgtatatatcacattttctttttccattcatctgttgatggacacttaggtagatttcatatgttggctattataaataatgctacaataaacatgagagtgcagatatctcttcaatatatattaattttcttactttgagatacgtacccagcaatgggaatgctggattatgtggtagttctatttttagttctttcaggaacctccatactgttttccatagtggcagtactatttcatctccccaccaacagtgtatgagcactcccctttgatatgttgtgtttctattgttgtttgactcaagatattttttagtttcccttttgacccattggttgttcagaagcatgttctttgcttttcacatgtttgtgcattttctaatattcctcctaatattgatttctcgtttcgtgttattgtaatctgaaatgacactagatatgattttagtcttcttaaatttgttaagacttattttgcagcctaacatatggtctatcctggagagtgctccatgtgtactggagaggaatgtgtattctgctgctgttggatgtaaagttctgtgtatgtttgttagatccatttggtcaaaagtgcaattgaaatccagtatttccttattatttgttatctggttgctttattcattgttataagtgggatattaaaatctcctactattattgtattgctatccattttgttcttttatgtccattaataatttttgtatgtatttatgtgctccaatgttgggtgcataaatatttacaatggttatgtcctcctgatgaactggctcttttaacattaaataatgtccttttttgtctcttgcaaaaatttttaacttgaagtctacgttaccagatataagtatagccacctgctccctcttttggtacatttgcatggaatatcgtcttccattccttcactttcagcctgtgtatgtctttaaagcataagtgagtttcttgtaggcaacatagttggctctttttttttttttccactcagccactctgttttttgataagagaatttaatccatttacattcaaggttattattgacagataaggacttgctactgccattttcttgtttgttttctggttattttgtagctattttgttcctttctttctcttttatagtttacctttatgaattgatacttttctgtagtgctaagatttgattgctttttctttagcattggtatatctgccatagatttttgttttgtggctaccgtgaggcttatataaaacatcatatagttataatctactattttaagctaacaacttaacttctgacacatacaaacactctaggcttttaccttccttcctcacaatttacatttttgatgtcacaacttttgtcttgttatattgtgagttccttaacaacttagtgtagcttccattatttttgaccattgtgactttcatcttcatactagcaatgcgtataatttatacagtattgaagtatcctggatttgactatttacctctaccagtgagttttgtatttacctctaccagtgagttttgtatttacctctactagtgagttttgtactttctttcatatgtattcatgatggtaattactgtccctttgtttccacttgaagaactcccttaagtatttcttgtaagtcaggtttcatggtaataaattccctcagcttttgcttgtctgtgaaagactttatttctacatttctgaaggacagcattgctgtatagagtatgcttggctgacagttttgtttgcttttttgttttgggggttattttttctttttctttttcttttttttttttttgctttcaacacattaaatatatcattccattctctcctcgcctgtaaggtttctgctgagaaatgcactgataatctaatggggattcccttatatggactcaggatcatgaaaacatccatccccatcaaaagtttcctcaagcacatttgtaatactcccctccctaatacttcactgtccctaggcaatagctgacttgtgttctgtcactatattctagtttgtatttaatgaaatataggatatactcttttgtaaatggcttctttcacttaacatgattatttgaggctaaccaatgttgtttgtatcaatagtttgtttttattgcagcatagtattccactcatggatatacaatttgtctaaaaattctactttttatagacgtggtttatttccagttgttggatgttatagaaatttatgtacaattctgtaggtgggcatatatttttatttctcttggataaatacttaagagtagaatggcagggcttgtacaataggtgtacatttagctttttaagaaactaccataattttccaaagtgattgtaacatttaatattcccactagcagtatgtaagagttacagattctccacaacctccccaattcttggtatagtcaggcttacaattcttgctattccagttggtgtatagagatcaccgtttgtggttttaatttgcattttcccagtgacttagggtattgagcatttttttatgagcatattgatctttatataatctagggtaaaagtgtctggttgattatttttctcatttttattagattgtttgacttcatattattgagttttaattgttatttgtatattcttggtaaaaattttatttgatgtgtttatttcttattttttattgtatttatttatttatttattttgagacagggtctccctctgttgcccaggctggaatgcagtggtacagtctcagcttactgcaacctccacctcccagattcaagcgattctcctgcctcagcctcctgagtagctaggattacaggcatgcaccacaacagcctggctaacttttgtgtttttagtagagacgggatttcaccatattgatcaggctggtctcgaactcctgacctcaggtgatctgccttcctcggcctcccaaagtgctgggattataggcgtgagccactgcgcctggccccagtgcgttttttaaaatattttcattgtcagtgacttaaccttaaatttcttaatagtctctatggaagaagaaagtttttaattgtcatgaaattcaaattattaagaatttttctcttatgcttcatgcttttgagtcatatttaagaaatatttgccaaacctatggtcactaagattttctcctatattttatcatagagttttatacttttagctgtaatatttgcttctaaggtttaattatatatatatatatttaatttttttaggtacacagtaggtacatgagatgctttgaaacaggcatgcgatgtgaaataagcacataatggggactgggatatctgtcttctcaagcatttatcctttgagttagaaacaatcaaattacaccctttaagttattttaaaatatgtaattattattgactatagtcaccctattgtgctatccaatagtaggccttattcattctttctatttttttttgtacccgttaaccatccccatctctccccccacaaccaccaactactcttcccaccctctggtaaccatctttctactctatgtccatgggttcaattgttttgatttttagatcccacagataagtgagaacatgtgatgtttgtctttctgtgcctggcttatttcgtttcacataatgatctccagttccatccatgttgttgcaaatgacaagatctcattctttttttgtggctgaataatactccattatgtatatataccacattttctttatccattcatctgttgatggacacttaggttgcttccaaatcttagatattgaaaacaatgctgcaaaaacatagaagtgaagatatctctttgatatattgatttcctttcttttgggtatgtacctggcagtgggattgctggatcatttggtaactcaatttttagttttttgaggaacctccaaactattctccatagtggttgtactaatttacattcccaccaacagtgttatgagggttcccttttctccacatccttagcagcatttgttattgcctgacttttggatataagccattttaactggagagaaatgacatctcattgtagttttcgatttccatttctctgatgagcaattacgttgagcacttttttgtatgcttgtttgtcatttgcttgtcttcttttggcaagtgtctattcaaatatttagcccattttttgattggattattagactttttcctatagagttgtttcagttccttatatattctgcttattaatgccttgtcagatgagtagtttgcaaatattttctcccattctgtgggttgtttcttcactttgttgattgtaccctttgttgtgcggaaggtttttaacttgatgtggtcctatttgtccatttttgctttggttgcttgtgcttgttgggcattgcttaagaaatctttgcccagaccaatgtcctggagattttccccaatgttttcttgcaatagtttcatattttgaggtcttacatttaagtctttaatcgatttgatttgatttttgaatatggtgatagacaggggtctagttctattattctgcatatggatatctagttttcccagcaccagttattgaagaaactgtcttttccccattgtacatccttggtatctttgtgaagaatgagttcactgtagctgtgtagattcgtttctggtctctgtattctgttcccttggtctgtatgtctgtttttatgctagtaccatgctgttttgtttaccttaggtctgtagtataatttgaagtcagacaatgtgattcctctagtttagttcttttgcttaggatagctttggctattccaggtctttttggttccatctaaattttagaattttttttttctatttctgtggaagaatgtcgttggtattttgatagagattgaattgaatctgtagattgcttttggtagtatggacatattaacaatattgatttttccaatccatgaacatggaatatttttccattttttggtgtccccttcagtttttttcttcagtgttttatagttttcattatagagatttttcacttctttggttaattcttagatattttatgtgtggctattttttaagaaaaacttatttattttaaataatttttagataataatttctttttttctttcttccttgccttcttctcctctccctcctcctttttgcttccagggtgactcatgtcaaaaacattgtggatgtccctttccagtttcctattgacttgtatattaccttacagcatttctccccattcagctgtccctagtagaaatccataggctaacctggtactgccgattcgttgtctttaatggctgaataataacccacagcaggaatgtgctaccatgattgatcctgccatctgcctactaaagggtgttcactttgtttccaggtttttgccactggaataactttgcattcaatgcctcatgcataaatatgcctttatctactggtgctgttatttcttcgggacagtccaaaatcttatgatacatgttaaaatgtatgtatattttggaaagttaaaatctctagccatagagctttccaaaaaggctgtgatacttgcattcccaccagcaatacatgagggcaccatttttcttggattgtcattcagcagatgttatcactttttgtattttttttttattatactttaaattctagggtacatgtgcacaatgtgcaggtttgatacataggtatacatgtgccatgttggtttgctgcacccatcaactcatcatttacattaggtgtttctcctaatgctatccctcccccagccccccaacccctgacaggccccagtgagtgatgttccccgccctctgtccaagtgatctcatcgttcaattcccacctatgaatgagaacatgcggtgtttggttttctgtccttgtgatagtttgctgagaatgatggtttccagcttcattcatgtccctgcaaaggacgtgaactcatccttttttatggctgcatagtattccatggtgtatatgtgccacattttcttaatccagtctatcattgatggacatttgggttggttccaagtctttgctcttgtgaatagtgccacaataaacatatgtgtgcatgtgtctttatagtagcatgatttataatcctttgggtatatacccagtaatggtattgctgggtcaaatggtaattctagttctagatctttgaggaatcgcctatgtgtggctattttaaatgagattactttttatttctttttcacattgttcactgttggcatatagaaatgctaccaatttttctatgttgattttatattctgcaactttactaaatttgtttatcagttctaatagttctcttgtggagtctttaggtttttccacgtatactataatatcatctgaaaacaagcataatttgacttatttctttccaatttggatgtcctttatatctttctcttgtctgattgctctagcatggactttcagtactaagttgaataacagtggtgacagtgggcatccttgttatgttccagaccttagaggaaagactttcagtttttccccattcagtatgatattagctgtgggtctgtcatatatggcttttattatgttgaggtatgttccttctatccccagtttttgagggtttttatcatgaagtgatgctgaattttatcaaatgctatttcaacatcaattcaaatgatcatattgtttttgttcttcattctgttgatgtgatgtatcacattgattgatttgcatatgttgaaccatccttgcatcctgggatgaatcccatttggtcatgatcaatgatctttctaatgtattgttgaattttgtttgctattgtcctgtagttttatttattattattattattttttttgagatggggtttaactcttgttgcccaggctgcaatgcaatggcatgatcttggctcattgcaacctctgcctcccaggtttaagtgattctcctgcctcagcctcctgagtagcttggactacaggcatgcaccaccacatctggctaatttttgtatcagagatgaggttttgccatgttggccaggctggtcttgaactcctgaccttaagggatctgcccacctcggcctccaaaaggactaggattacaggtgtgagccaccgcgcccagccagttttattgttttgatgtgtctgtctttttttggtatcaggataatattggccttgtagaatgagtatggcagtactccctcctctattttttggaatagtttgaataggattggcattagttctttaaatgtttggtagaatttatctgtgaagccatcaagtcctggggttttctttactgggagacttttttttatcatggctttgatcttgctatttttatgggtttgttcaggttttggatttcttcctggttcaatcttggtaggttgcatatgtctaagaatttgtccatttcttccagattttccaatttattggcaaatagttgctcatagtagccactaatgattctttgaaatgctgcattatcagttgtaatgtcttctttttcatgtttgattttatttatttggatcacctctctttgtttcttagtctggctaaaggtttgtcaattttgtctaacatttcaaaaaaactaccttttgtttcattgatcttactattttttaatttcaatttcatttatttctactctgatctttattatttcatttcttctgctaattttgggtttggtttggtttggtttcctcttgctttttttagttctttaagatgcattgttagattgtttatttgacgtttttcctcttttttgatgtaggtacttatagctataaagtgcctctttttgctgtttttgctgtatcccataggttttggtatgttgtatttccattatcatttgtttcaagaaatttttcaatttccttctaaatttttttattgacccactggtcattcaggagcatattgtttaattttcatgtacttgtatagtttccaaaattcttcttgttattaatttctagttttattctattgtggtcaaagatgcttgatattattttagttttttgaatgttttaagacttgttttgtaaactaaaatatgcactgtccttgagaatgagctatgtgctgaggaaaagaatgtgcattctgcagttcttggatgtaatgttctgtcaatatctattaggtccatttggtctgtagaacagattaagtcttatgtttctgtattgattttctgtctggaatacctatccaatgctgaaagtggagtgttgaagtctctaactcttattgtacttgggcctttctctctcattgattatttttgtgccagtaacaataaaagtactctgtctgtggcttacgatttttgtgacatcttcatctgtttttttttttgtatcaggataatattgatctcataaaatgagacaaggaatgttatcttcttttctgttttttgcaagaatgtttgaatgattgatgttaattcttctttagacattcgataaatttcaccaaaggtgccatctgaacttgggctttacttagtggaaagtttttttttttttttatgacaaactgaacctctttacttataggtattttcatattttgtttgtatttgtgaatcagtcttggtggcttgcatgtttctaggaatttttccatttcatatagatttccaaattatttggcatgcaattatttaaaatatccccttataatacagtttatttgtcatttcccctcttttttttccttaacttttattttaggttcattggtacatgtgaaggtttgttacataggtaaactcatgtcactagggcttgggtttgttgtacagattatttcattacccagatataaagcccagtacccaattgttatcttttctgctccccttcctcctcccatttattcacattattagtaattggtgacttcacactttattctagctaatctagttaaaggtatcaatgttaagatctttcaaaaaaccttttattgattgatttcctctattggttttctattctcaaatttattcactctgattaatttttgttatttctttctttttgcttactttggatttagtttgctcattttctagttttctttgaagggggagataaggttattcattaaagacctttcttctttttcaatataggcattacagctacaagtttttcttctaagcactgcttttactatatcccctaagttttcttctgcttgtggttttattttgtttttctcaaaatatttcaaaaatccctcgtgattcttctctgactcattaattattttgaattgtgttgcttaattctcacatattgcaaatttcccaaatttcctgttgttgatttctactatttttccattgtggttgcagaacatgctttgtataatttcatccttttaaaatcattgaggattgttttgacttaacatatggtctatgtggaaatgtttcaggtgcacttgagaaaaatgtatactctgctgtctagttggtttatagtattgttcaagtcttctatttctttgttacttttctgtctgtttgttaaatctgttcttgaaagctgggtattaaagcctccagctatcactgtggaactgtgtacttctcatttcaattatgttagttttgcttcatgtattttgtggttctcttattagtgaataaataatttctactatttggaaaagttgattttggcaatatttcccagtgttctcattgtttttacgaagaagagtattttccaatgtccttattccactattcccacttgtgtacctccagtgatatgatgttttactttaatctctttttgtcttcataatcaaagtgggtttcttatagagagaatataactgaatcttattcatttactcaatcttataatctctatcacccatatttatagcttttctatacaatgtgactattgatatggttgggtttaaaccgaatcttttgctatttgttttacacttgtcctatctgttttttgttttgttttcttttgatttttcttttattttaccagtttttcaagagtccatcattcctgggcctcctttattgagtttttcatcttctgatcagcagttgttgctttagggttttttcatatcttacagtttttaattgtatgcccagcattatggattttattttagaaaagcccttgattatgttatctttttctcatgagtactaaatattgttctaattaaaagttaatttatcagtacaacacctgaatactgtctcagactttgtttagaagaaagactattttagttttttcttacagatagaaaatattcctcactcttaaggcactgagtttctttttttattttctgtccagctttaagatgcaagcaacaaatttaaaaacttatatatttaaagtgtacactgtgatgatttgataaatgtatagatcatgaaatgattaccacaatcaagctacttaaaatgtctatcaccttacaaagttaccttttttgtatatgtgtgatgagaacacttaagatctactctcctagcaaatttcaagtatacaagtgttaactataattgccattctgtatgttagaccccagaatggatttatcttataacaaaaatttgtacattttgaccaatatttccccaacccccaaccccagccccagaaatacatcattctactctctgctcccgtgagttacactttcttagattccgcaaataagtgagattatacagtatttttcctatgtctgacctatttcatttaccataatatctctcaggtttatccatgttgtcacaaatgacagaattctcttctttttaatgactgaataattctcttgtgtgtgtgtgtgtgtgtgtcatattttctttatctcttcatccattgttggacacttaggttgattccataccttggttattgtaaatagtgcatcaataaacatgggagtgcaaatatctctttgacacattgattttattttctttgggtatatatcccgtagtgggattgctggatcatatggtagttctgtttttaagttttgaggaaccttcaaactgttgtcaataatggttacactaatttacattcctatcaaaagcgtgcaagtgtttccttttctccacatcctcaccaaaactttttatctttcatctttttaataataaccattctaacaggtatgaggtgacagctcaatatggttttgtattttttttttttgaggcgaagtctcgttctgttacccagacaggggtgcaatggcacgatctcggctcactgcaacctccatctccttgtttcaagcaaatcccctgccttagcctcccgagtagctgggattatagatgtgcaccaccatgcccggctaatttttgtatttttagtagagacagagtttcaacatgttggccaggctggtctcaaactcctgacctcaggtgattcgcccacctcggcctcccaaagtgctgggattacaggtgtgagccaccgcacccggcctcattatggttttgatttgcattttcctaatgattagaaaggtttagcactttttcatatacctgtctgccatttgtatgtcttctctggaaaaaaaatgtgagttgtatgaattccctctatattttggatattcatacctatatttgtgggttcaggctgctataacaaaacatcataaactggacagcatatagataagtaaaatttttttctcatagttctataagccaggaagtccaagatcaaagtacaggcagatttcagtgtctggtaagggcccactttctcatagtctgcaccctcttgcagtgtcctcacatggtagaagaggtaagggtttctctggggtcttttacgagggcattaatttcattcatgagggatctgccctcatggcctaatcatttcccaaaggctccatatcctaataccatcactttggaagttaggattccaacatgtgaatttgagtgggacacacattcagaatgtaacacctccttatcaaacatatggtttgcaaatatttttttccatgccataggttgccttttaattttgttgattgttttctttactgcacagaaacttctgtttgatatcatcccagttgtttatttttgcttatttatgttacctgtgcttttggtgttatatctaaaaaattattgccaagaccaatgtccaggagttttccctatgtttttttcaaaagttttacagtttcagtttttacatttaagtctttaattcattttgagttttgttaatatgataaggatacagtttcattcttctgcatttatatagccagttttcccaccaccgtttattgaagagagaaccctgtccccattatgtattttttatgcccctctcaaagactatttaactatatatatgtggactcatttctgggttttctgttctgttccattggcctatgtgtctgtttttacaatagtaccataatattttgattactataatatagtttgaaataaagacatatgatgcctccatcttgattcctcttgcttcttacttttttttttcacttaattctggctatttggggtcttttgtggctccatacaaattgtaggattagtttttttttttattttggtgaataatgtcactggaattttaatagggattgtattaaatttgtatattgctttgagtagtattgacactttaaaaatattaaatcttccaatttgtgaacacaggatcttttttcatttatttgtgactccaatgtcttttgtcaatgttttatagttttcagtgtacagttatttcacttcctcggttaaatttattcctaaatattttattcttttttattctaatttgaatgggattttttcttcacttattttttcagatagtttactgttgctgtatagaaatgcaactgatttttgtatgttgattttgtatcctgaaactttactgaatttattaattttaatagctttacagtagatactttagggttttacttatataaaatcatgtcatctgcaaacaaaaacaattttacttcttcctttccaatttggatgccggttatttctttctttctttctttctttttctttctttttttttttttttttgcctgcttacttggattaagacttccagttctatgttgaatagaagtggcacgagtgggcacccttgtcttgttcctcatcttagaggaaaaatttcacattttgtcattgagtatgatgttagctgtgggcttgacatatatagtctttattacattgaggtatattcctttgatacctaatttcttgagagttatcatcataaaagaatattgaattatgtcaaatgttatttttctgaatctattgagatcgatcatatttttatcattcattctgtcaatgtgatgtatcacatttattgatttgcatatgttgacccatcctttcatccaagggataaataacacttggtcatggtgtatgatacttttgatgagctgttgaattcagtatgctattttgtttgtttgtttgtttgagatttttgcacctatgctcatcaaagatattggcctgcaattttcttcttttgttttgttgttatctggctttgatatgagggtaatgctgactttgtaaaatgagcttagaagtgttctttcatcttgaattttgtgaacaagtttgagaaggtttggtgctagttcttcatgaaatgtttggcagaactcaccagtaacaccatgtagtcttgggcttctctttgttgggaggtttctgattactgtttaatctcctaactcattattggtatattcagatttcctatttctttaagattcagtcttgaaaggttgtatgtttttaaagaaatgtatccatttctactaggttatctactttgttggcatgtaattgttctagtagtcttttatgatcctttgtatatttgtggtgtcatttgcaatgtctgctctttcatttataattttatttatttgagttctttctctctctttctcttggttagtctaactaaaggtttgtccattttatttatcttttcaaaaatccaacactgtttcattgaccttttcaaccgtcttcccatctttatttcatttatttctgctctaatctttattatttcctttctttgactaactttgagcttagtttgttctttttgttctagttccttggtgtagagttatttatttgatgtctttatttttattaatgtggacatttatcactctctacttcctattagaactactattgctactattactactattgctgcatttcataagttttggtatgttgtgtttccatttttgtttatctgaatatttttttaaatttcttttttatttcttttttaacccattggttatttgggagtgtgtggtttaatttctatatatttgtaaatttttaaattttcctcccgttattaatttttagtttcataccattgtggtcagaaaatgtatttgatacaatttcaatcttcttaaattcattaagaattgtttttcaacctaacaaatgctctatcctggataatgttccatgtgcacttgagaagaatgtgtattctgttattgttggatgtaaagttctgtatctctctgttagatgcatttagtctctagtgtttttcaattccactgtttccttattgattttctattggttgatctatacactgttgaaagtagggtgctgatgtcttctatttaatactattattgtattcctatttctcccatcagttttggtaatacttgctttatatatttgtgcttcagagttgagagcatatatatttaccattgttataatcttttgatgaaattaaccctttatcattttataataatcttctttgtctcttgtgacagtttttaaagctaattttagacttacttagagttataaaatagtacagagtccctttatatctctcatccagcttcattaaatgttaacatattgtatacccgtagtataattatcaataataggaaatcaatattgtgaaacagtactataaagtataaattttgttcaaaatttacaaagtttttcattaatgtccactattagtttttatatcttatccagaatacgacattgtgtttggttgcattgagctgctttacaaccttccaataaatctgataaattatcttttgacttttatttaattccagataatttctaatttcccttgtgattgcctctttgacccataagtcactgaaaagtgtgtcatttaaactcctaatacatgggagtttcccaagtatcttgtgttaatgtctcatttaaatactttttgtctgcaacacactgtattttttcaatccttttaactttattaatactttaaatatctaaaccaaagatatttcttgaagaatgttccaattgcacttgaaaatatgggggctatttccagaatcttttgttattaatttccgacataattccacagttataagggaacagatggtatatgatttcaatcccttttagaacataattttttagaattgttttgcatcccagcatatgttccagtgtttcctgattaaaatgccatcgacacttgaatagaattgtatcttgctattgtataaaatgtataaatgttaactacgttcaatttgttcatagtactatttaggtttattatatattttttacttttctgtcttcattctattaatttcttagagtttagtattgaaaactccaattatatatattaatttatctattttttccatcaattctgtcagtttttgcttcatgtattttggggctctgttagtaggtgcaaatatacatttttaattactataccattctgcttttgacccatttatggttaaaaatatctctgtctttaataatattcatattattaaataaatgttgtctgaaattaatatacatactataatattttatgcatatgatttccatgtaatatatattttaattttttatttttagctataggttttttgtaattaaaatatattgtatgtgaggagcttagaattgggattctcttatgaaaactttttatctaatctgacagtacatttttcattttttaaattttttatttccataggtttttggaaacaggtggtatttggttacatgagtaagttctttagtggtaatttgtgagattttggtgcacccatcacccaaacagtatacactgaacccaatttgtagtcttttattcctcacccgcctcctatcctttcccctgagtctccaaagcccattgtatcattcttattcctttgcatcctgatagcttcgctcatacaatgtttggttttccattttttagttacttcacttaggaaaatagtctgcagttccatccagttcgctgcaaatgccattaatttgttcctttttatggctgagtagtattccatcatacatatatacaccacaatttctttatccactagttgattaatgggaatttgggctggttccatatttttgcaattgcgaattgtgctactataaacaagcaatatcttttcattagagtagttagttaacttacacttaatgtggttgatttgcttattttaggtgttcaattttgatactcattttctacttattttatatctttattgttcctctgttcttcctttcctgccttcgttttttgtattgtaatataattcatatatcataaagctcattattataaagtgtataattagtagtgtttagtatatttacaaaattatacaactgtcaacactatctcattacagaacattttcatgacactgaaaaatttaaaaatatatttattaggaaccattctccattttcccctctccccagctcctagcaacttctttatttctatagatttgccaattctggacatttcttataaatgaaatcatacaatatgtggccttttttatctgccttgttttaaatactataatgttttcaattttcctgtattgtagcatttactagtattgaattcgctttttcctttttctttatttttcattgtttagtgagatacaagtcacataactatacaactcacccattagagtgtaaaatttaatgatttttaatatattaatagatgaatgcaaatatgaccatcatcaattctaaaacattttcatcactgcaagacaaacattataccctttagctatcaccaccctacttacccagaacaccatgcctaagcaagaacgaattgactatctgtctctgtagatttgcctactctggcaatagctggaatttcatacagttgcaatcatgtaatatgtagtcttacgtgattggcatattcagttagtataatgttttcaaggtttattcatgttagaatctgtatctataattatttttatatgatgaatgaatactctgttgtaagaatatatcagaattttttttcattctgctgattgacctttggctcgtagccaatactttttatcacaaataatgctgctatgaacactaatcaaagattttgtttaaatacttgttttaattctcttgggtatataactagagaatttctgggtcacgtggtaactgccaaattgttttccaaatgcagggggattccaacttctttacatccttgtcaatacttgttattgtctataattatgactatgttcatcgtactgtgtgtaaagtggtatctcattgtggttttggtgtgcacttccctaatagctaatgatgttgagcatattttcacatacatataggccatctgcatatcttctttggagaaatgtgttttcagatcctttgcccaattttaattgggttatttatctcttactactgaattgtcaggattgtaacaaatattctggatgaaagacacataatgatttgaaattattgtctcccattattttagttgtccttgatggcatcatttgcagtgtaaaattttttaatttcgataaagtctttattttaccttgttgtttgtgcttttagtgtcatattcaagaaaacattgtcatagctggagtcatgaagatttagtcctatgttttcatctaaaagttgtacagtcttaccccttacttttaggtctttgaactattttgagggtttttttttttctgtgaatggtgcaagataagggtatgattttattgtttagcatgttggtattcagttatcctagcaccatttgttgaaaagactattatttccttcactgaattgtcttgacactctgttgaaaatcagttacatagaaaccatgtgtttacttgtagcctctcaattctattccatttatctatatgtctatatatatgtcagtaccacctggtcttgaataccactgctttgtagttggtttgaaaatcaggtagtgcgagtcctcgtactttgctcttttatctcaagattactattactctggctactctgagtcctttgcaatttcatatgaattttataataggcttgacaatttctacaaagaagtcatctgggatgctgatagtaattttgttgagtttttaggtaactttgggaagtattgtcatcttaagtatttcaaatctaatccatgagcatgaggatttatgtccatttacttaaattctttattttctttcaacaatgttttatagatttaaatatattaacacaagttttgcatttctttggttaaaattatccctaagtacttttattttttcaattatattataaactgaattactttattaatttaatttttggattgttcattgcaagtgtacagaaatataattaaattatgtatacttattttatatcatgcaaactttctgagttcatttattagttctaatactttttaagtggattccttagaatttctatatacaagacatgtcatcttctaacaaagatagttttaaattcttcctttccaatctagatgcattttctttttgttgcttaatttccctctgtagaacctctagtacaatgataaatgaaaggggccagactgaatattcttgacttgctccttatcttacgaggaaagtattgagtctttcatcattaagatgtctgctgtgggtttttcataaacgccctttaccaagttgatgagtttccttctatttctatgttgaggagtgacttttatcataaaagggaagtagatatgtttaaaatgttttttctgtatctattgagatgatcatgtgttttttacttctattgatatggtatattactttaattggctttcagatgctaaaccaaccttgcatacctaggacaaagcccacatgatcatggtgcataattttttatatgttgctggattcagtgtactagtgttctggttggtgtttttgtgtccatattcctaagaaatatttatccgtagttttcttgtgttgtcttcatctcattttggtatcagggtaattctgacctcataatatgagttaagaactgtttctttctctacaatattttggaaaagtttgggaagaactggtattatttcttctttaaactttttatatatttatataacttctaatatctttaaatttttatcactggtaaagtcatctttatggccataagttatgaacttttcattgtgcatagttttgggttagtggtcagtgtgtttacttggtatacgtccagtcacattgtctttttttgagtcatttttggtaggttgcacctttctaaaaatttgaccattttatctgagttatctcatttattgccatataatggttaataatattcctataatccatatttctgaaagatcagcaataatgtccctgctttcatttttgatcctaataatttaagcatctatctatctgtctgtcatctatctacctatctatccatccatccatctatctatctgtttatctatcatctgtcatctcttggtcaatctaaccaaaagattgtcaatcttgttgagcttttcaagagtcagctttattttcattaattttctgtattgttttaatattctctatttcattaatttctgctctaatctttacaagtttcttccttcagcttgctttatgtttattttgctgttcttcaagtgtcttagatggaagctcaggttattgacttgagactttttttttcttaatacaggcatttaaaatgataaacttctaagccctgtgtagttgcatccagtaagtttgggtatgctgtgtatttatgtttattcacctaaaagtattttctcttgtttttcttttttaattgaccaataagtatatatattaattatgtacatcatgtttttaaaatatgtatatgttgtataattactaaatcgagctaatggaaatatgcattacctcacatacatatcctttttgtggtgagaacacttaaaatctactctcttagaaattttcaagtatacgatacattgctattaactatagtcaccatgttatcaatagattcctagaacctatttccccttttttttaactgaaattttgtatccttgaaccagcatctattcaaaccatcctaacctctggcacgactattatactctctgcttctatgagttagactgtaattatagagttcacatataaatgagataatgcggtatttgtttttctgtgcttggcttaattcatgtagcataatggcctccagattcattcatgttgtcacaaatgacaggatttccttctcttttaaggctgagtaatatttcattgtgtatatattccacagtttatttattcatttattcactgatgaagatttagtttgattccatatcttggctactgtgaataatgctgcaatgaacatgggagtgcaggtgtctcttcaacatattgatttcatttccttaggatatatatgcagtagtaggattgctggattatatattagtcctatttttaattttttaaaaacctccatactgtttctcataatgaacctatggaatgggagaaaatgtttgtaaaccatacatctgataatacgttaatattcaaaatatgtaaggaactcaaacaattcaatggtaaggaaacaaataatccaaataaaaatgggcaaatgatctaaatagacatttctcaaaagaagacatacaaatggccggcacatataaaaaaaatgctcaacatcactaatcatcagggaaatgcaaattaaaaccacaatgagatgacatctgatacctgttcaaatggctattaccaaaaatacaaaagataacaagtattgctgaggatgtggagaaaaggcaacccttgcacacttttggtgggaatgtaaattagtacagctactatggaaaccagtatgaaggtttgtctaaaagtattttctaatttctcctttgatttattatttgttccattagatatttggagcatgtgatttaatttccacgtatttgtgattttctcagatctcattctattattgatctgtacttccatttttttatgttcagagaacatgcttcatattctttatcctttaaagtttgtcgaggtttgttttatgatatagcatataatccagcctggagaatgtgcgaggtgcactttagaagaatgtaacagacactgggccctaaccagaggagggagggtgggagaagggagaagatcaggaaaaataactaatgggtactaagcttaatacctgggtgacaaaataatgtgtacaacaaacactcatgacatgagtttacctatataacaaacctgcacatgtaccccaaacttaaaagtaaaatatgtatatacataaatataataaaaattatgtaaaataaatagtcatgaactatataattgtatttttactgttccttttctatgtttagatacacaaatattcaccattgtgttacaattgcctacagtattcagtacagtcacatgctatacaggagtccaggtgtgtagtagactataccatctagatctgtgtaagtacactctgtgacattcacacagtaacaaaatcacctaacaacacatttctcagaagatgtggccatcattaagccacacgcaactgtaattagattttttaaaatccaaatttaaatttttggctttatataaaaaagtttgatttaaaaatggatattcatttttgacattggtatcttgcactttaattttaatttttaatattttaaaagaaagaatttttcaaaactatatggaaataatgttaacttttaaattgtatgcttgttttaatgtatacttttataaatatattttcattttactcatttaggttattactgtcaattgaacaccaattatgtaaaaatctttatgaaatccatataattagcaatgtagctaaaaagaatgcaagaaaaataaattttatgtgacaaatatatttttaaaaagaatacatattctgttgttgagtagattgatctacagatgtcttttaggtctaattgatttatagagttgttcaaatcatctatttcctggtcgattgtttgactacttgttctttaaaatcataaaatgtagtattgatgtgttcaactattgttgaattgtctaattatcacttcatttctttccattttcacttcatgcattttggtgttctgttattggtacatatatgtgtataattgttatacctttctcatggattgaccctttaccattataaaatttttgtctttagtaaatttttgtttggaaatctattttgttagatattaattagtatatcctctttagctctcttgtggttgctctttgcatgattcattttccatcttttaatttcaatatatttgtatatagagttgtatatacattgtgcctcctgtgtacagcattagttggatcatgattttattcaatcttactatctcttcattttgattacatttttagtctaatcacatttaatgttattggtgatatagtttgatttaggtctgccatgttacattttgtttctatatgtctcatgtcttttttccttatatttttcttttactgcttgcttttacagtaagtggatattttctaatgtagcattttaatttatttaattatttctttctagttatttctttagtggcaactctagggcttaccatatatatcttatcagaatcagcttcatatatgtactaacttaattccattaagatttagaaacattactcctatgtaactctattcctttttcccctttctgaagtattatttatcatatattacatatgatacatatcacatcaatacattttacaagcacaataatatatcattataattattactttatgtaattttatgtcttttaaataatttcatagaggaaaggagcaaattcatatttatgtcttttgttatattaatcttatttcagattttttcctatgggttcaagttaccatgtagaatcatttatttagcccattatagctttgcccccacctacatctttttagctgtcattggcaaatgtgtttacatttctataaggtatatagtcaagcatatattatgtcaacttaaataacaaaccaagagaagctctctaaaagaaaagatgtttatttggggatacagcattgcaatgggaatatgcatgccatagtaaaaaatgtgcatatttaattagatgaacaaagacaaagtcttttaaaggaaaaaatcagacggattacataattgttttgaaatagttattcttgtctacaaagattaataacaagaatgatgccagtctgaggttagacaggtagttgctgggtagatgacgctgtagaggtatttttttgtgtgaagttgtaatgctttctgcagacttttgtgatagttgtgttatcagatataccaacatgagaacgctctcttcacggcctttcctggctctatttgtcagggtttcattaatattaatgaatccattttgattatggcaactttcacaattgtacacttttttatacaattgcttttaaaatcagccaagaaaggagaaatgtatgcatttatactgtcttctataattaaaaatttctttatagatattctttgtatttttatattggtattattgcctggggtcacttgccttcagctcaagaacttcatttagtattttttggaaggcaggtctgctagcaaaattctctcagggaatgtgcttatgttgcttttgtttttaaaaatagctttgctggatataggatccttggttgacattttgtttttcttcattaggcatttttgaatatgctatcccatcactttccaccctccattgtttctgattaaaagccagctgttggccgggcgcggtgcctcatgcctgtaatcccagcactttgggaggccgaggtgggcaaatcacgatgtcaggagttcgagaccagcctggtcaacgtggtgaaaccctgggtctactaaaaaaattagctgggtgtactggcgggcgccagtaatcccagctacttgggaggctgaggcaggagaattgcttgaacccaggaggcagaggttgcagtgagccaaggtcacaccactgcactccagcctgggcgacagagtgagactctaaaaaataaataaataaataaataaaagccagctgtttatttcattgtggttctattgtaagtgatgggccctttacccttgttgctcccaaatttttctccatgtatttggctttcagtattttgactagtttatctgtggatctctttgtatttttccaacttttagttaattgactttcctagatatgtagatgtgtaatggtgttcttctctctgagtagtagtcccaatctagaatttgagtgctaagtgaaagggctaggccgtagccataggtctttaggcttgcttctcttgacatgaacccctgtcttatcaggtgggaaaatggcaattcgggacccagtattttcagcagcaccatacccaagctggagcttctactgtatgagtagagatcaagtagaaaagtagagtgcccgcttctcagctacacttacccagatattatcctcagcagcaggtagctggtagtaggatgaaaaatgctgatgctgtgtctctcctaggaatataaatccttgactgggaactggggataaggggaaccttgtgcattagctctaccaatctgagtgaagtttccatcttcctgcattgggaatggggaggaacagaatgggttatggttcaaacaccatagactctcactgttcttactgagctctactagatttccttgaacaaatgtttcttcatattttgcatgtctccaggaccattttcagaaagtttaaattattgttcttctataatttccactagttttcgtggaaagtaaatctgtggagttcttcacgtggtcatgccaaaagtggacctcacttcatctttttttatgtcttcataatattcaattctatggatataccacatatttaccttcagttcattgaacgtattttaaatcacttatttaaagtctttttccagtaagccaaatatctacgttttcacagagacagtttctactgattacttcttttcctatgtaagagccatacattcatatttctttgaaattctcatatatttttattgcaacttggacaatttaaatattataatgtagtaactctggaaattagattctcatcattcctcaggattggctgttttcactatttattgtggtagttattgtttactgactttcctgaagtaactctgcagagtgtatattctttatcaatgaagtctcagctccattagcttagaggccagctgataattggacagagattaccttaattgcctggaacaaataaatctctcagttgttgctaaggagttctgtgttgctgttgggacacatcttcaacattcagccaatcagtataccattttgccatgggcttcccttacttgcacagagcctcaaggtcagacagaagtgagagcttaaggccctctcaggtctttcctaagcaatccgactgtttggggaatgcatacaatcctacacatgcaggtgtccttttagattatgaagaatcatgttggagcttttcaaagcccttctggacattttatttctcactttttccttttattcattttgcttagtctattgttttccccaactgtaaataatttcctcaggcagctggaatgttaaaacatttgccagtaaatgttttccagaaatgctcctcagggagaagtttttagcactggttgaactccaagtcagatgaaaggaaataagccttttgtgttggttcttccaggacaccactagaaaagtcaaataatgacaattttttaggtgcatggctttcagagatctccaactccattttgctactctcagtgccaggagggtcagctgttattttttaggactgacactgatctggagagcacgggatgggaaaggaacggttcttagtgatattgagacaattatcttgaatgaatgtttcccatgttgctgcaagttttgggttagtttttatagttctgatgatgttgaatctatttttccaatttttctgttgcttttatagagaggcaaatttttgaagggacttactctaacattttcacagatgccactctctgctttttcttgttttaaataaatttcttagtatgcaatttcaattccactattggcattttagatatatttgaattatttttaaattattgagctagaaaatatggtatgcttctataacttatcctattatactaaatgttcatctctacttacttcttagaacaagaaatataggaactttgaaaacgtatagttgcatttacctcttcccatcatttgtggattgttgtcaaatatattacatgtgtctacattataaagccacttacagaatgttgtaatttttgcagtaaatagcatctttgtaaaataaaaagagttttaccttgtattatacttaaccacatattcacttaccatttcttgttcccttcattatttctggttttcatgagttactatctcatgtcatttcctttcagcctgaaggacttccactaacatttctcatagtgcatatctgcaatcaataattcattttttgctatctacaaatattttcatttcaccttcaattttgagggatagtcttactggatatagaattgtttgttgactgttattttgtttcagcacttttaatttgatatttgagtgtgtcctgtccttcatagtttcttgagataagctgataattatataattgtttcctcatatgaaatatgtctcttcctacttctgctttttaaatattcttactctcttttaaattcagcagactgtgatgtttgtaggtgtgatttctcctgtttattctatttggaattcattcatctttatgaaaatgtgggttaaactttttcacaaatttgtgaagttattggccactatttcttcaaacatttattctgcttctttcctttctgtctggggcccaaattatacctatattaagccacttagtattatctcataagtctcaggcttaattcatattttgtatcattttattccctactcactgattcttctagccttcgaaattgcaattgtcccatcaagtgaattttttttttgctattttgataatttaattttacgaacattataattttcacttggtctttttataggtgtcatttcgttattgatattgttgtctttcctgtcattaataccatatttgcctcgaacttattgaacatattttaaaatacctgttttcacatttggatctttaaatcaaacatctgtgaccaagcatggtctatttatattaaattccccttttacagtttatgtttcccactttctgtttctttgtcaacttttgattgaaaactggatattgttatacattgacactctggagcttgtttcttattgtgaagattattgttttttatatctagtaggtatttaactttctggactcaaactataaaacctgtgtcccccacattgtgcaacagctgacatttcttttcagttttcttgacttctagttgcttctttttagtgtgttcctcccatctttcccttgtgcctatggagtttaaagatcagcctaggattgaggcaaaatttgtaatgagatttaggataggttggagaatgcattcaatcaaagacacaaattgaaaattagtaagggaactcaggaagaaagcgaaccacagagagatcgttaaatctaaatataaattcatgctgtatgtcctgatcataggaagagatccttcaatgtatcataatttagtctggcaatagctgtttttttttataagaatatatctttttatcaactggggaagtatctttgttcctagttttcagagaatttttatcgggaatagatattgacttttgataaatgatgttttaaattctattgagaggatctaatagtatacttttttctcttatttatcctattaatgtggataatttctttgactggtatacattcttgaaacatccttgcattcttgggaacaatctagagattaaacccccatctgatcatgatatactttttatatattgatggatttcaattcctaatatattactgaggatctgtacatctatgtacataaatgattttgttcaataaattacttatcttgcaaagtccttatcagcttttcgtatcagttatgctgaaatcataaaattggttagaaatatatcctccttttccattatctgacactgttcacataaaattggtaatatttctctcttaaatgtttgaccgaattcaccaatgaaggcatttgcatctgaattctttttctggagggggtttcaaatgtcatttagttaccttagtagatgaagagcaatttcaattttctgtttctttccattttgtttcactttaattcataggcaatacagtaaggcaaaaaattaaataaggaaaagtaaagaagactggaaagaaaacacaacttttttacctgaagataaaataattgtctatgtgaaacttaaggaatctacaaaaatgaaaaatttactaatatcaataagtaatttagcaagctttctgagtaacagatcgtataacacacaaacatagatggtatttccatatactcacaacaagtaattgaaaaattaaataatctgtatctatagtatcataaaaaatatagtacccttagaaaatatatgagaaccctctatacatataaacatagcttagagaaattaaagtggaataaataaatggaatgatattacatgtttttgaattgaaaatctaaaaattaaaatataatatattaatatatctaaattaatctatagattcatattaatccaaaaataatcacatcaggctagtttcagaaactgacaaactgattttattatttatttttatttttatttttattttttttttgagatggagtctcactctgttgcccaggctggaatgcagtggcatgatcttggttcactgcaacttccgactcccgggttccagcgattctcctgcctcagcctcccaagtagctgggattacaggcgcccgccaccacacccagctactttttttgtatttttagtagagacggggtttcaccatgttggccaggctggtcttgatctcctgacctcaggtgatccacccgcctcagcctcccaacgtgtgggattacaagtgtgagccactgtgcccagcctgattttaaaatttataaggaaaagtaatggacctaggagagttaaaataattttgaaaaaaaatctaggagcatttatctgatctcaagacatacaatatagctaaagtaatcaagagagtggttattggcacaagaataaagaaataaatcaatgcaatttttaaaaaatagtccagaaatatactcacacataaactatcagttttccaaaaaaagtgccaagataattaaataagaaaaatgtttttttcaataaatgttctgaggcttatgtacaaattggtataaaagaattaaccttgacttcaacctcatagtatatacaaaattaccttaagccagatcatcaatctaaatataaaatctaaaagcaaaattattatagataaaatataaaagaatatcttcataaccttgccataggccaatatgctttgaataggaaacaaaacacataaattaagaaattaaaagttgacaaatcaaacttcaaaattaaaaactgctctttgaaagacgacaatattaaggaaataaaaaagacaagccaaagactcagagaaaatataggcaagatatatctgacaaaagacgtgtatgcaaaatatataaagagctcttaaaaataagtcaaacaactcaactgaaaatgggaaaaatcttgaacactttataacagagtatatccaaatggcagtaagtatatgagacattgttcagtgtcatagactgtgatgataatgcaactttaaaaccacaatgagaactggcttcacaccactagaatggctaaaattgaaaagactaacactaccaaggggtgtcaaaaattagtggcaactgaaactttcattgcggatgggactgcaaaatggtactttgtcagtttcttagaaagttaaacatgcatccaccctatcatccagcaattccactgcttacatttacccaaatgatacgaaactatatgtctacacacaaaaaaaatcttatcacgacttttaaaactactttattcataataatcccaaactgaaaatatatcaaacgtttatcaacaggtgaaaggataagcaacaattccttcaaaggaataatatttacaatagaaagaaaaactagtgacacaaccaaaaatatgggtgaagtgataaccattatgatgagcaaaagcatccagatatttaagtgtagatcttatatgattccatttatgtaaagtcctaaaacaggtaaacctatactgataagtatctaaagagtcattttttggggtggggaaaatttactagataagaagataagaaaactttctgcaggcttgaaaatgtcctatgtttcaactgggatggtgatttcacagatatatacatttgtaaaacctcatgtaaatttatacttgaaatctgtgtgtttttatgtgcttgtaaattatatttcaataaggtatttatatttcaataaatctaccttatttatttatttatccatttatttatctaccttatttatttattcatttgagacagagtgttgctctgtcacccaggctggagtgcagtatcatgatctcggctcactgcaacctctgcctcctgggttcaagcgattctcatgcctcagcctcgagtacttggtattccaggcacacaccaccatgctcggctaatttttgtatttttatttgagacggggtttcaccgtgttggccaggctggactcgaactcctgacctcaagtggtccactcgcctcaggctcccaaagtgctgggattacaggtgtgagtcactgtgcccagccagatttattttttaaataaacaaaacatcaacaatctgtgagacactgacaagtgctctaatatgcattgatctcagaaagggaggaaagacacactgaggacataaaatgtttgaagcatatagaaagtgtacatcccttcttatattttttaaagtctagtaataacaagtgaaaaaaattataacaaagtgttgtggagttatgccatatttagaaataaatcatatgaaaacaatgacatatgttgggggtgtaaatgaacttatgctgttatattattcttacattatacatgaggtagtagatcatgcaacttatcataattgatcatagtatttctttttaaaaatatctgtaggttatgtagtgatgtactctcttttatcttgatactggtaatttgtgttctttctccttcctttttcttgatgtgtcttggtagagattgatccattttattaaactttgcaaagaaccaactttaggtttgtgaggtttctttatcatgtatctgttttctcttttgttgatttttactcctcatttatctgttttcttctttgtatgtaggatgtaatttcctcttctttttttcaagtttcttactgcagaaacttagattactaattttaaccattctttcttctttttgaatattgacatttagtgttaaaatttcttccaggctgggtgtggtggctcacgcctgtaatcccagcactttgggaggctgaggcgggcggatcacatgaggtcaggatttcgagaccagcttggccaacatggtgaaaccttatctctactaaaaatacaaaaattagccaggagtggtggcgggtgcctctaatcccagcaacttgggatgccgaggcagggagaatcgcttgaacctgggaggtggaggttgcagtgtgccaagatcatgccattgcactccagcctgggcaacagagtgagactctgtctcaaaaaaaaaaaaaaatcctctaaattttgcttttgccctacccacaaattttgtatgctgtgtgttcaacaaattattctcaaacgtttttccaatttttcttgtgatttcttttttggcacatgagctatttagatggttgtaatttgattttccagttatttagatgagatgtgggaaatgagtgatcaatatcttatttgtcattaatttcttatttaattctgttgctaagaacatactatataagattgcagtctttagaaattattgagagatattttatgcttcaacatatgacttatcttgataagcattccatgtgaacattttaaagaaggtatattcagaagcattcagtgtagtgttctgtaaatgtcaatcacatctaattgacagtgtttatattttatatatcattactttctttttcaaacagttactgagaaaggaatgttaaaaatgccaatgatgattgtggatgtattcatttcttccttagttctgtagattttgctttaaatattttgaagctgtgtcactgggggaaacacatttaggatttgtatgccttttgaatttgtccttttattattgtgaatacccactttcatctctgctaatattgcttgtcttgaaatacactttgtctgacaataatatagccatgctacctttcttgtaataactactcatacaatatataattttccataatttctaactttgtacttacatatgtcttcatatttaaagtttgtctcttttaagacaactgatcatctttctcttttatcttaatctgaaaatctctgcctcgtaactaaacgatttggatcaattacattttatgtaatcatcaatatgactaggtttaagtctgatatcttactattcattttctttttgcttcatttaatttttgttctcctgtttctcttttcctgccttctcttctgcttaccaaatacctttagcattgcattttagttcctttattgactttttatctatatatttttaagtatttttatttgacctaggtggatttaaggattgccatcggatatcttatctcataagcatccttaattttaataatgtactaattttccactttagactttagacatgtaagaaacttaaaatgtataatttgatttttcaagcctgttctttttgttaatattgtcatgtatgctcttgctacatatgtcatagacacaactttaaaatcaactcatttgtgcctcaaaacctcacttaccttttaagaaattaggaaaaaataaaaagtagtctgtttacttacatgtttaccattttgggtgctcctctttcctccagtagttgtgagtttccacctggtatcattttcaacagcctgaagaacttcctttagcaatctttttttttttccaaattttattttaagttcagggatacacgtgcaggatgtgcaggtttcttacataggtaaatgtgtcccatggtggtttgctacacagatcatcccatcacttaggtattaagctcagcatccattagctattcttcctaatgccctccgtcctcaccggctggcaggccccagtgtgtattgttcctcgctatgtgtccatgtgttctcatgattcagctgccacttctaagtgagaagacaaggtatttgcttttctgttcctgtgttagtttgctgaagataatggcttccagctccattcatattcctgcaaaggacgtaatctcattcctttttatggctgcatagtattccgtggtttatatgtaccacattttctttatccaatctatcattgatgggcatttgggttggttccaagtctttgctattgtgaatagtgctgcaatgaacatatacatgcatgtatctttataacagaataatttacattcctttgggtatatacccagtaatgggattgctgtgttgagtggtatttctgcctctgggtctttaaggaatcaccacactgtcttccacagtggttaaactaatttacactgccaccaacagtgtaaaagtgttgctttttctccacaacctcaccaccctctgttgtttctggactttttaatagtcgccattctggctgacatgagatgatatctcattgtggttttgatttgcatttctctaataatcagcgatgttgagcttgttttcatgtatttcttggccacatgagtagcttctttgaagaagtgtctgttcatgtcctttgcccactttttaatggagttgtttttttcttgtaaatttgtttaagttccttgtacactctggatattagacctttgtcaggttgcaaagattttctcccattttataggttgtctgctcattcttatgacagtttattttgctctgcagaagctctttagtttaactagaacccatttgtcaatttttgcttttgttccaactgcttttggtgtcctcatcttaaaatctttgcccatgtctatattcagaatggtattgcctaggttttcttctgagatttttagtttggggttttacatttaagtctttaatccatcttgagttgattattgtatatggtataagaaaggggtccagtttcagttttctgcatatggctagccagttctccaagcacaatttattaaataggaaatcctttccccattgcttgtatttgtcaagtttgtcaaatatcagatagttgtaggtgtgcagtcttatttctgagatctctattctgttccattggtctatgtgtctgtttttgtaccagtaccatgctgttttggttactgtggccgaatagtatagtttgaagttgagtaacgtgatgcctccagctttgttctttttgcttaggattgccttggctatttgggctcttttttggtttcatatgaatttttaaagtttcttctaattctttgaagaatttcaatgatagtttaatgggaatagcatagaatctataactttgggcagttatgagcattttaattgcatcgattctttctatccatgagcatggaatgtttttccatttgtttatgtcatctctgattactttgagcagtggtttgtagttctccttaaagaggtccttcacttcccttattagctatattcctaagtattttattccttttgtggcacttgtgaatgggagttcattcattctttggctctcagcttgcctgttgtttctgtataggaatgcgctatctcaggcaggctccaccctgttgctggtggctggctggaattccaaaccagtgggtcttatcttgtgagatgccatggaagtggggcccgcaggacaatgctgcttgacttcccggattcagcccccttcctagtggtatgtacggacctcccgccttgcctgagttgcagacacctttgttggggatcctggggtcagagtatgtaaagctcctgggtctctgtgtgtgcctgagcagctgctttgctgtgactccacacagctctgtgttggacccaaggccctggtggcataggttcacaaggggatctcctgatctgtgggttgcaaagatccgtgggaggagcatggtttcccacggtcgcacaagcactcaccgcttcccttgactggacgtgagggttcccttggctctgtgttgctcccaggtgggccgttgccccgcctggcttttctttgttctccatcggttgagttgtttccctgatcagtcccaaagtgagtacctggatatttcagttgaagatactgtattcactcacgccttttgttcctctctgtgagtgccgtggactgtagctgcttctaatcaaccatcttggtccccttagcattcttttaatgaagttctgttggcaacaaattctctcagctttagttgacatgaaaaagtcttaattttaccttcatttatgaagtatatgatcactgaacataaaattctgggttgacagatgtgcgtttgttgctgtagtttttactttattctttttaaagatgattttatcttctgtcctccatggtatctgatatgacacccttggatatttctttctttttcttgcattaagctttattttaatgggtttcaaaattctgtaacagatttttggtcagggcgtttccattaaaaagtgttgattttaaaaactaaaaacttaaaactgccacatgcaaaaaaaaggggatccagaaaacattctctttttcttctgaaggttttacaatgcattgtcatcattaatcagttttactattaaacttaaaaggctaattgaaacaaacagttctgagaccattcttccaccactgattaaaactggggtggcaggtattagggataatattcatctaaaacttctgagatttctggtcaaacttggtgaccttgccagctccaacagccttcttgtcccttgctttgatgacacataatcaagatatgatgtctatctcatatcataaagagcaaaatgactcagaggaggatagtctgagatactgtcaacacacatgggtttgccaggagccatatgaatgacaatgactgcagcatcaccagacttcaagaactcctgtcagcctgaaatagtatggttttctaggtatccttgaaaaaaaatttcctctccatgcaaaataacccatggaaacagataaccctgcaggttaacaataatttccctatgttttcattttgatgtttatcaagctgttctaggaaacgtattctctaatctcttttgtatcactatttattattcatctcttggcagtctgtttcctgtcttcactataattgttctctctataatcaccaatgacctcttcattttcaaagatagagaaaatgtttcaaattctagatctctctgtggcatttgaaactgttgcggatgtcttcttcagaacactccttccctttgttcgtaatgacataacttttcacttacactgaattgttgtcatgtagctgacactcattttgcaaattttgctgctggtagttttgatctttccagaagatgtcaaaagaagttattcagaccagtttcacacatgtactgacaatgacaactatctaatgactagtttctggccaacaatgattgtaagacactatgggttgtatgaagcatcacaatttcaaagatgttaaaatctgaaagaaatgtgcctcttagaatcattggcatatgaccttatggtttggagagaactgatctgtgttgcttgaattcaaggttttaagaaataatgtaaacatatttatacatcctctgaacttacctcttttgcagtaaaataacttcatcaactaatgggcttttaagaggctgaaatgagataatgcatgtaaagtatgtaatgcagacaaagtatcagagtcagtaagcactcataataaacacttaatgaatgatagtagtagtagttgtaacagcagtagtagttataatagcagtagtagttataatagtggtaacgttatattttgaataaaatagtggtagaagtaacatatgatattttcagtaaagctttaacttaacaatgttaatgaatttaatattctaaaatgctaagtaagactcttatatgtttactgaaggcactcttcctctcagagtttaagtaaccttaataaataataaccacttttcagagatttgcaacaactgaattagataatgcatgtgaaatatatttgacagtttattagttgaagaagtacctaaggtttgcagcacaacatgaattataacttacctttgttggttctaaaattctaaggaagatgatacagagttattgaagttaatctcagaaaggttaagtgattccacctaataatttatttttttttgtctggattgaataaaatatatataaaagtatataacaattgtgaaatatgtggcttagtgcatgacaaataagccctcagtaaaaggtagttattattattggaattattgttagtgacacctgatattttcaatggtagttcatatctagttttcctctttggccaaatcaggaatttcaaaaatattgaagattgcctcatgatatttgctaaacttacttaatttttctgaagttaacttcatcaaataacatgtgccttgcggaatttttataaaaatgaatgatgaatttaaagtgttttgttgccagtattgctgttatttatatttaccagacatgataatatcgcatgaattactattggttgaaataaaaatgctaagacaaacttaacacatttgctgaacttaactctctagcacttaaataacttaatgcattaacatagaacagcagttctcaagctctttggtgtcaggacccctttatactcttcaaaataatcgaggactccaaaagagtttttgcttatgcggcttatatttattgatatttatggtattagaaattaaaactgagaaatatttaaaatatttaggaataattttattttcaataataataataaacccatctaaggttaacataaaaacatatttttgaaaactataatctccaaaacaaatcagagagaaaacaggcattgttttacagttttgaaaatttattgtatttatttatttatttatttattttagatggaattttgttctgtcacccaggctggagtgcagtggcgggatctcggctcactgcaacctctgcctcctgggttcaagcgattctccttcctcagcctcccgagtacctgggattacaagcatgtgccatcatccctggctaatttttgtatttttagtagagactgggttgcaccatgttggccaggctggtcttgaactcctgacttcaggtgacctgcccacctcggccttccaaagtactgtgattacaggcgtgagccactgcacccggcccacagttttgaaaatctcttttaatatcttgtttgacagaaagaaagctagattctcatatatgtatccacattcaaacagttgtgatatgttgttttggttgaaatttatgaagaaaatgcagttttaaagacagttaggaaaggaaaacctagcaagctttctaacagtctcagacacccccctagggtccttgaatcacactttgagaactgctgacacttaccttttatttttttttaaagtattgaataagacagtgtacaacatatattgttattaatgctgcttttgttgttgctttttataatttcctcatatgtttgaaataacttgaatttcttcttgttttgttgattgcattcatggtttctaaaaacaaaagaaaattaatgacagtgcagatttggtaaactggttaagctactttgccaaataatacctgtcttataaagtttttaaccaaattgagataatacattctacatctgtaatgtcagtaatatacatggctcagtgcctggcacataggatacactcaataaatggcagctattagaatcaccctttcctcaatgcacaaaaaataatacaaatagatgccagggataaaattggcctcatctacccaataacagcttcagcttatctacagtgactttgctaccctctcttgctgtcccttgacaaggcctactttaggctcaagaatcccttagacaagtgaataaatcatttaacagaagcgagctaacattactctggagttggtctctaagtgatacaaacttccaccaatctcatggcctgtgtgtgaggccttccccagaaacgtccaagtgtgtctatgaatacttagaatatatgcagcatttcctgtgggaaattgaaggtacatgcctcagtcatgatgcctccagggtgaaagcaaattccccagattgagtctctagccccacgctgtagtatctaaggtgctgggtggttggcaaggtaggagattgaagagggaaacaccactcctgcatcctttattgcttttgctgtaaggaacctggaaaggtataacagagtttcctatcaacacattgtcagaaaatggccttcttccctacagttttatcaaacaggtggttgaatgtttctatttagggatccaaatgtttttttgctctggaaggaatcacttccaagattagcagtggccaatcagttttggagactttttaaaatctgaggcttaacagtgatgttactctgtttcagaaaggacctctatgtcttcttttctctttttttaaattgaaaaaaattattaaactttctgtttcatagttgactttcaaagattacaaaggtagaattataaaataaagcccatgaactcatcatccagctccaagatttatcagcctgtggactgtcttgtttcatccatactttcatccacttctccctcccgtattattttgaaataactccaaacatcataatacttcatctgtaagtgttttagtatgtatatcaaaaaataaaagagctgtctttttatataaccacaatatcaatacctcacctaaaaattaatgaacaataattatttaatatcatccaaaggccagtcattgttcagatttttaattgtgtcatgaaaatttttaacatgtttttgttttcatcaagatcccaagaagatccacatattataattacttgatagatcttttaagtatctcttaatatataagttccccctctaacattttctcttgtaaatttttttaaagaaactctttcttcttttaaaaatcttatattaactttctgcagactaatccgtcactaaaatatgttattaaggttaagccaacactgatgtctttagggcatgtttgatctgtgctgtctagagattaccttacgtttatgatttttcacataaagatttaaacaacacagtctggcagctttcttaactgcttttttttttttttaactcttaagaaatatattctgtgtggttctgctgtactctatattcccaaattcctgttgaaatttcccaggcatttcatcaaacttggtgaaaaatcactttctcttttctccttctaataattgtcattccaccccatctaggtgcaaaggtctctgctttaggatctggccatgcactacttgaggtgacttactgtttgcagtgcctcctcattttcagtctttcctactttcttgaatggtgtgcctaggttcagagctataggtaggcatggaccaatacccagggaagtcttgtcatatctgttgtggcttcctcaccctgttacttggcttcctactctaggaaaaggccagtcattttagaaattccatgtctgaggaagaagacttaaagatcactttcaaaacactctcttctttctatcttcccagagattaaacatccgtcaacattctcagcaagctctagcaaagaagcattgactcattgttttttttccctcttgatcatccagccagacactctatacctgactaggcatgttaaagcaactagtaaggactttctgtttcaggtttgtcacagttgcttgtgtgttctctaaggtcagcaaggatctctgagaatgcatttctgtctcctctcacagttcatgatgtagacacctaccagcccaggattcctaataatctctaatggaaccccacaaatacaatctgaacttcccaggcttcgacttcctgtggacacaagacaggacagcaatctctatctgttatctatttatctctatgtattgatgcaggacctcttgaagacctactgtggttatttctgaaagcttccagatatcttacttatgctcaggcacaagatcaccttctgctcccacctcctcattgatatttcctaactatgggcctatttattgaaggaagtgcttccctagagtactacctctcagtattcttaaaacaaaaatgctcaaaattccacacagaaactggaggactgcatatctcccaactctacattttaccctctcttgactttgaaacattgctcatgcccagagactcaaaataaaacaaacaaacaaaaacccttgctaaaaagagaatcttttcagtctctgcttattgactatttctgcatagtagttagactcagcccagccatccctaataggctattattactattacaggtggtatttgtctcatttttattgaatttggaaaatgatatgctaaagaaagaatgattggctttattaatgtcatcaagtacagatgtgaatttattcattgattcaacaaatatttatcgagtgccttctctgagccaggacgattcttggaactggaaatccaacaaatctgacacaatccaccctttgacacaaccgtgtctctaatatagttaatatcaataagggtaattccatgccttctacagaatttagggagaaggcattcctaacatgaaaaacgccatcattttctgatgccatactgctagtgtttcatgtgactatcgattatgccgtgaatagctttcaacaaatatcaggtctgaatttccttccgtaaaatgcaaattaatgtatgccgttgaatacatctgttcagtccttcaagatgctataacaacccccttcctttttcttcctttaggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaa

SEQ ID NO: 4935 - DNA, 326069 bp, human
cgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtggtaagttggagccccgggcggcattgctagccgagaccccaacgatttaggcgggggatggggtggggagcggggacaggtcccggatggctgcagcctgcaggaccgcactggccctagcggaggttggggggagggactctgaacgcgcaaatcgcgaggagactgagtctctggaagaagagaggagcttaggttccacggaaggagcatagaagtctctaaggggattgggagcgggggctcgagatgaagacgctgggcggaggcgggggtctagagaacctggcgcgggggaagccgagacagaaacggaaggcgggggtggggtctcaagaagtgaggagtgggaggagagaaaggagggaaactgaacgcaatgtcgctgagtagagggtcgggctgcggaagatgcaactgagttgcaggaccgactacaattttaagaaatccgacagcaggcaagtgggagggggcgcaaggtttgggacagtgtgtgcagagggggaaccaaggatcctttattatgttctcattgaaaagcgaccctaatttttctggcgggtctcagcgaacatccgtaactctggggagataacacactgcggatctgtgtttggtctaacagctgttagctgaatttgaacagcgctgctggtgatcacgtaagcttaagaggagaggataaaggcatccagtgaacctttttttaaataattaattagcttatctaagtcatttggttactgttctatattttgaaaaggattgcgaaaaagtctccagcgctgcctcttattcctgtactcagttttacctgacaagcagtctttacagcgttcctcggaattgctaaacatgagaacaggttgccgttcctgatgtcacataaagttcgtcattgcaaaacgtgtctgtgtgtctgtttcttttctgcgccatgccctttgccttttgcttcctgttgggtagtatgcgacttgaggtgacaaacacttgcattgtgtttgagaaccctgtattttaagcaacagagctccccaactcataattcagcgagtgacattcggcagttaaaagatttggtctggaatcactgccagtaccgcgcagcttcttcattaatattaccagtataagtcccatccaaggaagcctctgattgctgagccactaagtgcatatgccccttacctcataccttttaggcaggctaaccgagggacgttcatatatggttgagctaagatgatttggggggcggggggtgaggaaatgcggcgcactgagtaacctctgagctccccagtttgcagacaattgcgacctcacatacacggtaatgaaaaaagatatctgggctccagagtttaaatttttcatgaagaagtttacgtacatatcagccattctgacaatcaaaatatgagtgcaatagaaacaaggtgttactgtgtagttggctacatatgtgtagagacaatgacaaaggccaactgacatgccccacagaaaatgatatctaccgtgatcattgcatctcttttgcagtactgaaatcatactgaatattgtctgttctgaagagtataatctccttagcacctggctgtttgggaatcatctacaatgcccccccattccaccccacaggtggggggaaataaataattttgtccatattttggggaggtaggttatagaatatttaattatatttttcattccttaaataaattctcctgatcctcctggggagggaagaaaatatttgtttcatcaacatgatttctttcctaatagcgtctatcatctacagcaacaagcccaacgcaagtcctgaaattcggaagatggataaggcttgttgattgcaatgtcaaggtaggatttggggtgctttagcaaaaatgacggtgtttttctatctgcattatctagagagggttattaaccctttctatgctttcttgaggggtttatctccatctagaggtgtcatggatgacagtgatgactttttcagataatgtaacaggcttttgtgcagtatgaattcatcagaaaagaggtgagaactgatatttctgggaacctcctggatgccagacgtggatccaggactattacatatatatacataaaatatatattatttcatatagtcttcatagcaagtctatgaatgacggagatattattatcctccattttattggtgccattagatttttcccctcaatttttcaaggtattctcaaaagttaatttaaggcaagagaataagaaatatttatttgtgcttccaagtctacttgggaagagcaataaaagtaaaatctaaaaagcctaacattctaatagattcgtccaacattataattgagtcaagcctcaataattttactgttccatgtatttccttcaaggaaacgtcatccctctccagctaagggaaacacaaaaattaaaacaaaatttgggggagagattatagtaaccaacattaaatatcctcagctattcttattaaattgttcaaggcctgagattgaaggaggttgcagtttgctgagcctgctgaaagataaattaattcccaggttttaatggctcctgaagctccagactatttgtccagtattattaaggagcatcttaccacctcactttcatagcaatggaatacctcacaaaaggatgatgtacgtgtactgagattattttagtaaagcatctgatacagcttagtattgtctagtggaagaactgctaaattatgttcctctagctgcctggtagccatgagcaaactaggaaaacttcatcataaattgaagttaataatatattattgtgatattttatgtcagtatcatatataaccccacctgattgttgtgaaacagatgggtattaagcactttgaaaattttaaattattgcactaagcaacatttattatttatttgttagcattctaggctacctatgtcatttcatctacatattgtactgttgaacctcaaaaagaaatcatcaatctccagtctaatgtgtgctcaagttatggatctctccaacactgccattcttcaagacattttaagaaggctttttcatatactgagaacattgctgcaagacagtctagtcatctccattctagacaaacaacattgaaaacaaccaagtggttaagctgcatcatcatttggcaagtcattagcagatttaatactaatgctcacctgcaacaactctttgctaatcacttctgacattttaatgcacaaacgacatagtgaaatcaggatttcaaataagatatacacaagatggaattttaattctgtttttgtctcctacctggcatctctacttcaacctcgctattcattcctcttctcagctgtggctaagacagtgtcatctgcagtttcctaaaatagttgcgtattatagcattgtacatatagctggcatttgaaacagtcattcttcttaattatggttaaccttatgcatagatgaccacttacatggtctaatttgagaagcactcgaaaggccttctggtccctaaattagtagccttcatggttttccatataacttgaaattctacattcaggaatttccctctttcatcttagtcactgtctcctttaaatacaagtacacctttgggtaacatactgttattattacctattaagaactatgcataaatttattgaaagctattagaaagcctttagaactgcatcgtccagtgcaacagccaccatatatgggtatttaaattcagagttgaattagcgttaatggcaaggtgtggggttgagctcaatgtaaaaataaaaagtgaaaactgaacaccactgaaaccaaagataatgtcaactaatatctagacaaggatagcaatgaatgaattggctaggatttcctttactttttcataaaacatgatgtcttctttaatcagtaaacgcttacgaataaatgtcagtgttcaaatcttttgcaagtgtattttaaacttacgtatctcccattttatctcagtaatcaagactcactgaatactcttcaattatagcttcctgtaatcaaagtagtaagacttgcccaaattagcaagtaattattcttaagaggagaggtataaaagatggtaacagtggccactatttattgacatttaccatgcactacacagttctaagaggtttacaggtatataaccatacaagcctgatgactaccccatgagaaggtactactattatccagtttgcagttagggaaactgaggcatacaaagaggttaatctgttcaaactgaatgaacaaaaccaagcttgaaaccaggcagttttattccagaggccgtggtgttaaacaacaaactattgcctctgtttagaaattggctaatttttctttcatactgtaacaactagtcttttaacagaacaaatttgcatgtaaatgtgaggatattaatggacaatgtccattaatcctcgatatgctgcttggcaaggcaatgagacagacatgcaacatttcatctagagattcacctaccaataaagaagtagagcaaatgagaatgtactgttaatgctgagagactgagggacaagaagctgagtgaagctcaggggagttacagagataatacaaagacagaaatgaagtcagggaaataatgctattgtatgtagagatgactggacaggcagatgttactactgtgagttggacccacaggtttctactacatgtaacaccacaacaaaggccattcatatttgtcatttatataatattgcctacttgaaattcaagcagtaaaatagaagctctgaaggtctaagaccgactgacagaaggatcagtaaaaatcgtttatctctttccgtaccgatagtgctcccgaaaacatggtgaatgttcctaaaactcacaagacttaaagaagtgtggctagcaccaaccccacaaaacgacacagtacaagaagggcaaagattctctgtatgcccagggaaagcagcattatgacaggcagcgcagtgaatatggtgggcagactaagccaatttttcggaaaaaagctaaaactacaaagaatattgtgctaaggcttgagtgcactgatcccaactgcaaatctaagagaatgctgccattaaaagatgcaagcattttgaactgggaagagataagaagagaaaggtccaagtgatccatttctaagtgtcatcttttgttttattatgaagacaataaaatcttgagtttgtgttaaaaattatttatcatatatcaggaaggtttcaagtcttgtctgatcccatttgccatgtatttccttttcatactagagtcaggaaaagtaatttgatagctatgacttggaaaataggtgctataaaaagtaactgccagttttttagtttactgatctgagcccaggtagaaaaaccatatctgagtacaatacttagactaaagttatttcagggtagaaagaccatacttgaaaaaattctaaatatgattaaagtctttttaaaagtaggtttttaaaaattcaaaaaccaaaccaattacttccatttcttacttccattttaaattgacaaaaaacctgatccgtgattaaaaaagaatttattgctagaaagattggagaagtccagtactgtggtatgtagctttctctcccaaatgtatctatattctgtctgatcttcaaggtccgtttcaagccccacctcttgcaggaagcttttgttgactagcccacatatatgataagtgccttgcccatagtaggtaatcagttaacatatcttgattgattgtattgtattccaatggttaaagtaaaggtgaaagaagatgaaggaagagctaaaatagaatttttagcacatctgcacaataatattcaagaattcaaggcatctaacagaataacagtttcccctgaaatgatttcaggtaatttctctgaacatattttagggcaataaaaatattataaatcttcttaaattagtttagctaaagcttagccctaccacactgttttattttccatttcacagtgaaatacaccattatatatacatatatgagagagagaccatttcattgaccacatgcatggctatagaattctctttttattagcaaactgagttctgcacccattttgcggtatgggttgatggctcagaaagaagcgcaagttttctttttaaaatagcaattcctaaatgcctttgcagcaaataaacttgtaaataagagctttatttccttcctttttatactgttaaaggaaatcagacattagtattaatgaattgctctgagtgatcacgtcatgaatctattagttttttttatcttaattaaacagttaatttaatgctttgtggcttgtgggtagattgttctagcatttttggttggtcaatgactcccagaggtctaataggcctgtatcttttagttttaaatgtaatgttagtctaaaatagattcagaaagaagttgattacttcattcttgaaggaagtaaaacaaggaagatctggtgtctctccaacaaatattttttgaaacttcattttgaaaaagcagaaatgagctggtttctcaatagatttatttatttagtcatttcatcatacctctatatctatttttaaaatcactatgtaaatggaaaagaacttgtatggtagaattatgcgcccaaatgactattcattgatacaatgacttgctctccaaagtattatttaagttagcaagggcagattctttagtttggaggattattacccacctctcactgggtaactgtctgtgtcaaattttcctgcttctactaccaaacctcagccaatttcctaaatttcacgtaagtaaatctataaaattcactgtccatatttatctgccaaattagtgaactgtaagatgaagatgaataaagaaaagcctgtaagaattatggaatttcagcaatggcttagttgaaattcagcaagagaatttcagttgagggcttaatgtacatttaacactttgttggatgctaatgaggtgaaaaacatattctacaatacttccctaaggaaacaaataagtactgttagacagtaaaggcaattcaatgtaataatgtagttttgcaatttatggtataggcaacattgatttctctctttcctactctctcactcaggatgaatgaagaaaaaaatggtccagtcatttgcttaactcaggcctcagtttccacaactccaaaatgagagccttatactaggtaatctttctgtaaggatccttcaaactaacctctttgttataaacagatacagaatacagaaaccactgaggttatatgactgacttccctaaggttacaaatatagagtcacaaattgtataatatataaaatggggaagagaacatggagaaaactcccacaaattttattaggttggttcaaaagtaattgtagttttcaccattgtggttttcaccgcaattacttttgcaccaacctaattcagaatttaaaagtgaaaaacatttgaatgctgagaagataatacattgttataaagtaatttgaatttttaccatagatttatactttactttgggtaagtgccattttcagaaaggcagccaaatttgtacaaacatagtggatattctgagtctcttgattgagaatgaagcaacaagatcaaataaaagttcatttgtttctctagtataatacagaatacatttatcacaacacttatagagtgagaaattattaaaaaaacactctatcccttctcccagatttctttaatttcttatgataattgaaataatgcttgtccttcctaccttggattcattcgtggataacttttcttaattattccccatttcagtccattaatacagcttcagaattatttctgaaaaatgttgttcaaatgtgccaccttttaaattccattgtgattatagactcttagggttagtaattgaaagctcatttcagacaactccctatctcatgtttgaactctgcacatctcccactctctttacaatggcaccaaataatgctacccaattcctgggcagagcatagataaggctaaaagttgtcagctaccaaagtagctgctgaatatcagaatgaaacccagggactctaaagtgggttatgaagtgatgagcttcagctaacagggaacattaggaaatgactgcagacaaatcctcatgcttaattcagagaaagatgtacggtttgattggagggggtgaggaagaaggatatcatacagactataaagccaagaagcaatgcttagaatgcaaatgtgttataattttgtgtgtgcagtgtaaaaagactactggccatattttaaaaagtcatctaggttacactcacatacttaagaacaccagaatttccattttaaattttaagaaaatagacataattgtttgcacctcttacatggcacttagcacattgtattacattgttttttccttagatatggagtcttgctatgttgccaaagctgaccttgaactcctgggctcaagcgaacctactgcctcagcctcctgattagctgggaccacaggtgcatgccactgcacctggcttctatcgcattttatttttattacttggtttttaacttatactttagaggcaggcctggtgttaaaggttttacatgcatcacgtcacttttaaatttgagtcttatctttcctactggattataaattcacatggaacaaagattataatttattcatgtttatactccccagctaccgtttgcatatatcattacatattgtggcttctctcaacatatatttgctgaataattaatatacaaaaagacacaagcactgtgggaaaggtatttatagtgcaaatttggagttaaatgacctaagttctagtctgttataagcctctatgtcctcctccgccaaaagagaaaatcagactggatggttactgagataatttcaaatgctacaactttaagaaaatatcaacagtttctaattctgaaaatccacttcaaataataatactcaggtagttgattttatgccccagaagattaatggttatgactcttcagctacttaagtaattcttataaaatctcaagtcaatattcacttcaggtctctaacttgtcattttccattcactccagtgccctacatttgaaatgattcatgtcttaaagatttctgagtgattgaagacatgtcttctttttgtcttttgttatttaaagtaaatttaagatatctttggctattaataataagtaacattcattttaggtgatttataataaattaaactgtgcagctacaaactctacacaaaagaagttacttaactatttgataggacagataacactctcctgcattttcagaaacgattaagccatatcttatagttaatctaatatataaaaaaatgaacttccttaggatttagaaatgttactaaaaataattagcattgtttttttctcaatagggtttctagaagatttctagacatcttgaacggtgaatcataccataatagatattttacttttggggagaagagagatgggtgtaaaacagttttcaatattaaaatgtttaatacatatatagaaattaaaaaggaagtaaaggttaaatggatcaaaatgctttggcaaaaggcattttgacatgtaagcaattcacaaatgtaaacaattccagttattcatattgtcaacctttgaacatagataattcttttacccatagtaaagaacattggagatacttatactttctagttcaaaagttttcattattttaattcctatagctctaaaggcttcagaaagagagattacaaataacatgtagacaactccaaatttcttgatcttactacagattcgctaatgcagatatgtttttttgagattcatcccaatatctactttccattctctcttaactctttttatattttctatcaagtatttttaaaattttcttcatttcctattgtaaattttttcagcctaagagcaattcttatattctgtttcctgttttctcctccctaattttttatcttattttctaacgaaggcaacatatagctgaaagggtttaataatacagtcacagaatatccttattattaatatatctactttttacaccataatacaaattttctttgtagatattttagagattgtatatatttttctcatatatcccttcatttgattttcaacataacttcgacttagttagggccagtattactacattgattacacaaatgagaaaacgaagggtaagaaaggttaaattacttatgtaaagtcacacaattaattctacagccagattcaaacaaacccatgagttcttattcagaattccattctttttatttttttgagacagggtctcactctgtcactcaggctggagtgcagtcatgcgatcatagctcactgcaaccccgaactcctgggctcaagcgattctctcacctcagcctctcgagtagctggaactgtaggtgtgtgtcaccgtgcccaggttgttgttgttgttgttgttttgtagaaatgagggtcttgttatgttgcccaggctggtctcgcactcctggtctcaatcatcccgcctctgcctcccaaagtgctgggattgcaagcacgaaacaccatgctcggccctaaaatttcattctatttccagtactttcccctctcttcgtgtcatggatatttagttccagagaacttcagatgcttagaaataaatgatacaattaggaagttatagatatagatatgtgtatgtatatttgtatatatatagagagagagtcatgttactcccagatgtttaaaaagcatgataaatacttggttttctacaaagaatcagacattcatttgcatgtggtcaagatttaaataacaatagactgactaatgagcaatatgacagattaaaacacaaaaaaaaatcccaaatcattttctgcagaatatattggaagtctagctatctggttgcactttagccaaacaaagtttccttaaaataaatcaagccttgattgagttctgcttcaaatttttcaaaagagtgcttcaacttattatgacttctctcttactttcatgactattagccctatccctttcacatttcctgtaatagccagaacccagataacagagggtaccttctgcatttaaaaataatcattttccaatacttgtatttaaagaaaacatttctaccttacccacacacatggcatatttttaaaatacagaagcactgataaacaatttaacattgcataccctggatttaaacatttaaaatatactgtgcatgtggataaggtagcaatgtttgctttaaatacaagtattagaaaaacaatttttaagagaaaattttaattagtataaaaattgatgaaataattgaataatattatcccaaagttagctttcagtggagaattttaaatgggagttcattaatatcttgctgaatatcaataacgtaaatgctgagtttatggtttagcttcatgattagaaattgtcttattcctttattatatttttagattgaattggatataggctattaccttataaagggttacaaaagaaaacaaattctggacaaacattcatctagatgcctttaattatatttcatatgatcattttgcccctgtactagaacatttattttttgaggagtattcagtttcctctatttgtattcagaactcctttgagtctttggggggtgatcccaaatggcaggaagaagaaaaagaaaagttatttatagcttgttcatgacttttatcagtgttccattttgatttccaattactttcccctggaaaatatatctagataccttatcactatctttaatgaatctaaagctgtacaatttgtgttgctataaaataatttcaaaagaattattcaaacttttgtcctcagtcagatcttaacttgtggtactccagcctgctcttgatctgtctgagtaatcgtgtagatttctatcacatcatcatcatcatttaagaaatattttttgtgtcggccatggtggctcactcctgtaattccagcactttgggaggccaaggtgggcagatcacatgaggccaggagttcgagaccagcctggcctacatggcgaaaccccatctttactaaaaatacaaaaattatcccggcgtggttgtgtgtgcctgtaatcccagctatttgggaggctgaggcaggagaatcacttgaacccagaaggcagaggttgcagtgagccgagatcgtgccattgcactccagcctgggtgacagagcaagatttcatctccaaaaaaaaaaaaaaaaaaaaagcaaagcaatattttttgaagctaaattatacccgacattgtaaaaaacacatgttagagaatataacacttgttcttagagtcacaaaactgtcaagggaggatttagcaaacattttacggttcctaccattgagaaatttatcttctatttgggaagataaactgtattggcatgcaacaaaaatgaagacattatgtagtgaaggactaaattgtgtaccacataaaaatgaaggaaaagaaacaactaaaggaattttattggcatagagaggaaatgaattggagcttgaggacaagtagggtttgaattgacacagaaggacaatattccaaagggccataggatattcatgtttcacggtatgagaagaggtaaattaggaactagttagtgggggtgagagtcacctctaatctgaatatgtttaaaacagtggtgagacatgcaccatcagatgttctctggagaaatgaaaatgtgatactggatctctggagatagaatttcgaacaatccatgctacactagtttagctaaatttcaaaattgtacaaaaaagagaaggttgtagagagaaaagaaaagaatggaagtccaaaaataaagcatttattatttaaagttttgggtaatatttaagattgatatttacctgggaatattaatgatgaaaattttctcaggttttccccaactttagacattgttacattcaataattgttaagattctgctctgggcaagacatttgactgagtacttcagggcttcccagaagaggaaacaatacttaattctgatctttagtagtttgaagtctagtcagtagctggagatcaaatatatgagctctacacaaaggatttggcagcaaaggttactgttaaattcagagaagattgtaagagcacagtagatagaaaagagattgcatgggatgaaaatattgatacaaaaacctctttaccccaaagcccagagaggaagtgtaaatttggatcaacccttttgggtgccattttcactatcacctaaacatagagtggccaaacctctttttgactgactcacagagattttcggatggataagacttttgtttaacaacagaaaaagcctccatgagtctggagtcattcatattcagtcctgttgcttttattcccttaacttaataaaaataagtaaatcagcaaacaggagttgagtgccttttgtgtgtttagcaatgtattagattatttgaatgatgccaatagaaatatgtaaggtcccttatatagttaggagtcatatgaattacttgctatcagcaagcccttagaaacctgaattataccttggtttaagttacaagtaagtaatgagctgtagatagactttcagttaaaattaatagtccaaataccatatgactgttagttctcaatgccaaaaagtcatccattttatgagattatttttaggaataccagcaaagtactttataattcctaaatgcatggataacgttatgaaaataataacacattaaatactgagcactctaataaagcaagtagaactaaagcatactgatcacatttgtaagtgactcaatattgcctgttattattaaatgattatatattattaaagatgaacaaattaagacttagagagggttcttgatttgcttcaggtcatacagctaattattggcaaaactgcagagaacttaaatttcctaactctgaaatcaggttcttttccaccatggttcactgcctcttgaagcctatgtagcatattaaatgaaagcctttaaaaatttgactacatcatactgtccttgagaatcatgtcatgcttaataaattcaaaatgaacaggaagtacatttgcatttttggcttcaaaaattagaaagttaatacaagtatgtgaatactttcaaaattatgacttttgttcttactaacatataggtagaagatgtatatgtgtgtgtgttatataatatccgtatgtttcacaatgagagagaaacatgtaaagacaaataagagtattttttgaagtttaaattagatgactgaccagttaacaggccatgtgctcttatttatgatagcctttatttcttaatttatttgagcaatcgaagtctgaaagagctcaagactggatgcttcctttctataaattacatctcttaaaatgtacaaatgcaagcatgagtcactagctacagaattccagctttaatacattatgtcatttttataaggaaaccagtgaccttcatgtggtttttaaggacaatgtctctgtgaactacagactatgtgaaagatgaaatcataacatgaacaatcaaacaagctcaatggcatgatctaaaagataaaaataacatgcatttcatagattgaaatctgcttacctctgtgattatttttccatgattcatttgcatgtgtgccttgcatatattgtattgatttgaaattaaattgaaacattcacatatgttacaatcacattttaaatagttaactttcactgaggtgtgcacaaaggaatggtgatgagaaggaaagtacatagcccacagcaatcctgaatgtatattttgataggtagtttgaattttctatttactcaaacttatgtcagtaatgtttaaactatagtattactgaagttgttatttatatataccattccatctagtaaatatagagcagaatctcggagataggaggaagtccaagaaagaaatcacggacacttctaatgaaaaggaaagagaaagggaaaggaatcaacaaatattgagccctaaccatatcctactcagtgcgtgttgcaaagtacatatattatctcatgtcattctcacaacaactgtaagaaaaaggaaatggaaacagagacaggttaagtcatgtgcccaaacacacagctaataaggcgttgagccaagattcaaacccatatctgtctaattacaaaggttgtgtgctctttttccatagtaccttgattaacagccttaaggtttaaaaatatgccaaatactcatgcacaacaacatgctctcagtataacatttacttaatcatttttcatttacaatgttttcaaggaactaaatggaagacaagtcaggagacatcaatcatatatcgccttctacaaatcaggaatgtgtgtattttcaaatatctcagtttgtttttagaggtgaaggatagctatttactaatagtaataaagatggaaaaagtatgcaaaatgctatctaataataataattggtaatgaaataggaaaataaaaggtgaatcacaatatttaaaaaatattaaaaatattttaaaatatcaccttaagaatcacatttactgggaaataaaaggcagttataataacacaggaaacattttgactgcatattccatgaaattactactgtctttatacttttgtagcataataagtgattctattttaatctaatttcatatataatagtaatatattttcataatttaacgagttcaaatctaaacatggcacttgcattttaaatgcaaagtatatgtaagatccaattttaaagatccattttatgtattctttaaaatgttttcttccatcatacaacttcagatcgacaatatattttgtattgaattgttttctttaatttttacagtgaaacttgtcatttcaagtttagtaaatattatgacttgattttcaaataaaaataaagcataccaaacacatctacctgctatctaagagtattttaagaatcagtttccaaatactattcagagcaaaacctatagaatatccagaaactgtcactagttttttactcatttctgaattcattagcttttaaactctttctttttttttaggaaaatcaccagtggtctatatgctggtacaatttaagcaagaagacagttgagaggaagagataggcttgcaaatcaaggtacagaattgccccagataacttttttcatgtgcgtccctgtgaagagaccaccaaacaggctttgtgtgagcaacatggctgtttatatcacctgggtgcaggtgggctgagtccaaaaagagagtcagtgaagggagatgagggtggggctgttttataggatttgggtaggtaaaggaaaattacagtcaaagggggtttgttctctggcgggcaggagtgggggttgcaaggtgctcagtgggggtgctttttgagccaggatgagccaggaaaaggactttcacaaggtaatgtcatcacttaaggcaaggaccggccgtttacacttcttttgtggtggaatgtcatcagttaaggtggggtagggcattttcacttcttttgtgattcttcagttacttcaggccatctggatgtatacatgcaagtcacaggggatgcgatggcttggcttgggctcagaggcctgacattcctgccttcttatattaataagaaaaataaaacaaaatagtgttgaagtgttggggcggcgaaaattttgggggggtggtatggagagagagaatgggcgatgtttctcagggctgcttcaagcgggattaggggcggtgtgggaacctagagtgggagagattaagctgaagggaggtcttgtggtaaggggtgatattgtggggatgttagaagaaacatttgtcgtatagaatgattggtgatggcctggatatggttttggatgaattgaaaaactaaatggaataacagaaggagaaaaacaggtataaaaggtctaagaattgggacaactcaggatatctgattagagagtgcttaaggagattcagcatagtcctgccagcaaagattatttatttacttcaagagttaagagtggcagtttggggatagcaccaggagatatcagctgtgatggcttggaaaaacagtgtaaactggcagtgtaaacaagagcagggcatgtatgagtagttgagaacggtgaataggagtatgactagacagaagatagtagggatgacaagttttttgggggcacagtctaagttggtctggtgtctggaatgagactggggcctaataaaaaggagcgtctatacaggagcttaaatgggctgtaccctgtagcattccgaggacaggcctgaattctgagaagggaaagtggtaaaagtattgtccagtcctttttaagttggtggctgagcttggtgaggtgtgtttttaaaagacctttagtcaattctacttttcttgaagacggaggaccataagggatataaaggtttcactgaatactaagagcctgaaaaactgcttggctgatttgactaataaaggctcatctgttatcagactgtattgaggtgggaaagctaaactgaggaattatgtctgacagaagggaaaaaatgactgtggtggccttcccagaccctgtaggaaaggcctctacctatccagtgaaagtatctacctagactaagaggtattttagttatctgactcagggcttgttgagtaaagctaatttgccagtcctgggtggggcaaatcctcgagcttgatgtgtagggaaggcagggggcctgaataatccctgaggagtagtagaatagcagatggaacactgagaagttatttccttgaggatagatttcctcgatggaaaggaaatgagaggttctaagaggcgggctagtggcttgtactatagcataacctgcctttgctggtgtgtggcgattaggcctggtggaaccgccatcaataaatcaagcatgatcagggtgaggaacaggaaagaaggaaatttggggaaatggggtgaatgtcaggtggatcagagagatacagtcatgggggtcaggtgtggtatcaggaataatgtgggaggccggattgaagtctgggccaggaacaatggtaattgtgggagactcaacaaagagtgagtatagctgaaggagccgggaagcagaaagtatatgcgtcaggtatgaggaagaaaatagattttggaagttatgagaactgtagagagagatttgacatagtttgtgattttgagggcctctaaaagtattaaagcagcagcagcagccgctgcatgcagacatgagggctaggctaaaacagtaaggtcaagttgtttggacagaaaggctacagggtgtggtcctggctcttgtgtaagaattctgaccactcgaaccatgcctaggaaggaaaggagttgttgttttgtagaaggtgctggggtttgagagatcattcggacacgattggcagggggagcacgtgtgtttttatgagaattatgccgagataggtaacagatgaggaagaaatttgggcttgattgaagtaatggggctgtctgtgaagctttgcagcagtacagcctaggtaatttgctgagcttgatgggtgtcagggtcagtccaagtgaaagcgaagagaggctgggattaggggtgcaaaggaatagtaaagaaagcacgtttgagatctagaacagaataatgggttgtagaggcaggtattgaagataggagagtatatgggtttggcaccaaggggtggataggcaaaacaatttggttgataaggcgcagatcctgaactaacttgtaaggcttgtctggttttaggacaggtaaaatgggggaattgtaaggagagtttataggctttaaaaggccatgctgtagcaggcgagtgataacaggctttaatctttttaaggagtgctgcgggatgggatattggcgttgagtggggtaagagtgattaggttttaatgagatggtaaggggtgcatgatcggtcgccaaggagggagtagaggtatcttatacttgtgggttaaggtggggggatacaagaggaggacgcaaaggaggctttggattgggaagaagggcggcaatgagatttagctgtagtccaggaatagtcagggaagcaggtaatttagttaaagtgtctcagcctaataagggaactgggcaggtggggataactaaaaaggagtgtttaaaagggtattgtctaagttggcaccagagttggggagttttaagaggtttagaagcctggccgtcaatacccacaacagttatggaggcaagggaaacaggcccttgaaaagaaggtaatgtggagtgggtagcctccgtattgattaagaaggtaatcacttaccttccactgtgagagttacccgaagctcggcatctgtgatggtctagggggcttccgaggcgatcgggcagcgtcagtcttcagccgctaatccgagaagatctgggaaggagtcagtcagagagccttgggccagagttccaggggctctgggaatggctgccaggtgagttaaacagtccgattttcagtggggtcccacacagatgggacacggcttaggaggaatcctgggctgcaggcattccttggcctggtggtcagatttctggcacgtgtagcaagctcctgtgggaggaggttctggaggaatgcctggccgctgcggttcaggcgtttggaagttcttgtgtgctggagatgtggctggggtttgtctcagagtggaggcaaggaattgcaacttttttctattattgtacaccttgaaggcgaggttaattaaatcctgttgtggggtttgagggccggaatttaatttttggagttttatttaatgtcaggagcagattgggtaataaaatgtactttgagaataagatggccttttgaccttttagggtctagggctgtaaagcatctcagggttgctgccaaacaagtcatgaactgggctggatttttatatttgatgaaaaagagcctaaacgctatctgatttgggataaagaaaaaggagcattaaccttgactatgcctttagctccagccacctttttaagagtaaattgctgggcaggagtgggagggctagtcatggaacgaaactgtaagccggaccaggtgtgaggaggggaggtgataaaaagattatagggtggaggagcagaggctgaggaagaattgggacctagctcggcctggcgaggagcagcctggggaggaagggagaggtcagatgggtctgtagaaaaggaagattagacagactcagcaatgcttggggttggtactgaggggacaggcgggagggaaagaaggaagatttgggacgagttgcactgggcacagagactaggaagggactgacgtgtaaaagaatgcctggacgtcaggcacctcagaccatttgcctattttatgacaagaattatttagattttgcaggatggaaaaattcaaagtgccattttctggctatttggaactactgtcgagttggtattggggtgaagcggcattgcagaagaaaataaggcatttaggttttaggtcaggtgtgagttgaagaggttttaagtttttgagaacacaggccaagggagtagaaggaggaatggagggtggaaggttgcccatagtgaaggaagcaagcctagagaaaagagagtagagaaatggaggaaaggggttcaggggttcttaccttccagaaaagtgggaaaaggggttggggcacagagataagaggttggggggcagaaataagggattggggcgcagagatataagaggttggggcacggaaataagggactggggcacagagatacgaggttggggtgcagaaataagggattggggcacagtgataagaggtcagggtgcagaaataagggattggggcacagagataagaggttggggcacagaaataagggattggggtgcagagataagaggttggggcatggaagtaagggattgggggttcttgccccatagaaaagcgggacttgccactaagggtgaaggagaaggggttggggtacttaaccctctcccagaaaagcgggacttgccgctaagggtgaaggagaagggcttgaggggtacttgcccctctcccagaaaagcagagaaggggtagagacaaggagagaaggggttgagctacttgccccttccccagaaaagcgggacttgccgcttaaggtgaaggatcaaggcaggcgtccctgcgtggtctgacacccttgaaacgtgggtgtataatcagagaggcgtccctgcaacgattaaacaccaagggaaggctgccttcccagtccgtgaccggcgccggagttttgggtccacggataaaacatgtctcctttgtctctcccagaaaatgaaaggaattgaaattaagagaagggagagattgaagagtggaaaggagaaagtggttgatggacagtgagagaggttggagaagagagtaagaagaggccgtttacctgatttaaaattggtgagatgttccttgggctggtcggtctgaggacatgaggtcataggtggatctttctcacggagcaaagagcaggaggacaggggattgatctcccaagggaggtaccccgatccaagtcacagcaccaaatttcatgtgtgtccgtgtgaagagaccactaaacaggcttcgtgtgagcaacatggctgttatttcacctgggtgcaagtgggctgagtccgaaaagagagtcagggaagggagataagggtggggccgttttataggatttgggtaggtaaaggaaaattacagtcaaagggggtttgttctctggcgggcaggagtgggggtcgcaaggtgctcagtgggggtgcttttgagccaggatgatccaggaaaaggactttcacaaggtaatgttatcacttaaggcaaggaccggccatttacacttcttttgtggtggaatgtcatcagttaaggtggggcagggcatattcacttcttttgtgattcttcagttacttcaggccatctgggcatatacgtgcaagtcacaggggatgcaatggcttggcttgggctcagaggcctgacaacttttaattaatatcaactgtgagtagagaagttaaaatgaaatatcaaacacaatgtttgaccatgataaagaaggtgtggagtttcttcttcttggccatttattggatacttaaagacttgacattttcctcaccaaagaagtcactaggacctatggtacaacgttaagatcaatgatgaaaaagagtcatcctcaatggaagagtatgcatcattctgattatacacaagcattgattatttgctgatgtgagaaagggtcaagataaaaattgatctttgaatgtatcttattcaattttttaatatttcatagtgcttcagttgtttggcacatttgtcatatctttaattttttttgatgtcctgctccacccttccatatcactataaaatgttaatacatttttcatacacatgcagaacatcaggttttaggattatttttaaattaaaatctgaggccaggtgcagtggctcacatctataatcccagccctttgggaggccaaggtgggtggatcacctgagatcaggagttcaagaccagcctggccaacttggtgaaaccccatttctactaaaaataaattagctgggcatggtggtgcgtgcctgtaatcccagctactcaggaggctgaggcaggagaattgctggaaccgggaggtggaggctgcaatgagccaagatgataccactgcactccaacctgggcaacagaaagaaactccacctcaaaaaaaacaaaatctagcctttcatgaatcttacatgtataaaatgtttacacttttattatgtaaaagtaatgtattcccccaatggattttataacaatacagtcagtccctcttgcaaaggggactttttcataactcccctactgtttcattaaaattgaggtttaatttgattctgtgttctcacatttaaaaatctatatttttaagatctgctttttccttcgaagtaatggctttaactccgaatcacttttaacagttttattgacctgtaattcacatactatccaatttgcctattttaatgtgtagaattcagtggtttttaatatactcagagttgtataatcatcatcacaatttagaatatttccatcaccccccaaagtaatcctatacccatttacaatcactccacatacttcttcaacccccagcactaggcaaccagtaatcctctttttatctctgtagatttgcttattctgagaacctgcaaacttttaacggatgtacttgctgggaatgtcagagaagttgtttgagattaagaagggttggcaaacaaaataaaatttgttgttagatttaggcaatagggtcttgatttatttggctaagttcttaattttttcacacttctgaaatgaaagtaataaaattttgtctctgagcttctgtcatccttacttttgctattcaattttattttagtatggcaaaataaataaaaaggaagtcatcctccaagtactcctcttaacaataaattgattcagaaaaaccaagtttcaaactcaggaaggttaaatttctagtccatttctttcattttttttccattctgtccaatcaagatttgtcaaacaaaactatcctttccagagaagaggcatttacctcaaaaaaacttttgtgtacgtggtatttgcagttgaatgtcataagaagcaattgattgaagtgtgccatctgtttcttttctaaatctctaatatgcaagacacgtctttaaaattacacttattcagaggatttttatgaaataaaattgcctgtcattctaattagctctgaatacttctcttgcaacagtggtgtggcataacacattagtaggaactttggttggtatgtattttggccactaacatcactaataaaaaaacagtaaataaaatcggaatatagaaactggggctttctacataaaatctgatttttttattagtatttattatgcttcccattaaaacaataaatctgatatgtattatttaatatacttcccattaaacaatacatttcataatacctaataaaataagaaaatagatcctattaattacatcctcaaatacatattttaatatttttctgaaatatatatgctctttacacactagaatataatcgttttcgttatctgcattgtgctaaatgtgaagtgatgggcgatgcaccattttgtatttaaaagatttctcctatggtttttttctgttgtaattactcttttggttgaccacgttcggttggacttctgaccattgttccaagcatccactccattactctatttgacatgacacagtgagtttaaaggacagtatcgtgttagacaaagattgaagttttaaataatacatgataacttgaagggaaagttaagaaaatttaaataaataaagaggatgaggcaaggggatatgtatgtatgctttaaatagtctataaataagactcagtgaaagatgaaaatatcgttttgaacaaagaaagggtggaagatatagaaaacgagcagagcatactgtatggttccatttacataaacttccagaactggcaaaaataatctacagtgatagaagtcaaaaagtagttgcctggagcttggaaggtggtgactacaaagaagcaggaggatggaattgttttatgttttcatcacagtggcaattacacgggtgtaaacattcatcaaaagtggtcaaactctacatttaaaatatgcacatattagtatatgtaaattacactcattaaggtggattccttaaaaagtcaaagtaggcagtaaagggtaccattcagtccctctgtggtcctgctttaatactgaatggaagacaacctccttctttttaaatgagcatgaatatccatgaatatcgaaaagagagcattaagctctttgtaatgactgcatttcctcatcctgctcaggattgactactggcattttaatgcacggtaatgtgggcatttctttgatagacattccactttaaatgcctactttttccatattatttcaactgaaggagaaataaggcagcaaccttatctattaaatcttcacagggttcttatgacttttaaagcatcattttgaattgaagctactattttatattatcttttctcagggtgggctgaaaacaaaatagcaataatttttgtaggaaaagtaggttaaagtctgtcttgaataatcacaaaatcacacttaatgtcacctcataaatcagttataaatagtgtcagaggtaatagaattgcacatgcgaaatttaaaaatattctgtgcacaatttttgtagaatggaatggcatggtgtttggattaatatgtacggcaaggttatggtcaggcacatctatgttttctatctagagtcactcgcctacaaagggaaaaaaatcagtcactgtggaaatttaaaaaataatactttggtaggatggagagaaacttgaaatgacagagcgttaatcataaaatgtatctcaaatttatgtataattagctgagaggaaaaaaattggaaaggagagtgtatgatagatgcaaaatgttaatataaagaatgtcgtgatcaggaggaagggaagaagcaagtgagcctcaagagaaaaaaatttgacttcactcaaagtacttcatatttttgcaaaattaattaaaattttagaaatcgacactaaaacgttagagacctcagaaaacactctcagttgataggtcttggagaaatttttttaaagaatatctgattggataatttttaatgacggagcagtaatgttttagtgttaaatatctcaatcttcccctaagggggaaaaaaaacgcaaaaataaattcttcgtgaataaatggcataattacaatcatagcacacattgttctgactgcaatagtcacaattcgccactagggggctgtaattctgttcttagcagttcttggtccacaacattttcattccctcccagggtacttgaacagttaggtgaagttaagtgggagcttcgacgggcataacaggtcattaatgtgtattgagatgatctcatgcgtttctgcgatgcgatgtataattcttgttgtatagaataataacttggccaccagcttcttcaccaagcatggagtctcatcattgctccaagattgctattaattttgtacgtattacgtagaatcattttatcttcctttttcccaggaaattatttttatttactataagtctcctactttttcatgaaaattgaaggttaatgtgatcatgtgttcttgcatagtcatttcaataaatctgtgctgtaaaagagacaaaaaatgttggttcaaatttataaatactaaatgtattttctgaagtgtagattaaaacagcaaagttgtgggtttttttattttttttctttttttgagacggagtctcgctctgtcgcccaggctggagtgcagtggcgcgatctcggctcactgcaaactccgcctcccgggttcacgtcattctcctgcctcagcctcccgagtagctgagactataggcgcccgccaccacgcccggctatttttttgtatttttagtagagactgggttttaccgtgttagccaggatggtctcgatctcctgacctcgtgatcctcccgccttggcctcccaaagtgctgggattacaggtgtgagccaccgtgcctggcccaaagttttaatccaagttatttttcactcatttgaagttagaactattttttactttcataaggaatgaaaaatataatttgttggtgtagtacattgtatcttgcatgatgtaaggggtagtcacattaaattatttaaatgcggctataacatttattgaatattttatattatacttcaaatatgttaatttatgttgataaatttatgagctaacaaaagatcttgtcctcaatataataattaacatttcctatgtatttctcataactttgatgatctttacatcactcaattttacttactaggctgagtgcaagagttagctttatatttttaaaaataatccctgcatttaaaactttttttgatcatgctttatgtgtttggggaaatttttgatgtttaaaacatgtcaaatattaacgtccttgcaccaaatttatttgtcctactgcaaaaatatagctggctaatatttatttcagtcttgtttttgcattccagaataaatattggcaactgatgctcttacaataattgatacagaaatggtgattttcaaatgttgtttcctcttccagcgtctaatattgttttagtatctgtggatgaaatactatttactcttgctctgtaattgttctatgtgaaatgtttcaacttgacatttgacttagaattttgctgattcatttagaattcttaactaatatttaatttcctctttagcagaaggacgaacactgacttacctgctataggaatggggtccggatccagaccccaagagagggttcttggatcttgcacaagaaataattcagggcaagtctgtaaagtgaaagcaaggttatcaggaaagtaaaggaataaaagaatggctacttcatagagcagccctgagggctgctgattgttttttattttattttattttattttattttttttttgagacagagtcttgctctgtcacccaggctggagtgcagcggccgatctcggctcactgcaacttccgcctcccgggttcaagcaattctccctgcctcagcctcctgagcagctggaattacaggtgcccaccatcatgccaggctaatttttgtattttttagtagagacggggtttgatcatgttggccaggctcgtcttgaacccctgacctcaagtgatccgcccacctcggcctcccaaagtgctgggattacaggcatgagccactgcgccctgccctggttgcccatttttatggttatttactgatgatatgtaaaacaaggggtggattattcatgcttcccctttttagaccatgtaaggttacttcctgatgttgccatggcatttgtaaactgtcatggcgctggtgagagtgtagcagtgaggacgaccagaggtcactctcatggccatcttggttttggtgggttttagctgggttctgtactgcaacctgttttattaacaaggtcttcatgatctgtatcttgtgctgacctcctatctcatcctgtgacttagaatgcctcaactgtctgggaatgcagcccaataggtctcagcctcattttacccagcctctattcacgatggagttgctctggttcaaacgcctcttacatacctgctgtactaatattttgctgttttaaattcattttatataaatgagacttctttcttctgaagcttataggtatcagccttactacttttcagccattcattatatgtgaatggtatacctactctgtgtggcaccttacttatggagttcttactgcatttttctcaatgtttgcttttagggttatcagctaacacccgcgagcatctataacataggccaactgacgccatccttcaaaaacaactgtaagtatacacataagcgtgcctcaagactcttattttgaaataatattcaactattatatcaaggtgattcctattattttgctagtgtagacctacccctgaactagtaaaacatatgccattaagggcctaacatgtttgaaaaagaatattatgtaattggtaaacagcattttaatgcaacctgaaaaaaaaaaactcggcttattttattactaagtaatgtgtgatgcagaccccttaccgaactgttaaccaccaccgcagatttatagtaaataagtataaagtatgatagtataaattgggacaattaggttagcgaagttcaattttcttcttcaatgacaaactcttgttttttttttgtttttttgttttgttttgttttcttgagatggagtctcattctgttgcccaggctggagtgcagtggtgcaatcttggctcactgcaacctccgcctcctggggtcaagtgattctcctgcctcagcctctgggtagctaggattacaggtgcatgccaccacaccaggctaatttttgtatttttagtagagacagggtttcaccatgttggccaagctggtctcgaactcctgacctcaggtgatccgcccacctcgacctcccaaagtgctgggattacaggcgtgaaccacctagcccagcctgctttcagtaacaaactcttatatccatgattggggtgtaggaaatctagctgttgttttctatgataaattttagaaaacatagctagctcttcaaaatactctcaatggatgcacttaaaaatctcagcaggagaggcagggagaggagaattttgtttctcaaaagggagtatcatttataaatgctgaaaaacgcagatccagataatggaacactctacattctatagatgtctagagcatgattatttgattgggtaaatatattacaagttaaacaaggtgaatttaaattggattccttattttcgactccagactgcatggggaattctcaattaaatttctgattgttctcataatcatacaaatatttaataccacaaaatgtttttagaatgatagttttggaggaagaactgatacgatggtatagactaaatcatttttgacagtaaaattttaacagaaatttttagtataacattaatatatacgcattagattaaagaagtgaaaagtcgaagtctatcaaaattcgaaagaggatagggatggaataaggttgggaatgtctgctgcacatgttaataatgatcaaaaataaaagaaataagaaaacagtgatttgacatcaagacagttgcatcaaaatggctgcattaaaatgtaccctttttcagaatagccaattgttctgttttattcaactactcaccatttaagatgatggcaaaggtaactttctttaatacatattgaaaagagttcttgatgctatcaacagctttccagaggggaaaaaataaaaaaaaatttcataagggacgttcaaaaagtataaaatgtaaaattttgaagaacccccacagcagtcctgaaagcacacaggaaatcactcattctgtttgtgaagattcaagtttgcttgcagatgttttcaatgcgttggtgaaataggttaacctggacatgcaggtaagtttctactctcaggcttcaaacaatgttcacacaagactatctcacatatatcattggcatggtaagcctcgcctggtagtaaagaccaaggtcagccttactagaatgtgaagttcgccaatttcatctttactgtcttcctttcaatgctattctgtccttaccatgttgtttttcgacctctatgtgccaaatattcacaactccatagtgagtactccttgcttctctcccaggcctgtgcacccctctttgtacacacacctgttgacactttgctcttatctaggtattaattagagaagatttgatatacaaattcatcataatgtggcaatatcttacaagtcctaccccatctagagggaggcatggtttaacatgtggttcctataactgaatcccttgatgagctgaaggggaaaatatgcctcaaatctcatcatgtaggtatgtaaggcctttgcctacttcacttctctgtaaggctgcctttgtcagggtatatcagtgacatgaaaaagatatgtacaatatatttattatagaaggttggagcttgattatttatggtaaataatgttggtgttgttaaatatattaattcttactgtaaatagaagagtaccaagagttttattgtaatgtgtatacatctacagcctgatattctttgggttgttttttttttaatctctgggtccttggtgatttctatggctattttatttttatttttatttatttattcatttttgagatgaagtctcgctctgttgcccaggctggagtgcagtggcatgatcttgactcactgcaacctctgcctgccgggttcaagcaattctcctgcctcagcctcttgggtagctgggattacaggtgcccaccaccacacccacctaatttttgtatttttagtagagacagggtttcaccatgttggtcaggctggtcttgatctcctgacctcaagtgatccaacagcctcggcctcccaaattgttggaattacaggcataagccaccgcgcccagcattttaagctatataattcaataaatcttaaaaagaaatttgtctccactatcatttgaacttagtaataccttccgtaaagccttacttatgctacctattctactgtgctatagatgtatgtatatatttatatcacagtcaaagtaacaatttaggtaatgtattcaatgtctcctgtgaaaataatcagttggacaactgtgctcctcctgagttgtataaggtttgtgatatcagtaagtatcaaaggtaaacattatttttttctgtaaaaccgcatcaacatttcaagttattcacagaaaaggttaatgtaatgaggaaatagtatgcatacattggttctacattgtcaaaacatgatttataatcgtcactctcttgacacttatattaacaatttaggaatttttatctttcaattatgtggtcttgtgttactataaataaatgcaagttcaattaacagaatctgttttcaatatgagttctctgatacagaactgagttatctattgcaaagttctttactctaggttaccaaattacttcaagaaaaacataaataggctgggcatggtggctcatgcctgtaatcccagcagtttgaaaagtcaaggtgagaggatcacttgagcccaggagttcatgaccagtctgggcaatatagtgagactcccatctctacaaaaaatttaaaaattagccaggcatgatggtgcaaacctgtagttctagctattcaggaggctgaagtgggagaattgcttgagcccaggaagtcaaggctgcagtgagctgtgatcacaccactacattccaccttgggtgacaaagcaagatcctgtctcaaaaagaaaaaaaagaaagaaaaacagaaatacagaaatagaccataacaaatagcaaatgttgcttacattgatagacaattccatcatttcactttgcagtttgttgtagttatctgttttattcacaaatattttaatttcacatctttgatttaaaaatgaaatatattttactactcactagctcttcatttgattgatgtaaataatatataatcaaatgcctgtatcaacaagtcaaacatattctgtaaatatatacacctgctatgtacccacaaaaactaaaaattaaaaaataatttatgaaaggagcagagaattgagtgtgttaagtaacaataatttgttctatatatagcacatgtattttatatcacttacaggaactaacatgaagtcttgcacataatatacattcaataatatattcaataattagtttaataataactatcaatattatgacaaaataacagcatttctagaagagaggtactcaatcaggaatgcattttagtaaatgaacatacacatttaaagcacaggaaaacctgaactttataagatatttccacattctgtgcagtttttgcttttgttaatcaaaaatttaaatgatcctttataattatcagttgaagtcaaaacacatggaattaactaagtacttaaagaactgattatcgtaattaataatctaacttagccaactgataactgttaaaactatctgccacacatatttttcactcaatagtctgtgccaaaattcaacaagactaacaacatagtttagcatgcatcctttctaagatactgcaacttttgtgaaataagtgaaagttacctcgttttggaaaggaaagtagccaaatggttatcaaggtggtttcaaagttacatgttcatccatattagataataacagtaaaataattttatatgtatgttttctggttttcaacatatgtctttcaaaaatcggattgactttttaaattatacattttcaaaacattaatatcttcttaaatataaaatataggtataacttaagtaactgtaccaagtaaattaatacatgtcttataagaggatattatgcttaaagagtttatgacacaagaatattgatttttatttcgctatttgaaaatgtgtattagtcttagcctttagtacatatgactctaaacgtaacatagctctttcaaataaaatacagacattttaattgtgtggaagcttttatatgctgtgtgaagtgactatttgcatattacatcatgtttcaattgcattttgcttttatttaaaaatgattttttcctccagcaaattaaacatatggcccagacaagtagtacattgtgcacataaaatttctaacaattcctttcagagattgccactgtgtagatctaagtacagttgtccacttagttctctcataacaagcctttagagatgctaataaactaatactaaagtaataatgaagatactattaaaatatgaaaaccaaatcatatatgtgtggtatatccattagatgtatacataaattaatctctatatatttatttttgcttccataaagtattctcagtgacttcctagggttttaattgtgtaagaaaatactctcaatgtgttgcaagtttcttagcatcacggggaattgcactgttattcagataactggattaacaagaaactgcgtcatccttgaatggcttactctcccttatcccccgtaatgaatttattactaactccagtcaactccagtcggttttaattcctaaatatcttcactccatttctacaaacatcataccagtttggatttccatcatctctttagtactagaataaccttctaactagttctcccaattacgcatttgcactcccaaatccgttctcccaattcttattgctcctaggaaaataccaaaatctttatcatggtttataaaagacaacctgatctggttcctcttcagcatcatatattccctcacccccctcatgaatagttgggccccactgatctactttcagttccttgagcacatgctctctctgatcacagggccttgccagaaattgtgccttctgttgtgaatactaccttgcattccccatctctcctaatacttacatcaccagtacaccatttaactcctatataagccatcaaaacacgagcttaaaggcatttttttttctgggatcagggaagacttcctgcccaccataccccctaacacaaggtgagaattctgttatataccctaatagataacatcatgtaccttcatcatagcaattattacagttgataattatacatttgtttttgtgattccttgaggattcctgtctcctccactagatgttaattaactccatgagatcaggaacagtatttgctttcgctcaatattgtattcttagcatctaacacactgctaaggatataccaatgatttaataaatatttgttgactggataactgaataaacaaataggtattatttatgaaaaagtcatttatataatttttggtgatggttggtctgtgactgttcgattgcagaggatatttttctaccttcccccaagtggcagctgtaaatattgcagcctggtgaaaaatgagaagtctcagtaactaagacctcaacaaagggttgtatatgtgagctgtcaactcataactgacagcagtaaaagtactgctatgattttaaatgtaatgttatctatacaagcaggtgaaacttatatatgcctaacaccatatttgcattattgaacagtccagcaaaaattttgaataagtttcacttgccctgtttcatgcagcacgaggttcacattcacattttaagatagcagataatcaaatcatatcactgctatgctttattaaataagcaaactcaaatgtatgtcaaatgagttatagcataatttataaagttttaagattattgccaatacggcttacatttcacactatatatttatgcatacatgtaatacagtatgaatatattgcctgaatatatgactatatggaatatatatattgaatatatatgaagataattgaaatatggtgttactaaatgaataccttgctaagtgatataatgcttagttcatatactttcctggctaagctttcttatttctgctgtaatattacattatactttatatgtattacacggaattgcactcggctattttgcaatgacccaaatttgcattaaattccatatatctaccataattcatacattttattatcctggtcatgtttcctgtttttcatctgctaaaagattgatgattttaagacagcatgatgagtgctagactagtgcagtcagtctggggaggaatctgagttctgcattttttttttctttttttggcagaggagtcttgctctgtagcccaggttggagtgcagtggcacgatcttggcctcactgcaaactctgtctcccgggttcaggtgattctcctgcctcaacctcccatgtagctgggactacaggcgtgcgccaccatgcctggctaatttttgtatttttagtagagacgaggtttcaccatgttggcaaggatggtctcaaactccggacctcaagtgttccacctgtctcagccttccaaagtgttggaattacaggcatgagctatggcacccggcctgagagtctgcatttctaaccagctcccagatttccatggactacacttggagtcacaaggtaatgaatcaggggatgagaaacttttgaaaagagctagatgataaatattttggatatgggaaccatgtaggctctgttgcaactactcagctctgccattgtagcttgaagtcagccacagacaacatatgaatgagtgagtggggctgggttccaatgaaattttatgaacactgaaatttgaatttcctacaattttcccatatcatgacatattatttatctttttgtattttttcaatcgtataaaaacaaatacatcattcttagcttgtaggccatacaaaaacagtctgttgttgccaaccaccctgctatggtataagatgccgatcgataactgttgtagaggctggaggggaggtagagtgtgacaggataggctttgtagaaaggattacagttgagctaggacttgaagaaggaaggcttttcctggacagacaagtaggagaaagtgaaagacaaagatgtaagccagcaacagcattagtatgttctctgaactgaaagcaatggattgtggcctgagaagaacaagcccgtctaggttgagaaggctcaatgaaaggggggtcccttaaatgcatgtctaaatagttttaaaccttaatgagtagtgatgtcaggtgagcatccagaatgagcagtgggggatgctattaagttctacatcttagaacttcaagtcaagagagaactggactactgggagggagaaagtatagaaatgactgaggaaaccaggaaaaactgcacttgaaaggccaaggctctttgaaagtgactacaaaatgttctcaaatgaaagctttgtggatgctttatacaaatgatcagggcttgcaaatttattgatgaaatgggaaatatgtatcacatagccggacagagcaagcctgtcaagccatttttccattgctacagagcacacagcagattaaaaagggaagctaagaactgaggattgaagatttgaaaaatggtctccccagatgcctcagtgtctgactgactttgctgataagctacagagtaggaatacacgctgaggggtaaaatgagcatatgggttttataaaagatgtttctattagttctctggaggtggcagtgaagtgagataatgaaatactacaaaaaaaaaccagagctggaaattatgaaaaatgggatatcaagtagaaaattaacaaaatccagtgcttttggaaactctcttctcccaattatttttctatttcccatctcgttctcacccatttccccacaggatgctgtccagttgttttggaggtatgtttcattggaatagtggagttaagatttgctgagtaactactctacaaaaagcatgactaataaaaaatctcatcatccaataaatgctgaattttactaccatttaacagatgaggaaagagaggcttggaagcctactttatttatccagatctcctccaaaataggcaatacatctgccagtagatgtggcttacctataacccctggtaaaaagtgggaagcagagcaaagggagaatttccgcttttccacaataagggaatgctagttaatcttccatcttccagacgtacaggaaagatttgtctttggctttgttcaaatcagaaacaattacctacaagttttggtcacagcattttaggtaatttttaaatactggctaaccatgagaggaaaggcagtaaggttttattaatagaagttagaaagggtagcaaatatagacatagtaaacttaatagggtttaaaaaaaaattcaaaggacctgtgatcaggtttcccaccaaacaagagagatattaaatatggttataaactatcatgtattgagcatctgctccatgccaggcactattggacagtgtacaaactatgtcctttaattttcacaacattccaatgactggttattattacctatatttaacatatgaggcctaggggcttaagcgagttatccacagtcccctgagtcctataggtttctattgtgtcaatctggtaatattaagtacctaacacataccagatgttaaacaaatgttaactattgttttcttgctagtattgtcattattataactgacgtttacttaactcctccaagccttacttaccttaaccataacatgaaagtcaacacaaaataagtttgccagaatgattaaatgaaacagcccacttaaagtttctggcatacagaagccacttagtcaatgttaaaaccgtataaattttctcttgaaggatgttttttatttttagatgaggctatataagacagtgtatattgatgctttcagctatttagtggcatgcccctggataatgaacttgatgtttatcttcagaaaacaatgtttgactagaaaatgacttttttcaagtgcctgtgatcaggaggttaagagagtttatggctgaaatattcagcatacacatcaaagtttcttagttttttctatttcatatgctatttccttttcctctcttcctataatttgtctccctaagaacttaaatagatattttatactgtttgtgtatttagcaaaatagtattatttataatgcaattgaaatagtctaaaccattggtgtcttagtctacaagttgtctctttttttggtggtggttttttttttttttttttttgagacagagtcttgctctgttgcccaggctggagtacagtggcatgatctcaggtcactgcaacctctgcctcccaggttcaagcgattctcgtgcctcagcctcctgagtagctgggatgacaagcatgcaccaccacacctggctaagttttttgtattttcagtagagacagggtaggctggtcttgaactcctggactcatgtgatccgcccgcctcagcctcccaaagtgctaggattatgggcgtgacctaccccacccagccccaaaagttgtcttttaatagttgaagcaatgtttactggtagagcataagcgctcaataaatgtgttaaataaatatcagatgaaagagtaaatgaacaactctttccattattacttattatttttatatctttagatttccacaaagaatgcttccctaaaattggatatgtacttatctctgcaaattcattttgacaaaacacatcatattctcctagatataaaagcacaaatgaattaatctttattacactttacaagttaaaattatatttgaaattgattttgctacttgatgtgctaacatttaaatgcagctcagcttccttatattgtttccttcataatgcttctcttcatttaaaattcattttgatgatttctggcactccttgtgcctttaaagcataagataaaatttcagtttacaacctgatctttatgttattgactaacagcaacctctgattccaaaaggaaaaaaaaatgaccaagcatctctagcatgttaagaaagaactcctgatagtttagagtcttctccaaatttgtcaaataaaggcacagctagaatgtatattattaaaaagagtaattctttgggaaaatgtttatttgagagcttataattgaaaagctagctcggggaaagaaagccctgatgtcaaattaggggaaaaaaaatgaagaaagggcaagattagcatgcattgtaatggagggtgctaaataaggctctataaaacagtgcatattgataatttcagctatttagtggcatgcccctggatatttaaaaagatatttggatatagtttacataaaacctccaaatttcaatagttggtgccaccttcaccataataaatgagttcctgctctgttaatttccatgacagctggttgttcaaaagagcctgtcacctccctccccgcaccttctcttttgcacaaaccagctccccttagtattctgccatgattggaagcaccctgaggccctcaccagaagcagatgctggcactatgcttcttgtacagcctgggcttttctaaaatattctctacttatagtttgggtgtttgaccctccaaatctcatgttgaaatttaatccccaatgttgagaatggggcctaatgggaggagttgggtcatgaggtaaaatccctcatgaatggcttggtgctgtcttcatggtaatgagtgagctcttgctctgttagacaccatgagagctggttattaaaaagatcctggcatctttctccctctctcttttgcttcctctctcaccatgtgatctttgcacatgccagctccccttcaccttccaccatgagtggaagcagcccgaggccttcaccagatacagatgctggcaccatgcttcttatacagcctgcagaactgtaagccaaatgaacccctttttaaaataaatcacccagcctcagatattcctttataacaacacaaatggattaagacagaaagtgagaagtggcttttgagctcaacattgaagacagaatagaatttagaatttgaagggggaaagagaaagagtatctcaaagtgtgtgttggagtaggggagtttcatgaaaagcttggaaaccaatgagtgttgaatgaggcagggctgatggtctgtggccttactgggttgtactcagtaataggagatcagctggaataggtaagtgacagcaacttccagcagctctaccttcattaaatgttatgatatcatgaaccagagaacataaagttctaagtttattttgggggaatgttatgtaaatccaagatcattatttttgattcttcatattaataggcattaagtgtgcattagaaccaaaaatggataaccaaggatatggtaagaggcagatgccgatttggtggttttgatatttacggtagctcttctaaagagaaactcctgttaagtgcttagacatatgggactggccagcctaggcaacatgtcaaaaccccatctctgcaaaaaaaaaaaataataataaaaaattagccaggcatggtggcacatgtctgtagtcccagctactcaggtggctgaggtgggaggattgcttgagcccaggaggttgaggctgcagtgggttgtgattgggccactgtactctagcctgggcaacagaaggagaccctgtcacaaaaaaaaaaaaaagaaaaagaaaaagaaagaaatatggaactggaactctcatctttgtctcatagttttgatgctttgtgctaattattatacctgtaacaaacatcccttgccaccaggtggctacagagttatgccatgttttcaagagcttaagactccaatgtagtgaaagcttttccaactcacaactttaaaaactgataatctatttaatgttctatctactatctagacaaccttttaggaaaagttgacttgagttcatcccttctcaatattcataggtttagagaattgatttatattcctaaagggggcactaaagcaaatgaaatagaaggaattcatatgatttgttttcagtttctagtgaattctgtcatttaaaaataatttttattcgtgttccataattcactgattgagattccttatggcagagttatagctgtgagaagagatgttcactgaattagagcaagagaaggatagcaagcctctataaagccttaagtggaaggtcagaggcaatttgaatagtagtagttggcagaatacagattcagtgtctctgacttcattaaacgttatgatatcatggcctacagaacataacgttctaaatttattttttgggaaaattatataaatccaagatttttttttgactcttcatattaataggtaatgcattaagtgggcattagaaccaaaaaagatgtaagctagtttttaaaaggcaaaacacttcaattaacatatcaaaatactcttgtcacaaggaaagaatgttgttcattgccctaaattattcataagttttcacataatttgctgtaaaccatagactgatagaagagtccagaactagtagttgatgttgatacaatgaatttcatctttttccccttcttctacttgtgcctatgagggttataataaagaatgagtggactaaggtatctggaaaatatattcttaaatattagattaattaactaaggtaatgatggagaactattatgtgatcagcactatgccaggaattactggggttgcagaaaagtattggccaagatatctgaccttcacttaaaatcttattggtgcgataagattaattaacataaaataaagaaaaagaacagtgtgctctaagcaataaggtttatacatgtacaaagaggtgaggaattaatgaagcctgcatttcagcagaagatccttaaggaagtgctcttatcaactgggatgaattgtataatcattttctgtcattatctctttcatatcattgcacagtctcctttttatgccccatgcaggcccttgcacatggtaggtgctccataaatatttgctgctggatcaaataattttttcacaaggatatagtaaaagcaagcaaaagagagacattttgtttttctgttgaatagttatcttgagaaaaaaatctgcattgaccatgatagagtaccttatcattagatcataggatcagaaagtaaagcttataaatctgctttctaaagagtgcagtgcccagtagctcatcctcacaggcttgaagaatgaagaccaaaactggaatgcctagtggatcctgaaaacaattttagttcactagtctgaatcaattagacatgacctataatatcaagattgcatgtagctagtagttaacttttcagcagaaatgtttctctaatgcttggtatatgtaaaatttgatggaaatatttaagtaatgtgaatttgctctcttttttaaaagcagtatttaaatagtatctattttatgcctaacaaaggcaggagtcttttatcttgatatctgtatctatctatctatcttttaattgagatggagtctcactctgtcgcccaggctggagtgcagtggcacgatcttggctcactgcaacttctgccgcccgggttcaagtgattcttgtgcctcaggctcccgagtagctgggactacaggcgtgcaccaccatgccaggctaatttttttttttttttttttttttttttgcatttttggtagagacagggtttcgccatgttggccaggctggtcttgaactcctgacctcaggtgatctgcccacctcagcctcccaaagtgctgggattacaggcgtgagccaccgcgcctggccaatatccttatattaaggaactcttatttgtttagaaatgctcctcttaaatttcagtcctccaaataaacaaacacattgaccagtatttgttgcaactagtagttggcaagtacgtaattttattggaacatggttaggcataattagaacagtagcacatcaccaaaggtagtgatagaataacagccaccaataaaataaaaactttggcggaatttctgtaggtgaattatctgtactacaaagatgcattttgacgtgtatgcacactgagagcaatataagaatttaggattaaggctgttgatatcatacttacatataaaacaattattttgggtactacaactgcttttcaaaactgtcaaataatgaacatgtatttttcggaatgatgaattagatggaaccacaccttcataagtgaatggcccaatgtaaactattaaaacccacaattaataaacaactagtcacatgttatttttccatctttttatatttatatctgtgaaatgatctgtgcatttaagagagtatctatactctggttacccaacagtttagaaacgggtctccattggaaaaacagaaacgggttaatttgtatctttcccttcaatttgctattattctagaattttaggggagaaaatatgcccatttatgagtcacagaaaagcctgtgccctttaatatctggagtacactttcttccccgactcctaaagtgggtaatgcttacttttaaattgttttcctcctcttcattttttaaaagccgttagccaagaagggactaggatatcacttgtagttctcattttgctgagaagtttctggtatttgattccattctacttcaaatgtctgagaaaagttccaaacctcaactttgtacatgaaacttccccatacagggaggacaggcaagaaagtaatgggacattttatacctattgtaagaaccaagcatttgtgggaacgtgaaccaactggatctcttacacattgctagcagaaatataaatttgtaaaattacttggaaaaagttggcattatctcttaaaatcgaacattcacaatctgtatatgatgttttgttttaatttttaattaattaattatatctatagagccatatgtggagacatgacaatggtgattcatacaccaagggttataattaatccagttctgtgcactagaggccagattattcctagaattcaaggatggctgagcacctaagcagcatcatttggtaaggcagcataccaggctaggacaaaagtcaagggggtatagagaaaggcacttgttttggtgggaacactattaattagagtagtgcttggttcataaaattttatctatgaatatttgctgacttaatgaagcaaacaatgaagaaaaaggtaacgattatttgccaatggctgcttgaggtggcagattttcagcgataaccaagagaaaaaaaaaagaggtacatcaaatggatagttttctgttttgtacatttgagagaatgtgagttccttccagaggcacaggaaagatgtatcattgtccttcaaacaattcaaggatagtgatctacaaatttgttgtcaggaaatattaggcaatttaaaatagtcattcaacatatatgccaacataaaatagttggatctaaagcaacttttcttttgtaaggggaaattataagaagaatagaaaattgtagaattattaactaaaaaaaattccaacatttttttaccagatcccgcacaaatggtaatttgaaaaaataaaaaagagagttggtattggtgagtggggagatttttagttatgacaatagctattaattattaaatgtttaacaactaatgtcaggtagtggactagactctttgcaagttatttcttccaattctcacagcagtcaatgaagtagttattactgattccatttaatatatatgaaaacagaggctacaagaacttgagtgagtttaccaaagtcccacagctagtcagtgacagtgctgggattctgagcccagatctgcctgattctaaactcacattttcttcactggaagttgacctacgtttgcagtcaccatgttgagtgaatgaagcaatgggttctgagatgtttctggtcacctacccactccctcctttaagcttgttcttctatacagagcatggggccccaaccccagctctgctgtctacagcactgccaagtgacccattgggctccatcttgaccaactgggcatcaagcggtgcaaaagcaaatccctctcaaagctgggagagtcacaccgtgggctactcctgcatgcagctgggtacatatctcctgggtcctatgacctgcctaaaaaaagtgagagagtggagagacagatccaggcagctcagtaactgctattactagaaaagcgtgactatgtctggccgggcgcggtggctcactcctgtaatcccagcactttgggaggccgaggcaggcagatcacaaggtcaagagatcaaggccatgctggccaacgtggcgaaacccgtctctactaaaaatacaaaaaaaatcagctgggcatggtggcgcacacatgtagtcccagctactcgggaggctgaggccagagaatcccttgaacctgggaggtggaggttgcagtgagccgagatcgcgccactgctccagcctggtgacagagcgagactccgtctcaaagaaaaaaaaaaaaaaagtgactatgtccgtaccaggttaatagaagatactcagtaaatattatcctcgctattacattatcataatcattactagctgtgaagcttttagcaatttacattaacccctcttagactcagtgtcctagtccataaaataaggttgacactactggaatgatctacgattgtcatggtgattacatgacaagataaatccatttaaatttctgggcaatttgctcattaagtgttagtaagacagagagataagtggttttctccttttgatgtgatgaaaatgagattataattatcttatagatgatggcacccatgtatttgccccacatttctactagcttcctgacaagctaggcttccccagcctcttcattctctgtatataaacagtcagcttagacctagtgctgatagaattccctttccagttctttcttataagttagaactacattcaaggctcattcctggccccctttttttccatcatgacaccttcaaatactcaagtccccactaatctctctctctctaccacataatttgacgatgatcaatttttcatttattctgttcattcaccttgttagcttattaactaattggtaaaccctttgaaaggtctatcttctcataaatcttagtacttactgcagcacctatcccagtgcctttcataaagtagaagctaaataaataactattgctggataaattaatgtaagttatctatgaagtcagccatcaatttttgtaaccaaaactggaggcaagctttagaagattgaatgtcatagttttagcactgtataaaacaaggtactgttttacgtgataaaatacaggatgaaaactcatttaaaatttagaaaagattagtttgaatccaggataaggtaagtaaaaaataattattttgaaggaagacctcacctcatactattcttgtgttaaaattatggatggtaaacttgccttcctaggaaatgtattgaggggggactcccacaaaaaggacatggccctcattaacccaaggtcatatttatgttctgatcataaatcagatcagatcaggtagcaaaagaatgtacacaatctgcatttcatttacaatcttactattttcagacaattgagacaaaatgtatcagttaaaaatatatatctcaataaatacttactgattgatatgtaaaacccagtaaaaaagatgacacatctttcctgacaattggcaaggattaatataatgagttctttatgccatagtttggtatatattttaaacattataattctttcaactataatctttatcaatgctattgaaccaagaataaaaggaatgtgaacatcaagtatgtgggtgatatggaatgggagtagaaattggcccgtgcctttatataaacctccttgtcttgatgttccagagactggcctccttagaggaggcctccttagaatttattaaattctaataaatattattatttagaaaaataaataccttctttcttagaaacatgtcaaggtagggtgctcacgtgacctaataaccttgcaaatgaatgtctataatgatagttttattattttctctttattattttaacacagaatgaatgctatttcaatatatcttcatcccttacccataaacacaaatatcccactgataataagatgtgagaaggaagtcttttaaattgatttttaaaacttaatttcttcaaataatatagtcttggggctcatcttagaggtccatgtggataggtcagaatctgtcaacattatgtctttttctcagcatttttcctaagggaagcatgctattttgtttcccttgtaattatttttgcttctttttcctgctagtgtactttaattttatttggaaatttgaggatggaaaattatgattatttagattttctaataatataaaacactttttgtgataaagactatgaattctctttgacacaaacatctgcctgtagttgaatgaagtattatttaggatagaatgtagtattcaacaggaaaagcaatttgtctaaaaaatgcttctttccttgctgcatttaccctcttgccagcttgatgtatctgcactgcctatttgttctttgttactgtcaagatagcaaatttctatctggagcagatggtgtaactgccattgttcaaatgcttcaaattcattctgctgctgggtatttttatcattaaacctctaatttagcaatattaataaattgtatctatggactattctgtctgggatgtctgaacatttgttaaatatctgaacataaaaatatatattcttttgatatcatgaaaattgtatcaaaatttatttgattatttcttaacagaaatcaatgtaaagatgtgttttattaatatgttcaaaggcatcattctctctctctatatatatatacacatatatgtgtgaatgtacacatatatatgtgtgtgtgtgtgcatgtatgtattctaagcagataaaactattgttttaaacacctagtgatcttacattttggagaggtagtaaaaaagtacgttaaatatatatgcatgtgtatatatatatatatatatagagagagagagagagagagagagatggtaggtaaatgctataaaattttagctattagtcattagttctataaatttattagttgtgtatgaatctataatagaaggtacttgtttcccttactacttcctccattacttatctcaatagaaatttaaataatcttgatgtgtgtcttcatactcttaaatagagagtttaaatttaaatctacttttaaattacaaatgtgggcctttttatctatacgttctaacagcatgcccccctcaccccatgtagaaagccatcatacttcatattttaccatcaggaaggaattagaaacaaggctaatttttttactctccaccatattttcaatactaaaatgattaaaactggagcaacaaacatttttcagttaactttatccttacagctttaaaaaacaagacaataagtgaaaatttgcagaaatattaataacttttaaacaaattatacttacatataagaattcagtaaatagaattctgcaacttatcatgatttttcagtgattattactttagaaattatttcattcactgtggtctgtaaattgtggccagccatggtggcttacacctgtaatcccagcacttcaggaggccgaggtgggcagatcacttgagctcaggagtttgagaccagcctgggcaatatggcaaaaccttgtctctaccaaaactacaaaaaattagaagggcacggtggcacatgcctgttgtcccaactactagggaggctgaggtgggaggatcccttgagcccgatgaggtagaggttgcggtgagccgagatcacattactgcattccagcctgagtgacagagtgagaccccatcttaaaaaaaaaatcagtaactaaatagaattctgcaacttatcattatttttcagtgattactgctttagaaataatttcattcagtgtaatctgtaaattgaaacaatatcccatagttggacaactgtacaatcagcaatgatcaattctaatttaacaaatgttgaacaaatcaacaactattagggtgactatatattctacttttcctaggacagtcacagtttatgcttattgcacatgtattaaatataatttttaactctcaaaagtgtccaatctggatgctaaattatatactcattctgatgcaccaaggtaaacctgtgttacatgctgatatatataaagaactataaacaaatgtcccttacctgaagaagcatacaaaacttattaatgatgcaagatatatacataaaattcttgccaaatgtgttttttattaaaagcttcaatttttggtatagccagtaaacactaaaaattcagagaagagatataaggatatggattagaatggttaaggctagtttaatggagttgctgtactaaaagacattgtgggcatgaagtcacatagttatggggatgaagacgaatatggtctacagcggatcaatcaacagtggaaatgactgaatataaagaagagtatgttaataagaataataggtaaggactcagaaattctggtctcttgtcctgctcttccactggctaactttgtatcattgagaaaattacttcttcattttgactttagtttcttgatttgtaaaatgagggattgaactggattcatccattcatcagtttttttatgatgagattactttgtgcaagacactccactaaggactatgtaaatgatttttcaagttcctttcctgctttaatttttatggtaatcacttttgtcaccaatacctccaatgatattgttgtagccagtttagaatcacgtgcttctctgtcaaagaagaatatttcttgcaggtaaatgttcccaaaccaacaaatatttgttgcattaagttgaattgaaacttttttcttgcaagtaccctttgtttcctaattggattagaaccatgttttcattccctgtgatggtaatgcaaccctagagtgataagtgactgccaggaaaagctggctttgtgtattttcagactgtgaatatagctgttatgttaacaggtaactgaggctgcagccaactcagctgggaagcatgaatgctgtgcaatggtttttttttttttttttgtccctgcttgcaaatgaaaccagtttcccatttgccctacctccccgatctaaagaatcttgctcttattcccagtgctaatcacctaacaggaaaggtcatgctccctggagtggagttatggtactgaacagcaaggaactctagcaactcaaagaagctgagttgtcttctgtgaatccagctgattcaaggctacaggcccacttcccagtgcaggttttcctattttgaagggagttggaaaagtaaccctaaaacatcagtatggattatacatcacttttgataatacacactgatgctcccttccactaactggataagttgaggatagatctagcctaaaaggaatctgatgagcaagagaaaattatttttacttctcaaatattcattctgtacttgaaaattgtggcatgataaatgtagctgtatatttatccataattaactctggagccttcttaatatatagtatatgcaaaatacaagatcaaatgcagatcatgtttaagttgatagctcattcttttatctttgtcacttgtcagaagtcagagacagatattgtgtgtgcctctacaggatatagttaaagccaggtggagtctacctctgactaatgtatgattttcacattgatattgatggtcatgaagctagcagtagggaattaaatggagagaactcaagactttatcaagacaagttgaatgaaaactaaaagtaggaaaaaataggagttataataaatgtttgatcataaatgagtgctacaaggaaagcaaataatcgtgagggtatttattttctccagattgcacttttacacacagaacacgttgtaaacgttgttaccaggggtttcctctcacttttggtgtggttagggattggcagggaaactgaagtcctttcaggaaaatattcatagtcagtaccgtttactaattttttaaaaaaataagtgaattttaagtgttaagaaatttctactagctttccacatagatctgttgacattttttaagtgtatttttttttcagaaatacataatcttgtaggtttaagcctgtaaatatacagaggcacttttaaaagtgttaaatcagagatatgaacaactgaaaactaaccaataggagctggaaatagagttgtaagcaaatggttgggaatctgtcttttcaaatatactgcatgagaaatataaatcagtctttgttttattctgccagtcatattagaatattctacaccctcaatctataaagcactcaaaactttgaaaacttctgactaaacaaggagaagtaggaagaggaaaagaaaaaagcatatggaattgcttgacaatgtgctgaaatattaagctgcagacatctctgactaagtgtatgtgtaaaataaagaccaaatttgaaagtagattatttattttgaaaatgagctcaattatttcagggtctagaagcaaacacaacgtaaacctctactcatcgtgtatgtgtgtcggtatgtgttagtgtttaattaccactgtggcaaaataagagcatgatccaaattctgtgcctcatcccagaactttcagagattattgacaccttacagagtcattgtaaaggatcaggtgcaggaaggaaaattaaaatgcaaactcacactgacgtgcagagtgagtaaccagtcttagaaaacctgaaaagccatgacattgagcaaggcaaactgggttttaaacaggcaatgggaaggcttcgttttttgcaattgaaaaaaaagcaaaattcgctaagggagagtgagtgtaaacctaaaagaaaggaagcttaattgagacctacaagatggtgggtatgtcttttttccctgaggagctatgaaacttttcagggacagaaataataagaaaatagatctgcatccattgtggttcagggtaactgactgggctctttgcctaactactaggcaactttgcttaatgtagaaagaaatgactcaggttaaacagaatgcttcgctgatttttccaaacaaacccacttaaagaatttcagaaacagggagtttcctctcagatgagctagtgaaaacctactcatgccccaaacaatgtagtaaacacaaattgagagcgagcaacaaaatagcccgagagttcaatataatgtggaaattcataatttagaaacaaagtctgtcatttttaataccttcaaacaggaatttaacaatgtctgtcactgtccatctttgaaatgcagaggtatgagatgttatataaccaagatctttaggttagcaagcatatagatcaaatatgttgtaaatggaatccttgtacaattttaaaccttcttaaagtgataatttgtaatatgtttttgaccattatgtaatacgtttatttatttatttatttatttatttatttattatttttttcttttattattatactttaagttttagggtacatgtgcacattgtgcaggttagttacatatgtatacatgtgacatgctggtgcactgcacccactagctcgtcatctagcattaggtatatctcccaatgctatccctcccccctccccccaccccaccacagtccccagagtgtgatattccccttcctgtgtccatgtgttctcattgttcaattcccacctatgagtgagaacatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggattggttccaagtctgttattgtgaataatgccgcaataaacatacatgtgcatgtgtcttgtaatacttttgtaggtttcagtaatattctacaagaagaatggataaccttaatgatctcgaatatttctggttttacttttgcttgagcagtttcataaatgaatattttacttggcacattatttttattattaaaagaaaaagggcttctcctattacaaaaagtagttctataaatattttgatcaaatttttaaactatgtgacaaaacaatgtgaaataaatatttcaaatgccatttattgatgagtaaattgtaaatattgctaaattccatttacaaattcttggaggaacttggtttttaaaggaaaacatcatgatcaatgtatggatgtgctcattaggagactcttggcctttttcagaaggttatactctgccatagtataaagaatcctggtgtgttcgggtgatattttcaatctaaaatctaggaggcaggtgctcacttgtcctcctccatgcttggaaaatgcagggaggaggccatagtggcaactgttaccatgattaatttcgttgggatagaagatggacccgctggttgtaatcaatgcattgaggactctcagatcagtgggactgtgaaattttaaactcctcaaggtagaacacagtggtaatgttttgaaatttaaagattttgaaatgcaagctacttttctcaggccatttcttctaaacaacacaacataatgtttaagccatgtgttgttcacagattataatgttgcagtgataaaatatatactccattggcaaaaataaacagcggtaaagggactgagattcttgatttttaactttgtatttaaccttgtgtaatgctgcctggaaaatttttgtaaaagtatgaatagatgtaagaagattaatatattattactgtattttacaatctttctgtccttgagtttgaagtatattacaggttaaggttaagccaggaagtaagattgctttatagaactttataactttcaaaattgacatttgaagaaattgtgctatactataatagtgaaataatagtaattacaaagtaaatataatcatcattgaaatataaattttcatacattttttgttcgacacatatttatataatacttaatatatgaaaggtattttccattcataatctatttatctttaatgataatcattttagcagtctaatactggaagtagtattttcttcaattgactgatgataacgaatcctcgaaccataaaaagtagaattggatattgtcagtctctacatctctacttaaatgtattttacattcactttaaatgaaaacaatgaaacacatatatctttaagagtgattaatgattagaaataatcaagggaggcttcttatatgacacggaatgctagttagaataaagtacacggctgggccattgggaagttgaacattaaagactttgccaatcacatcttatcatttgccacactgcaggtagagatttatccacattttgatcttataagactcaaatctcatagtacacaaaaggtgtgtgttacagagtgttttcaagctatgacataccacaatgaagcttgacagtaaatgtttaatggttggctcttttggtaacaaattgggcatatttttaaaattattgacattcatttttgcaatggcacaaacatcttttgaagacttactaaatacagggcactatgctaagtgtaatgaagacaaaagcagattctgtgcattcaagtagcttacagtctggggaatagagatttcttgaccttatttcaaaagtaggacctttctatcttatggatttgtgatacaacatctattttattgcgctgtttctccttgtttcgttctctttctttctttctttcttttccttccttccttcctgtccttccttccttcattctttccctccccctccctcctttctttctttccctccctccctttttctttcttttttctttctttccttctttctttctctctttccttctcctttctttctttcttcctttctttctttctttctttttttcttttcttttcttttcttttctttctttcatctgtgtatttcatcagtgtctacaccaggctgaagtgtagtagcacaatcgcagctcactataacctcgaactccctgtctcaagccatcctcctgcttctccttgtttcttaaacttgaataaaatgtttattcgtagtagattttctgctttagcagatgccactggattctgttgacatataaaattcacgaatagatgcatatattttctcttaaaactgttttctgcttttgcatagtccttatattttagaacatgaaatcatttacccctgtactctgttagaagctcttctgatatggtgacattgattagtatattctcatttaaaagtggagaaacagttctgtgaaatactgaacatggatttctgactagctctcatagtgagggttttcttttatgatttgattagttttcaaagtaaaaaaaaaatctatgtctttccagacttggctaggttcaagtggtcatccatataagatcaacaagggataagttgattttctttcaacacttgctttcaatattttacttttttcctcattaaaattcaaattgctctcaagagcagagaagtatgactacatttcccaacagataataatgaaaaatatcatcgagaaaagatgttatgccattttattttattttaagttccagggtacacgtgcaggatgtgcaggtttgttacataggtacacgtgtgccatggtgttttgctgcacctatcaccccatcacctaggtattaagcccagcacgcattagcatttcatcttgatgctctccctccccttacccccactccccggcaaaaagccccagtgtgtgttgttcccctccctgtgtccacgttttctcactgttcagctcccacttacaagcgagaacatgtggtgtttcattttctgttcccatgttactttgctgaagataatggcttccagctccatccatgcctctgcaaagaacatgatcttgttcctttttatggctgcacagtattccatggtgtatatgtaccacattttctttatccagtctatcattgatgggcatttgggttgattccatgtctttgctattgtgaataatgctacagtgaacatacgtaagcatgtatcttgataacagaatgatttatatttctttgggtatatacccaataatgggattgctagatcaaatggtattttgttatgccattttatcaggatgtggtcttcattcaggcagtaataaaataaagtacattaatttttatacatttttggaaatatcaaggctacatcttcatagcttaattcctattactgtgccttatatgaaaaaatatgcaatctaagaggagggaattgccataaattaaaactttgagtgtttaattaatactatgtgataccatcatatagaaagtttaaaaaacttaagcaaatattttattttgaagcttaggaatatacaagttagtatcttatatgtaacacgggtagatgccagtcagattaataagtgagacatttatttatgtttttattcattttttgatgtatttacttaggctttaggtgttgttgcttggcttttgttttgtttgtagggctgctgtacctgaatgataacatttttctagcttctgagtttgtttagaaaaatgtgtgatcttgtaatttagggcagtggattgtaattttttatagaaattagtttttaacaaattagttttttatagaaagatttcttggactgattatgaattttcagtttacaactgacacacataattgttttcttgttaacaataagctttagcccccaatgattttataattatcttccaacattttgcatattggtgttattgatgagtaaatcaagaaaaaaattcagcaatgaattttgcacaatagaatcaattttctacaaaaataacttgaaaataggagacatgatttttaaaaaggagaaacaatggtattattagtgaattaaatgtgaactttgtgatatcagattatttttgctgttttgggggttcacactttcattctatgtaagtgaagttcctagataaatgagtctttgcagattacagagcattcaaaatatattaggttggtgcaaaagtaattgctgtctttgccattactttttttttttgcaccaacataatatatgtcttattgtttgcaagagccatgaaatctaggttattgatttgtgtcttaggggaaatgggagtagcaatattgattactttgtaatctttattttgtcttctttaatatatatgttagtgtttttaatgcaaacttcttattgccataaagctttatcagccttcacatactatttatgactatgttggctttttttcaagtgaaaatatgaaccacagttaaattggatgatttaacctgggcagtatggggatagtaacagggtgggaaagagtctttgagctttgactttgtgtcctgtctggaaaatccaaattaatccgttttaacaggattaagctctcagtgtgaaagtactttgctaggaaattatcaaagcacaagttaattagaacacagagctccttgcatgggctgacagttattaattacatgttcttgggctggcttaatttcaggcaatttactgctgaaagtagtagaaacaaaaagtttctcttagtttttagtcttgtagagaaaaaacaatccctcaaactaccaactgcgaaataactgctgtataaggtataaagaagacatattttagatttaagttcttcagccagtgtttttggtcattttattcccttcactataaatgtgaattctaagtgcagttagtggaacaatttgggaacttgtgtgtttgcctaagtaaatagagtgttcaaagattgatgtagctactggtagataagtgtgagtttgccttgttttaggattagatacatttctgagaagggctgcgcacggtggctcatgcttgtaatcccagctctttgggaggcggaggcaggcgggtcacttgaggtcaggagttcgagaccagcctggccaacatggtgaaaccccatttctactaaaaatacaaacaaaattagtctggcatggtggcgcacacctgtaatcctagctactcaggaggctgaggcaggagaatcgcttgagctggggaggtggaggttgcaatgagtagagattgctccactgcagcctgggtggcagagtaagggagactccatctaaaataaataaataaataaataaataaatatatatatatatatatatatatatatatatatttctgagaagttctatgtaactatactttttttagtcatattgtaagtgcatgggaaattatttaatgagctttatgagcctcggaggttcacatcatgggattactagaaccattgcattgttcccttttaattttttctcctcatacttaaataaaattataatcttattcttaaaaattagattggtcttacctctttatggtttatcgagttggcatatcacctacttatgggatctgaacgttttggtgcttgagcctctgttgagtattacatgcctctgctaataaactaagtactgctagaggcaattattttgaggtaattattttctcaaaattgaaagtattaatgattggtggtatcatactgtggaaaataaatgaaaagtgagagcatagtaattaagttcttagttcttaatgctgagtttcttaattatggtttgtccatgtcatgatgtaagtggctgaggatgtcagggtattgcccagacatacaatgaaaagatgagtcaacagagaatgagggctcaaaaaatcaccaaagtgcattctctataaaaagcaggtggagagaaaggaatataacatttttcaggaagggattatgggcaactggaaggaaaagacacatgaaaacaatccaaaacacaagaaaaggcagcatttcatacctctattgtttgagggcagggggcagacagaatttctgagctgatggcagtaatccctattctactgagtactataaagccacttagctacaaaagagagagaatgaagtataaggaagctaaaaaaaatacgtaacattgaaaaagatgtataagtatcaagttgtgacaggaatgtaaaatatagaagaaaattgctatattaaggctcacataaggaaaaaaaagtgcctcaagaaaacagcatgaaaagatagatttatgcaggaggaattaaggaatatgagaaaatgtagtggacatgcctgaaacacagacatcagtttccctgggtagaggagggagtgattgatgggggaagtggaagaaggagagagagagagaacgtaataataaaaaaaatgagtaaatgacaaaaaattagggaagcaaactgccccagttgaaaactgatttccagaagcataaaggataaagttaaagggagaatttaagaatttagagtttaaggggaatcttggataattaattaaaatcaggcaactatgagcaacataattgaaagtaggtacatgcactgtgtgtttagtataagaatgcaaaaggcaagttgataaaaatgcaaaagattgtggtgatttatgcaagttcagggcaataaataagaaaaagacatttttatgaaaaaagataagatatggaccttttctgaatgatctttatcaatcattagataggatcattattctgaaacaagcattaaaaagttgttaaaatataagaaatctaggaaggttgatggatgattatgaataaaatggaaaaccggaaaagagaaaattagatttgtgaatattatgcaccacaagagatgagattgcctcttttctatgtgcaatcaaaaggtctaaggatttttgtacttgaacttaaaagaatttatgcacattatttatgttttcagattagctacagtatatcttaaaaccattatgggagtaaatattgagtagattaattaaagttttatatcaattcagataaatactttaaaggtttaatttattgacaaatatcatttgaaattaggtaaaatcatctaggttattaaaattatttaaagcatatttagatttttgtgatattcttagagacatctgtgatttgaccatatggctgatcattctatttttagtgcataccacagatctgttaataaaggctaaattgtctttaattttaggttcagacctatgataaatataaattaaccttacaattttttcctaatccatagaataaattttaaattgttaaaaatcacaacattatttttccttaaaaggaaaatacctctgtctttttatccagaagtacaaattttctaagatatatatgttgctaacagttgtgaggtaatatttcactctgcttttaattgcatttccttgatgattcgtgaggaacattttttcataacccttttggccatttgtatttcttcttttgagaaatgtctatgcaaatattttctcccactctgtggggtgtctcttcactctgttaatgtgcagaaactttttagtttgatgcaatctcatttgtctatttttgcttttgttgcctgtgcttttggggtcatatctaaaaaatcattgctgagacttttcccatatgttttcttccagtagttttacagtttcaagtcttacatgcaagtctttaatcgcctttaagttgatttttgtatttgatgtgaaagataagggtataatttcattacacattaattcgcatttctctggtgattagagatgatgaacattttttttcatatatctgttggccattcatatgtcttcttttgagaactatctatacaggtcatttgcccatttcattactgcatgatctcacttatatgtggaacctgaacaagtcaaactcatagaaatagagagtataatggtggttcccagaggcctgagtggggaggaaggtgaacggggaaagaacagttgttggtcgaagagtaaaaagtttcacctaggaggaatgggttctaagaatcttattgcacagcatgaggactatagttaataataatgtaatgtatatttcaaaatagctaaaagaatggattttaaatgttctccctacaaaaaaatgataagtatttgaggttctggctatactaattagcctgatatgatcattccacaatgtatacaagtatcaaaacatcacattgtatcccataaatgcatacaattattatttgtcaattaaaaataaaacttaaaaaataatttgacaacatgctttgatttacattttccagcatgaaaaatggtctttacatccaattttaaaatcacccttttaattttcctcaacttcaaatatgtataggtagtttgcttagcactgttcacttctctgtttactatatgcctactgtgggccagacactgtggcaggtgttaggaacccaaaaaagaatgttgtaatatttgttaattaattgctcctagccttgtagaggagagagatgtgcagacaaataattaaaacaaaatcgtatgaatgtaatgttagaaataagcatgaggtatacaagtaagctagaggaagaaatggttggcactatcagtgcaggcttcacagagagcatgatatctagcaggactctgtgtaatgactatgagatggccaagcataaaaagaggtcagagacattgcaggcagaggacatagcatgtgccaaaacagagatgtgtggaaacagtacagtctgtattttgctattgctattataggggagcagaaatatcatcacccatcctgtgttaatggctgtactccctgtaagaaaagacagattaataagagaaaagcatacaaatttatttaatataagtttaaaataacatgggaaacatcataaagaaacgaagacccaaataaataagtaaacctttttatttttagtgctaggtttggtgcaaaagtggatagtagtggagaagtatgattggataaaaaagtatgatctaatgtaataaaacttgagggaacttaacaaggcctatttgttcagattcccctctgtgactctgtattttcagagataagaatgttcctttcttttgggtatagggagtgcagttctcaaatgaagatcttatgacttgcttcagaggagaagggtgaggggaaagtgagaatgaccttcctgcttctgctgttttcttaaatgtcaaggtgccatgttttggaataacacgtcctggtctccatcattattgtactactacggtcttctagaaacttcctttttccattaaaagttatacaggtccaggcaccgtgactcacctctgtaatcccagcactttgggaggccgaggagggaagattgcttgagcccaggtgtttaagaccagcctaggcaacataatgaaaccccatctccacaaacaatacaaaaattagccaggcatggtggcatgtccctttaatcccagctactcaggaagctgaggtaggaggactgcttgagcccaacaggttgaggccgcagtgagccatgattgtgccactgcgctccaacctggcaacagagtgagaccttgtctcaaaaaagaaagttatgcaaattgacagattgttggtgtcatcatcattattgcttagtctgtgttaggctctagtactttaaatagtttactcccgtatatctcaatatatgtcatttttagctttaggcaaatgttcagagacatgagtgctatattagctcaggaaaattttagaagtctgtcccttaacaaatatttcaaaatcccccttttctgtattggagtatggaaactaacatgtaccaaaagtttacttttgtgataatttattgattgcctactgtacgctacatacggatactttaacgtcaacagatcttggctccaagagaacagcagtacataaatttagattcaggctttattttctcccttttgcccccaattatttcatgttttaagtattttccacatatgatcatgacaattatagtactaaatctatagtgtctaatacacttttcaagcacttgggaggattctatatttttatttgtcaaattcagcttttctcaatactatttaaatgttattcagaagatattaatagttgggagcagattttgttacatttgcctcttggctgttaatacaaacagtagtttttatttttgtgcttttttcttgatgattaattattttgataattcccaatacaatatggtacagcaggctttctttcagtacaaagaaacacagtgtttatcctactgtaaacactgttaatgcagttttctctgaagaatgctttgtgtcttctgaattgggggacaccagcaaggcttttagccataggaacataagaaattcttgtggtcacagagcaaaggtaatctttcatcttttctgtgttatttttatttttatttatttttgttgttgttgtttgtttgttttttaattttttgatggagtcttgctctgtcgcccaggctggagtgaagtggcgtgatctcggctcactgcaacctctgcctcccaggttcaagcaattctcctggctcagactcctgagtagctgggattacaggcacgcatcaccacgactggctaattttgtatttttagtagagatggggtttcaccatgttggccaggctggtaacgaactcctgacctcaagtgatccgcctgccttggcctccgaaagtgctggaattacaggtgtgagccaccgtgcccggccttttctctggttttgaagatttgtgtagcatcaccattcagtcatttctaactgaacaacaggtgaggagtaggaaacatagtttcatccgtatacagaattttgcctgacttcctatgaaacagaaatagcatgagcttgacgtttctgtctattttgacagatctggagaatgaacacaaagtggatagcataaatctctaatttgactacatttaatgtctaagtcattactttattgcaaagtaccatatgaatgaaaattaatgtttactaaacagatgaaaggaaaattcccaagtccaatttgcagatcatatagatggtaaaagaggccccagtttaatgtattaagaggattcagaaatcattctgaatatcagttgtttagttgattttaacacatcattccatgcttaagactgttcaatgcctttctatctaaactccttatcattgcatacaacatgttaataatatggtcctagggttttctccctaatctcagtctttagaaatcattttgtcacagtggttcacactcaccttaaagtcatttgtacttggtgttctctctggaacactagttttccatttcttcaaatgactagatcatcctcattcttcaagtctcatgtcatatgtgactgcttggaagagttccatcctgatcatgccatccaaactactcactcccatttcttgtgttgatctgttttatctttcacagcattattactgtatacaattttcttctttatttgttctcttctttattatctccctctttctgccccatattgtaaactcccttgtagacagttcctcatctgtcttgttcagtttgctttctattgaagtaagaataataagtaatcaaaatagctaccatccagctgctctattgaatcttaaatctagtcagggctgtcgaattgaacagtgaggtagaggctcttggaaagatttcaaagacacagtaagatgatgaaaagattagaaaataaaacctatgaagaggagaaaatggtgacatgggttgcagtattaactaccccagaataataatccattatatttgctcacttcttgcagtttacagaacacttttgcatgtatgaactccgttagtattttacatgatatctacatttatgattatccctgttttacaggcatagaaacggaggctaggggaatttaactgacttgttcaaagacagatagttataagttattatttatgttttctcagttctaaggccaatattttttccatgacactacttttggtttagtcttcaaagcaaataatttaatttggatgtgatgaacaaagatgtttaatattagggattataaattctgataagttatcccagttgttcccagataaatttggaattccttttgaatagatattcatctgtctggtatggtttggaagagggtagagggtatggctagagggtaagagactacttagatattgtctcttcaagctttaaaatcctataatcttttggctaagtttttgactttcaaaattaatcatttcaaatttacttaacatttaaaatttgatcaaatgataccaccctttgagccttctatcacaactggacttggctctaggatgtgctcattgcatgggctgtgtatagtattattcaatacccagagcatgcagtgtgaacataatagagattgaaagacagccagaagggtaaaacatgaattcttaaagagtaattttgtacttcatgtagatttttttaactctccattttcagctgtttactaactatgcttccaaattctattccacaactgaaattttaaactcacaacttaaatttgcatgttgcttctattataatacattttttattcctcttttatttacattaaaaatttactgaaatttcacatgaatagtcaaagttagctttcagtagcagttagaagcattcttttaatagaactataaaaatacatttggaagaacattattatgatctttcatcatgttgaaatttcttttgatgacacatcagatgctatttacagatgataattgaaatctccatagtataattttacctcatgatgatatcagtgaacatatcatcttgtgatcagctaactggatgtttctttaacccatttatttaaaatttcacataatttccaggtgttttcttttataatgagaatctgttacttcaacaattctaagtagatcatatgtctttgatttgaaataggaaaaaaaatttcctagactgttagaatgattttgtttggttggaaagctgcgtgatctctgcatataattccaagtataaaatgtacttgatgcagtcctgactatattccttataattagaaaatttatttttattttttgcgtctccttgcttgtatcaggaaccaaaactaaacttagtcacctaatagccaaatatttagaagtacttgttaagaggcctagtccaaaacatgaataagaaatgttataagtggaagaaaaataacagaagttcacttaagtgagaatataaatggaatagaggtgggaaatggatttatatagaaagaaacattttaatacatgctgattagaaatattgcggcattttctgaaatattatcaaactgaaaattatggtctaatagttttaaagaaaatatcataacatattcaacacattgtgtttctccatgcctggcatatagcaggtcctcaataagtatttgttgaaagaataaataaaccaacaagtcttatttgagcacctgttatgtggaggatacaatcctacgacccagacagaccttatgatctagtatgggagagaagaaatataaggagaatgcacaagtgatcgccatatctgaaagtctgtgataagaattaaagaattggaaaaggttagaggaaggccagattatttctcatctgggaaacttttggggagaaaagaggacttgagcttgggatttagtaagaatcaagtgcacaaaagtatttattgtagaaatttgagcgaatatataaatattattaaatcattattattataagacagtcaataaactaaaacaagaattatatcatcaataaatcttgttataatcatccattcttaacttcatttgcacattacattgatataatatgaaatagtctaggttcctgcaagcctctttgtcacttagctttttttttctttactacgttatataatttataggcagcatatccaaaatgtttcagtaattactctgcccatcattttattctttgggttaaatttctagcctaagttattaaaaattaatttaaataatgaaaataacttcagttatgtctaatttaaaaattcctattaaatatgtcaaataatagtttatttatttttaacctttttcttcctgagaagatcaaagatcttagcatatttctttctatttcctcctaggacatctttgtgaggagtagttggtatcaggaaaagttaatttcatcaggttagggagagtgttaggagaaaagcaaactgattgtcccacccaaaatatttatgcctgtcttgtaagtgatatgcagatcactttgactctaagctagttttctcatccccttttcatgcaacttgcttcttactgactttgccatttatcagacagaaccttattatgtgcattctcctcctattttccctcctctccctcctgtttctccttgttcatctttcttctttattaagtgtacaaggattatgcaggctttgttcaccattctatatctagctacaaacactttctatagggttgaattggaatccatataaatgtttgctgaataaagtaatagccacccgctttggaaaagtcagcccatttaaatatactaatctaagaaaatcagtataggaagattaatctgacttctgaatgtacatagtgcatactaaaataaaatgtggtcagcttttattttattcactcttttgcaatatttctgctactacgctgcagaaccttgtctgtctcatactccttcagcacttattaggtgtgtaatcttgagccagtgaattaaccttcctgagcctttagatataatacgagactaataatatcttgtctatctgaagacagtaaaatggattagaaagtctattgatccaacttatgataaatgaagatgtgaataaaatttttaaaaattgatttatgaaaattatactgttttctgctctttgcttattagttactgtaactaattcctcatgagattccaaaaccccttaacttaaaaaacaataaaataatagatgtatgtgtgtatatgtgtatatatgtatatatactcatatatatataacatatatatcatatatataattttttcgctaaaaactcatggtacctacctagtaatggtgattattatcatcagttagaagtgtgtaattcatgaaatttctaaaaacaaattcaaatcaaaagctttggtatgcatatttaatgatatattttgaagagttaaagcttacgtaaccatcaccagtgtcctttcaattgccataattgtagaataattttttattggttggctgtttttcttttttttttactggcactgaaactttaccccacattgttcttttattcattaactaaagttgtaccctaatacttggttctgtactaggagctgcagatacagcaatgaataagacacaatccctcccttcaaagagataacattttattgggagaagtaggcaatagagcagacaattaatatactgtgttgaagtgctatagcaagaatgagctcaggatacattgtgaacacatgaaagttctccgaacccagctagaaggtagaggagtcagtcagggaaagcttcctagaggaggtgatgtcagtattgtatttctcctgcctatacatgtccttcccaaggaggttgaaatgcaaattatttaaacatttagtatctaagtgagatatacagtaaaaatttatcatttggttatactggctacttaatgtttagtactaaatgaaactacaaaacacattaccaggactagaggtggggtagaaaagaaaaaaaaaaaaagccataccaagaatgaagaggcagttttcacaaacctgccaagtaaagaataaggtatgattaggaatcagatgcttactagtagacttcctggagactaagaatcagaaggctgaatggaatttaggtgacaatgctgaagatttttctaagagggtgatgtatttaggttaagtaacaaacatgacagttaatttgagttgtgtgctttaggttgttcatagaactgagaaactgggatcagaccaagttaccatggcactatttctgttttaaatggtctggtaaaccacctgtctaatctattaatcaaaatgtgctgatatgttgtagtgattaccttattatctattcctaataatactcctacaatgtgttttcagcccatattggagtatggctaatgcactatgttaatattcttttgctagatatgttcattttaaagttgtcaattactttttgttgttcctcaagttcttgtgtatttttggcacatgccatttaagtgtatttttttactatattttatgaaaataattttacagctacctcatgtatcagcccaaaatgttagtaaatgacttgtcttcctacaactctggatgagatatatctatatctgccttttaggggctggtggggctacacactgtagaattcttttctacctcttaaattccattggcttgattggattccttcggaacatattataccttcttgagttttgtgtaaaactctacccttctgattttacctgttaattaagtttacaagaatgacttgctgaatcatggcacatttattttgattattcccatcctggctttcttcatatttccattatcatttcaaatatgcatttaatttttgcttgcatggtaatttcagccaacttaccttcatttaggtcagtttgtacaagaaaattaattatcttattgtttcatccactggattgatttctgctactgtatatacaagccaatagtttgttcttttcttttggtgccttctgtaaaactggggaccattgtcaattaattgatggctcacagatttctttctgacctctattaccttttctgaacttcttgtatcacagaatcacctatcattttattgtgttcactttgttggcttagatgatttattgtctcactactaattatataactagggaaattagagatggaaagattaatgtaatcttccaacttctttttgtgctgtctgcacttatatttttcttagagtattgcttcaacatgaagaaaaagaatgctcatttaatcacccatccatccaatttttaatttattttttaactctcagtacaatacttcacacaaagttggttacaaatgaacgaatatatcaatttgtttcttaatgcaataaaagtcctgctttcaaggagtcaggttctgcttttgctttacctataactctctatagtctaaaaaggaaggagaaatggagtgagaaacagaaatagagagtttttaatccagagagacagagagtctttttaaatgcagtattgcttagaaagagcttactaaggtaaactcaagtctcaggtaatttttttttctggaataggttttattttgtgcaaaaattgtcaaatataaaagtagtttatgtctgaatttgccatcgattatcatagactttacacagaaaccttctcatggaagatgaatgaatttttctgaaatcacttttaaatgtagccaatttgtatcagatcctataacatgaatgttaacactgaagatttcatttcacttcaatcttagccaaaagacatattgacctagaaaaggacatatgtgaaaaaaaaactaaaaatattaaatatgcttgcatcatgtctaacttggcaaagcaaatgtataatttatcttagaaataaatattatataacagagtaataaataatgtttacagtgggaagcagtcttatcttcaaaaacaacttttctagttgtgattataaaacaatcttgcaaataaagaagtgcagctcaatgaaatgtaaaagcatgccacttcaacataatttagctagttgctttatcttgacacatttcttgattttcatgatattagtgtaaaatataaatattttcatacattttccataacccgattgctctttctttccaaaataatgatgaaatggaacaagaaaaaattgtctcccagcaaatatttagacatgtgacattttgtgtttttaaaggtcattgatattttagggtatttatcttaactacttaatatttttaattgcttgaattgccttcagaaggtgactacttttctatttggttgcatacatggaacccacaataataatatgtatgaaaattttcctctttataaataattcatgcaaattcaacaatacaccctgaaaagtaaatatttatcacctgcgtgtaatatggaaaacatttagtgttattaagaagtaaccgattgcaatgaatagaagaaatctgttttaatgtggtaagtctacctcccttaagatacagtttgtctagggcagctgtgaatttgttcctatacttcatggcccacctaatcaaattcttcaagagaggtaattatctttttattctcatttttttatatatattttttattatgctttaagttttagggtacttgtgcacaacgtgcaggttagttacatatgtattattctcatttttttaaggttcacaacttccatgatggaaatagattattagtaactataactcctgaagaacaagccaatattttgttgttgttgtttttctgtgtcttctgtaaaactattaatctcggtcaattaatttatggtttgggaggcagtcagtcatgtcatgaagacctaatctatctagaataaaaaaacaagatgcccaggcttaaaatttctttgttacaatataatagcatttctgtaaatagtaattttatttttagaggaagagtaaaacaattttttttgtttgtttgtttgttttggtttctccatgatccttgcattagattttacatttaatttaacttattttaatttttatctacatttgctcttgttaataaatacttttaaacaagtacaacaaataaaattccagaattgatcacttttattattgcaaaagataatctttcatcttgaatatttatgaattatcatattcccttctaacaaggatagcaatgacagtttctaatcctaaatgactgatacaattaattaacctgtgaaatataaaatgctaaaggaacaagtcaagagaatatatagaagtatgaaatccaaactaaaattgtttttatcttttagtttggaaatatacaggaaattgctgagttctgtctctatcaccagatagccaaagtagaattttagtatgtgctcatggaatggtgggtggatcgatgaagattatcaggaatattggagggtttctattttatctcttgtggtatggcataaatggtgaagcattaaggtatgaaaatgtctaccttgtactctcccatagtaaatatgataagctatgaaatcttgaagtggaaatatccacaactctacagaaatataaataattgaataagcagataaaggggggagaggagggataactctgccatacagaaaaattccagtttataaatgtggacacaattagggaaatacaaaatcatcatcaggcaaacacacagtaaccattgttgtttcaggccaagtccactaatatgtgctaaaataaggggggcaaaagttttaggataaacagggtattaacatagtttcaaaatatctccctcaagttatctatttggttactgtattagtttgttctcatgctgctaataaagacaaacccaagactgggtaatttataaaggagagaggtttaattgactcagttccacatggctggggaggcctcaggaaacttacaatcatggtggaaagggaagcaaacatgtccttcttcacgtgctggcaggagagagaagtgcagagcgaaaaggggaaaagccccttaaaaaactatcagatcttgtgagaactcactcactatcacgagaacagcaacatgggggtaactacccctatgattcagttacctcccaccggatccctcccacaacacagggattatgggaactacaattcaagatgagatttgggtagggatacagacaaaccatatcaattacaaagaggctaatgtagcatcatagaagaataatcagcagacttcactttaaccaagtaatcaaggttataacatagtgacagtttttatgctcatcccatctcctcaccatcatataatgcattgagaagaacacagcatcacttctgtagtattcttgcccctgcaaaaaagaataacttcagtctaatcatcagacaaacccaaactgaaacattatacaaaataattggccagtactcattaaaaaatcaaggttatgaaatacaagggaaggctgccaaactgtcaaacgttggaagagattaaggagaaacaacaactaactacaatataggacagctatatacaatatagtcaacattcaggagaaacaacaactaaatacaatatagtcaatatattgtaatatattgactagaaatataatataggatcctggaatgaatactggactagaaaaaaaactgatgaaattcaagtgaggtttatagtttagttgatagttatcttccaatgataatttcctcattttgatcatttgtttatgattatataagatacttggggaactgagtgaagagtgtacaggtactctccaccatttttacaatttttctctaagtccaaaattattttaaaataagaagtaaataagcaaacaaacaaaaaggcagaaatactgtctgcaccttccatgacacaggctttatcaagtgatatgatgaatttggatgttatatagataagaagtgaatttacacatgtagtaaaatcggtgtatctatttaatggactttttaaccacatgtcggtatctttaacgccacagatatacagtgagatcataataaccagtatgtcagcttgaagaataggaacatatagttttatcttctaagattcaaattattattcatgatttgtttaaagcaaatcaaggctgagtttgtaactctggaatttttaacttacagattctcttactcattcctgtcttccaaacataaaacatttttatttccctgtcaattcattattaggagaaacaagaatcttgaaaaagtctttcctatgcatccagcaataaatgtattctactccaccatggactgtttattgactttattacaagtccattatctgttttcatttttacttctccaaaattgctaattagaacacaacacaaccatttgcatccatagaaactttgcgtttacacgattatctctaaatggtattatttccattgagttgtatttctttgtgactttccaatccatattttactaattcattttgtgcataaaattgcacatgatttttaaattactattactacattttactttattttaaacttaacctttaatattgcacactgagaatccttataatagatttgaagtacaatgccctttttaggatttctatgtgtttgaaattacatgtatcagtgaataaggtatactgtcaaatacttaataccttaagaagtcattaatgttaccaaattatagtgaatggtgctatattatattttgaacgtttgtggcctctaaaccggtagcaagtctcttttagataattttgtaaaccccaaagttgtgtattctatttaagattatttatacactcatgtattgattgagatatctctgcaaatatggttcatttaggatggatcttgttagttattagaagttaatagtcaaataagtattcccctcccctaagcttccaggctaactcatgtctccctaactttggccacaggcccaagcaagcatctatttttaaagtgaccctggaagtatgtttcttgccttcggaagtagagtgatgcattatctggtttgagtggaaaagttggccgggcgcggtggcccacgcctgtaatcccagcactttgggaggccgagaagggtggatcacaaggtcaggagatcgagaccatcctggctaacacagtgaaaccccgtctctactaaaaataccgccgtggtggtgggcgcctctagtcccagctactcgggaggctgaggccacgtaaatacacaataattgttttgctaattagtttgaacactatgaatgaatttgtaaaaaaaaaaaacctataatatccaataaaccattccaaaaaggaacacgttttaagggaaatgattgtatatatgttatgaggtaaaatttatttttactccagaatgtcagctagtaatgacacctggctaattttcgtatttttagtagagatggggtttcaccatgttggccaggctggtctcaaactcctgacctcaagtgatccacctgcgtcagcctcccaaagtgctgggattacagccctgagccaccgtgcctggcctggaaatctataaataattattttggcacctatccatctgcattctgacctccttttggcgtccagagatctcaaatccttgagcatttcagggaccactactgtgtaatacccaactgtggttttgttcttgactttcatttaaatctgccatgaaaacacacataacaagcaagtcttacgtttcctaggtcccactattttaaggtttaatttgcaaattaacttccaaagctatattattctacttgttagccctttcaaatagaatcttgctgccaactggttagccatttcaaagtctttaaacatgtgcaatacatttgtatgtattacacagtcaatatgttatttcattctacattgattgctctctattggcaattgtctttttatttggggctaaaacaaatgctgaagtaaaataatggcagagtttttcaatattcggtaggaatacaaaatgaaaaggctgccttttttaaataaccaatcgcttaagtacttcatgtaatacttcttaatttcacacttataagagaatgtttatacaggtatagggttactgaatatttcacttaatttttttataatgatattattattataaaattacatggtgtttcttttactggaagaaactataaaattcagtaaactcctctaaacttcaggtaatttctttcatatgcaaatacattcacaactttaaatctatttgaagtaatttagttctacagtatgttgtgtttctctgtttacctaccaacacacacacaccaagatgcagatcacaaacacagaaaaagaaattgttcccttgatttaggacttgaaatataatcaagccttaagatgaataaattatttgaaaatatcctctaggtatttgcacatataatatatcccaagggttttacaatacaatgaaatatactttttttctaaatgactgtgcagacacatgcagaatccattatgcattaaagggaccaataacttctcctttcactgataataattcatgtagtgttataaacaatgctaatcttgccaggagatggcttcttattcattttgaaattatcagtgaatcagacaatatatctatttcatgttgtaaataaatgaggaaacatagagtaaggggaaaaataatcctaaaataaaatgtatacaatagtattgcccttgattttaaagtacttgtgtaagtaacagaaaatcatgatgtctaatgtaaatgtcccaagttttagaagagtggctaaatccattgacagagtactcaatgctgtataacagagaaagaaataggtgtatttaggtgtattattgtaaacaggtgtatttttataagtaacgtgctaatcatggatttgcttgatggaatctattccaaagaacccaacttagttcttgaagtgccataggtctcaccttcccaattagattgtaagctctccttcatcaactattacctctttttttttgtttgtttgtatctcccatagtacctagaactgtactgattcttaatcagtagtcaacaattgcctatagaacctaatgaaatacttagtgtattcgttccagcaacatgttcagcactgtttcattgaggagaggggataataagcaggatggtatgataggaaatatgcattgacctggatttttaaatgaaaaatgaaataaattaaaatattaaaacttaaatgttaaaaatctctatataggattatagtcacatgacttatgaagctttgagcaaaaatatgccaagaaggaaatcataactaactggcatttattcttgcaaagtaaaaaattaaaaagctttcaaacaaacaaaaaccaaatacacacttgataaaaattatttttatctccctataaaggtttttgttttacttttgtttttggtggattgattttatatgatgctaagagctctgaaacagcagggctgttttccaaatttagcccccactaagtgagggaaatgcatttccaactctatgtttgcttttaattatttatttaccaggttgccctttctccagaggtagtaaatccacttaccttttatgcatttttgtctcttgaactgaaagtataggtaggatctttgtctcagcaagaagaggaaatagactagactgcgggggtgagggcagtgcaggcaatctcgtaatgtgttaatagtaaccagcaggaataattctgactagatcatttccactaaatagtttagtttgtgaagaagactgacaggatcatttccactaaatagtttagtttgtgaagaagactgacaggagtgaaggctcagaagattatttggaaaagaccagtgctttgcatctggtgaaagtcccagcaaatcatggtatcagtgaggactatactaggtgtctctttttccatctgacatatacccgtgcaaagttttaagattcagcagtaaagcttttattctcctaccacaatcactatggctgccactggttgtgaaaatcacctcattttattgtttttttcttcaacttttatttttaagctctagggtacatgtgcaggatttgcaagtttgttacatatgcaaatatgtgctatggtggtttgccgcatagatcaacccatcacctaggtattaagcccagcatgcactagctattcttcctgatgctttccctcctccttccccacctccagactccagtgtgtgttgtttccacccatgtgtccatgtgttctcatctttcagctcccacttataagtgagaacatgcagtgttttggttttctgtatctgcattagtttgctgaggataacggcttcaagctccatccatgtccctgccaagaacatgatctcattcctttttatggcttcatagtattccatggtgtctatgtaccacatttgctttatctagtctatcattgacgggcatttatgttgattccatgtctttgctattatggatagtgctacagcagacatatgtgtgcatgtgtctttataatagaacaatctgtattcatttgggtatatacccagtaatgggattgctgggccaaaggggatttctgtccctaggcctttgaggaattgccacactgtcttccacaatgactgaactaattaacattcccaccagcagaatcactttatccaagtgcttcaagctgttctgtaacttaaggtggaattttcgacaatgtcaaaattactcagtttcatactgttgatgttcatgtaaatttttggttaattttttaacagcttgtttgagatatcaaaagacagaattataactaatttagttctagatctaattgactttccttctcattcatgtatcgcaaatagaacaagcactcccactgtgcaatggcagaacagtgagtttcataagggggtacaaggtaacagaacaatagaaaaaaaactgattggttaacgtcagcttgcttcaggttacttttttttggtaagggtttaagcagaggagacctccttattacactgactcaggtaggattggaagtatcctgttttcaggaaaaactgatctgtttcaggatctgtctgcttccttagagtttcagtttgattatttggcctttggcatgattgcctccatttttgttcgatctgctctttagggccaactgtagtagctaaatccaaaacaatggactggcataatttttgtttaacagagttataatttaaatacagttggcccttgaacaacgtgggtgttcagggtaatgaaccctgtgcagttgaaaatctgcatataacttttgacatcacaaaaccttaactactaatagcctattgtgaagagttactgatattataaacagttgattaacaaatgttttctatgttatatgtattatgtactggattcttacaataaagtaagctagggaaaagaaaatgttattaagaaaatcataaggaaaagaaaatatatttgctattcattaagtggaagtggatcgtcataaaggtcttcattctcatcatcttttcattgagtgggctgaggaggaggaggaagagaaggagttggtctcgctgtctcaggggtggcagaggtagaaacagtggaggaagtggaaggggaggcaggaacacttggtgtaactttttctgaaacaaaatctgtgcataagtggacttgagcagttcaaacccatgttattcaaggatcaactgtatttggttagttgctgatatgtcttctttttcgcaggtatacccttgtaggaaattaaagcccactttctccattattatctctttaagagaggtttttcttcttaaaatttattttttatctctctgatatgatactgcctctcttccatctttatcatttgcaaccaaattatatctagaaccagaacctgtttatgaaaagatgtgccttctcacttcgtgctgctgaagaaagatccacagtgatagtagagaaagcaacatattagctgctaaaaagattgcaaacataaactacaattgtaaattttgaagtcaactatgttctgagcttgatttctttgcttcaactgtctgtatgaaatggaataaatacagctaaccaaccttcagggatagttttgaggaatgttgtgaaaaataataaggtgcaatcgtcacaaaaataattttctagaaaaactgaattgaaaatcaacctgagtatttaagatacagttttaaaaaactatgagaacaacctttctttctaaaacttaattcttatttttctttatgattatctaattttgtcatattaatgttgtcaaggtgccatattatgtacaatgaatagagaacttgagttctgagcaaaagttacattttagattttgtaataacattgagaagattcaagataatgagctttgtgtttggttatttatgtaagtagttgaacactcacttttttttctttcttgacttgatttttaaggccatttatattagatcttccctaattcatacatatgacttttttcttttaggtataatccattgtatagtcacttttaagatgttttgaaaattaaaaatattttaaattcaataaatagcaatattggatctttaaattcaatagggaaatctcaggaaatgtactgtaagttacttccctatgcttgtcttgaataatcttttaattttatttttagttaaaaaattacttagcaactgtagcagtgacataggtaacagaactgccttacaaacaaccttgcattatattcattttctactatattttttaacatcctgtagtctatgaattatcagaatcattgacctcttaatcatttgtttgcttcttgaattttaagggaactctgggcactatcaaaatgagggaaacataatatcacattctaaggaccttactatattcaaacctataagcaacaaatttaagtactagattataggctaatcttaaaaactattttttatagtatcagttgtttttttaacaaaaaataccttagagaaaaacaataaaaattaattatttatgcagagctctaattttgttctctgtaacaggatgcttggtttctgtcttattgtttccctgagacatcaaaaacaggacttaaataaattttcgaaaagagggtttctatagttacgtgtttttgtttgttttttagtattgggtactagatacattacgtacttgtaatctgacataaacaatttaattatcattagcttattgtatctttgctgttgatcaactcaacactcaaagcttactcttcgctaccagtgtcttacaaaatatgtactgactatattttgagaagcctaaaataaatgacaaaagtactaatttgctgaactttggaagtgtatgagaatgtttaagcgatttatgacatgttgaggctatggaaggtagaatggaagatgtggaactgggtgacattgaagtaacatgtaaaatgatttctaggaagccaaggaactaaattgtactcaactagtttttcctgtgagcccagattgtgcacagaccctcttccaaacgtgtttcacaaatccaaggcagttatagaagaagtaagaatgtgtgtcctgattatgagccagaaacatgacctttactgaaaggcaatgatatatttattaactatttaaacatttctagaaatctacagactcatttaatgcttgcattaaagttattttaacaaaatccacttacatactttcttcttatgtatggtaaaaattactttcctctaaacatggtaaaaattatcacctgtatctgcccatgtcttggaagagaaagtacatacaaaaaaatctgtttcattgatattgaaggacaatatatgtatgtatctacaacacaaatatacctttgatttactaagccaagtaagaaatggaagtgtttgggtataatagactctcaatgacaagtcctgccactttttctttcttagcacgtcttcctttgtagactatattgtttctaaagtgagactatttatgagtttatcctcctagcatagatgcctgatctgttctccttttagcttgaaactatttcagtaagagctttacacaataggcttgagggcactttaagaacatgtcttaagaatatttgaaattaatgactaatcatcccaattcaataggacaaatattctgatctacatttgtgcatcacccacacatttttgttttaaaatttttatttagctcttagagatgctgtgagggaagccatcctccaaagctccaaaattctataattatttttaaaattgtatttatggctaggtataaattcaagataagtgggtgtagaacctgaaaaagcatagatggggaagtaaaaataggtattacagtatgtgccccaataagtaaactctactccatatattatcctcttgcatattctttaaatctggtgttaccaaaatgggaaccaagaattattttttttacctgtaatatttcataaacatgctcttacataaccctcctgctttggaggatctaaagcacaaaatggaagagagattatatagccacagtttttccttgggattattaggtatttcaagtaagtgttagatacttagggccaaaaattaacttctacttcaactaaaatgtgtgcgtatgtaaataatataatatatacaatgtaatatatataacatgtgtatatagttaagattatttttgaaataagtgacttttgtaggatggtggcactgttgacataccaaggcaggaatagatactttctttcaaatgatttacagaggtcaaaagtaaaggtacatgtgttatacaatactgtctatgatatatgttctacacttgtgtcagttttttttttatacaggggagaataggactaattagtctttttcattgcattttctatcaacaggttcttttctaaagttcatgtagtaagtaatatgtcatagaaactgaaaaaaggatagcaatcataggctggcttttatcttaccaattaatctaagaaccatatacacacaataattcgctggtaataagttaaagttttctcagaatgtgaagtattactttaattcgatgagcagattggtacattagagctttttcattggagaagaaaaacttcataaagcctaattcccttttgatttatataacagtacccaaactcttactgagcccccttcgtctattacttagaattgtgatgatcatatgaattgggaatcatttaattgagcataataatcatcaggcaagccagtgaaccaggttgttgaacaaattaagcttattaccattaagagtggtggcacgtgcctgtaatcccaactactcaggaggctgaggcaggaaaatcacttggaccagggagtccgaggttgcagtgagccgagatcgcgccactgcactccagcctggcgacacagcgagactccgtctctcacttctatcttttaagcactaagttaaaagagtacttttacacaataaactaggggtgttttatacttacaacagctaacattcattagacattatgtatccagcattattctaagagtattgtatgcatttttcactgtctccatacaacaactatttacaataagttttgttcataacctcatttaaaagatgagaaaacaatcatagagaagttaaataattggactcagatcacacagcttaaaagtagcaatgctgccagacgtggtggttcacacctctataatcctagcactttgggaggccaaggcggggggttcacttgaagtgaggagtttgagaccagcctggccaacatggtgaaaccctgtctctacaaaaatacagaaattagctgggcaagggcttacttggccgggctcagtggctcacgcctgtaatcccagcactttgggaggccgaggcaggtggatcatccaaagtcaggagttcaaaatcagcctggccaacatggtgaaacctcgtctctactaaaaatacaaaaaaattagctgggtgtggtggcaggtgcctgtaatcccagctacttgggaggctgaggcaggagaattacttgaacgtgggaggcagaggttgcaatgaacctagatcgcgccactgtactacagcttgagcaacagagtgatactctgtctcaaaaaaaaaaaaaaaaaagcaattctgaggcaactcctttagcaatttactgcataaagttttctatttttgtcctcagaaaatcgtcttttatgtatttggtctttattaactatgtaaccattatattgacatttggccaaatgcaaaatgcattcttatcctgaaataagcaattaaaaatgaattgatatttttaggcaagcctagcatgtagcaacacactttttatggttttgctaatctgatagtgtaagttcaatgtttataatgaagatgtatttaccaaaactcaaatttatgcaatatattaaatttatcattaaatgtataaatttttgacagatagattattaatatcctctatatgcaaacccatagactattatcacgagttagccatgtgtttgcctttaggcagtttgcccgaataaaaaatattcaagagcaaattttttttaattttaactatagtagtgttttataattaatgtacgagtttagctgaagaaaagacctgaataaagaatagacttaaagttcattcgtatttaagttactggctattgtcactgaattatctattcttggttttatgaataggcatggaaatcatgaactggactcatcatcacacttatgtcatttatttgatttgtgaaacattttggatcaataattttaattaatatatatctaatgtgtttccattttgtaaaacaatttctttacagttcttaacacattgagggagaaatcaaacagattaacattcaaattttcatgtatgaccattggtaaacacagaacagaaggaaaacatcccaaaatgttttttctaccaaaattatggatgactctttacaaataaatttcagcagttttagataaatttaaatgaatattgaattaaaatggcaaaagcaattaaatagaaatatagttatatgccttgttttcagatcccagatgcctgatctccagattacgtgaaaattattattaatctcaatgacaaatattgaaatgagcattttgctatgttactgataggttgcagtttttaatcaatagattgaaaaactcacaagatttggatttgtaacacgttgctgcaagatttgggtttgacatttgctttaacgtttaattcaattatttttacatttccactgagattgacttgtataacaacatggtgtttatttcaattgttaagttgatctgtgatggcttcgaaaatatgtaatgttccttaatgtataaatgttttaaaatactataaaacttgcagaatatttcttttaccattagcattattatactgtaatcattcacattattgatgtggactattatttttaagaaattggtattcacagtaataggctgaggcattagcattattcatagtcagaagttcattggaaagtaaaattaaatattcaaataccttataatattttctttaaaaatagcaatagttgtattcactcgcaacatacttgagcatgagtctaatatgcacttgtcatagagcctgttcatagaaaaatgaataataacagtacccaaacatttgtcttctccttctttctcaatcatggaaatgaaaaaggtcactactatttatattaatatgtatcagaaaccgttgggcttctgctagatacaagcaaataaatataaacaagaagaatagcagatcctgagcatttgcctttataagagagaagtgctaaatctgaaaagtagagtaacttggactataaaattaaagtttatctgaaatgtggtgtataatcatattttaacctcatctctgctaaaaaggtaaattaaaaattacatgggtatggtgaaacatgcctgtagtcccagtgactctggaggctgaggtagaagagtcgcttgagcccaggagttaaaagtggcagtgagctatgatcgcacccctgcactccagcctgggtgacaatgagactgagtctcaaaaaaaaaatcgtatttcacaccacttagataaaatcatataaatatttcaatatcactcctggattaaataaaatcatatgtaaacatttacttaagctaaattattttttaaaggggtatgctatctataagacttgggcaatttacttagtttccctgtaaaatggaatattctttacctataaaatgggtattccttacctttgatatgagagttaaatggaatagtgtaattatatacctagctgtaaaatagctatagctaattctccattaaaaatattcacttgtacacatgcacacaaccaattaagacttcaaattaaggcatgtatacattctgtagagtttcaaatataactttggaaaatacagcagccatatttacttatatgttaatatgcagatattgagattattagattatgttacaatatgctgttcataactgagttgtttagtcaatgtttcctacttttttattgttaaaacagcacagctatgaagtgcagttatcttaatttagctataactaagactaatgtggatctggaggctcatctaattgcaccctcaagatcaacaggatttagttaaatctcatcttccccatgtgtagctggaccttaacattctatgattcttcattaatcagccaatttttttcagggcaaaggctgcttctcagttgtcaaatagacaaacttgaaagctatatgataactcttaagattgtcaaacaattatagttggccgaaagcagtaatacactctgtctcacttttgggacctgaattatctaaaagttaactttagtttggaatgaactttaattaattccaggaaacaaaaaccagtaagaagcaaattatttcaccaagttattacattcattttttatgattatcttcaatggatttgatggtaagaatgtgaattaataaattagatgtatatgatattaagctaaactaacctagattttcagtaagagattaagaaatctaaggtcattatgattcaacctttccttccctataaactttcagaaaaccctctttgctactctctcttctcgggatcttcatctccaagggaggggattccaataaaatcagaaaagaaaaaaggcttatattatttggcatttgatattcttaaatcctactgttcttattacagtagatctggcatcatatggtaatgaggttttattttaaatgaaaatcctcaagactaagtagaaaaacatggacacaaaattatgtatttgatttcaggtatgtgaaaatatgtatgagattgacagtagttatatatgggggttagcatcacctggaactttttaaaactattttttttcatttttcaaactttgtacaatgaacatgtatgttatttatgagcaatgcaattaagtgatattttaaaacattgtggaaactttttttgctatagactgaaactcaaaattctacttctataactaaaatcttcagtctgtaaatttctgaaaatacattaataatatataatatcataatatattctaataagaaagcacatcagacactgtctgtttcaaggctgtgcttgatgaacctttgaacttatagcttgttatggagagtagagaagagaatggctgtgttctcagcagttgtgtttttccaaagaccatgcctcaaggcaatgcaggggcaccttttaactcatgaacaaatgtgtttgttgattaaacgtccagactcagtaatcacagcccagcagagagcttcgtgacatatctttccacctatttcatagtctagttttctaggatattctcctgagaaaatctttaggaaaaaaagtgaatgacatatggttcattctatgtagtgtctgaaggtctgtttctatagcaacaattaacaggctaaatgttaggatttgaaacattctatagctaccattgcttatgttaacaacaaactttagggaaacttctgaccttatagtagtgactttgaaagagtgaattgttttcaagaatttattttttttctaaatctgcagtagtcaggatataaaggagaaatgtgtcttctggcgccccttttcctatctgcttctctacttcagatgtttatttttgtatttctgctcatatcctcccaaattgtaaatatgaaactttgaaacattataattatgatacgtaatcagggccaatcaatgcccttaagtcaaaatgcatagcatgatgagatactttatattgcatagtgtcttaaaaaattataacatctattatttcatttaagcctcccaataatcccttcaagtacataagacaggtattatagtcactcaatagatgggtatgtaagttatggttgagtgtcttccctaagatgtattaaaagcagaggcagttttagaatccatgttttctgcctctaaactctatactgtctccagatagttttcttgatactgtattcattattatggtctaggaagttgatgaatcttaaattcaattcatagtttcacatcatgtgttcacaattccaaaatcatatttatctaaacttcgaagaaatacggaagtatagttaatatgattagagctaaatgtctcaggcactgggccagttgctaccttttgcttctacattgtgtctacaaaacaagcaaactaaaatatctgtaaatattacattaacattttcttcaacatagatgtattattaaaaatctagtggcataattataagacaactgtcatactcagcagcaaatgttctacattatttaatacatcttcaatgagccaggtcagagggtggtatgcatacggtagaagtgcaaaaatattccttcttataaaaatagacaaaaaaacccaacacaatccaacttggttaattggaacagcatggcaaaaagagatttgattaagccctttttacttttaatttcaactcttatagtagtacatccttctaaaatgcagaagtcttccattcaggtttttagtcaatgatctaatctgtcattttcatctatggaagaattccaggggataccaaagaagttactaatctatatccacagggtagaaagggactttggaatggtggagtctaattttttcttaatgtgttgtacttaatctaacattagcttgttgaaagtttattttatgttctcgccttgacatttccaaattaggcacctttggcatttacattactctttttatttcccggagctttgttgtagtacactgaaataatgactcatcatacaatatgtgatgacctaaaatagttgctgtagcttcccaatgtgccagaaagaaatagctgaagccctgacatcttgtttcattaaacaaaaattcaaagtaatggcagttgccaaagaacataaaatattattatgttgaaagattttctaagtttttaagacttttcgtttcttttttcttttttttttttttttttgagacgaaatcttgctcttgtcctccaggctggagtgagatggcacgatgtcggctcactgcaacctccgcctcctgggttcaagtgattctcctgcctcggccccccaagtagttgggattataggcgcctgccaccacaaccagctaatttttgtatttttagtagagacgaggttttaccatgttggccaggctggtttcgaactcctgacctcaggtgatccacccaccttggcctcccaaagtgctgggattacaggtgtgagccaccgcgctcagcctttaagactttttgataaccatatctcatattgtgtaggtaaataagaaccctgaaaatcatctgcctgcaatcataagttttgtctgtagcttcctaatgcatatagaaaaaaaccacaataaatgaaattgactaatctagcaaaatgcctaagcaaatagactccctctccaacattcagaattatctttaatcttgtgatataattacctcaattatccataaccattattccatgctgaaaacagaaatgtgttccacttcagctttctgaggtaaaaaaaaaaggactaacttttgaagaggaaaacaaaacaatcatttgagctgcaaagtgtttccatttttatgcacattaaaaaatccatttggaaaggaagaattcattgtaatctgcaagagtaacacattttgaattgtaatacacatattttatttcatacgaatttattaattattgacagaagtactcatgagagtgtttaagttggaatgtgggatatcatgtgtcaaaaaaaggctcacataatttgttattattgctctatgacactcttttgtttttgtgctttttgcctttagatcagaatgaatatgctctgcacaatttgttaaatctttagaaaaccatcaaaagaccactctggaattatttgcattgagccaaaaactattcggataacaggtggcctgagtgggtgtgtgtgaaattcaagggatagaaggaaagcaagatttgcttacttgaaatcctccttcagttcagtgatgggactccttaattgaattcaaatcctgagcaattgtatttgatttcctttctgtattaataaaggcatagaggcataaaagtgtttaacatgttcaagaaacataatatggtttgtgttagatgtgttggcatatgtgcttgttgtgtacttgcagggcccgtgttgaagggggaaatgagaagtaggttgtggaaattttgtttaagatctaaagagtttgggttttactgtgtggtcaatatagatttcctgagctgattgacaacatgattttatctcatacgggaaataaactatggtggcaattttgagaagaactgaaatgggtaagagtctggaagcaaggaaaaatatggcgagactattggaataatctagatgaaagttgatgagggcctagataaaaggaagagacagattcagacagtttgatgattcaactcttaaattatctggaaaaactatgtctcaatgaaatattagttttttttttcttctttttagaggacaaacctcagttaactacaagaaaatgttcaaccctataaaatgatgaagcacttactagaattttaaccacggtacaatgaaacagtatactaaacaaaaataaaaatgccattttttgtcaccagtttcttaatgacaaaataaggccttatattttgaaacaacataagacttgataattttcaaaattaaaaagctcagaaggtaattcctcattaacaatagatcacactggcctttaatgtatgtaaacaatcttgagtattgtcaataaaggaggaaaggatgataattacaaacagactaagcttcttgcaattgttttctgcctactcaaatagaacataagagagctcagtcccgtgtacccaaggttaggaaaaaaggaaatattactgtgtccatttttaatgtcaccacttttcccttctatggcttaccagatcatcaaaatgatcctctaatgccgtggctaaaagaatagatgtcctaaagcactcttttttttttctattttctcgagctttcgtgatagataagatcgttcagtactgctttgaaacaacgacattttataatataaaattacttttgaatcagaaggtctggccattcttctctcctctttcctgtgctttgaattatttttggaccccagcataattcaaggtaaatagatcctgtgtgaataaagtatgggcagaatgattctttctctgcacatgtagtaaatattaaacattgatcagacagttatgtgcatgagaaaatatcttgagactgtgtatttggtgtttctctttccctctctgtctgacacacacacacacacacacacacacacacgtttagaaagattgatgtgaaacagacctaaattaaaaaggtcaaactaacccccttcaaatcctgtcaaccttcccacctatattcttacttccatgttcctaattgaaattggaaaaaaagtaataggcgaaactacacaatgctggtgttgatttggcagtgagggtcgagataagagagagaaaactaagctctagtgatgcagtggcagattggcgattagtaggcagaccattctggggaatgaatagagcctcatgagtaattatttaacatgaaagatagtgtttacattgctcttccctgcctgtttcacattctggtaatcataatcttgtgaggctcaaatgagataatgaatgtgaaagtgctttttaaagtatcatagattttaaggacattatacatttaggtctaggtaacaacatttcagaagatataggaattttcatctcccaccccccattcagtttctcacggattgctttgaaactgttagccttaagagttccatttttattatgtaactacatagttagaaaaggtaagaatttcactaataaaatattcttgctgcccagtaatcagacaattaacagggttctgttcccccacaaacaagacatcctcctgggcttcctcaagagtttcctcaagaaaaaagttaaaaataaataaagtaaaaatacaaagcagaaaagtaaaatgttggaaacacaaacttactaagccacaccttggaaacacagctagatttttagtttctaagaatttaagagtctaagagatgattatgtgaacaattatgaattaagcccctcctgtgggcaggggcctgattattttcctatttttcttattccatacttaatagggggttgttatatactttgctttttctacacacagtgctggcttatccttggcagtcttaaagaaacttaatatcacagatttttattttttaaatttatttattattattattagagacagagtcttgctctgctgcccagtcctgagttcagtggtgtgatttcggctcactgaaacctccacctcccaggttcaagtgattctctcgcctcagcctcctaagtagctgggctcacaggcacgctctaccatgcctggctaattgttgtatttttagtagagatggggtttcaccatgttggccaggctggtcttgaattcccggactcaagtcatctgcccgtctcggcctcccaaagtgctggaattacaaatgtgagccactgcaccttgcccagtgtgacagatttttaaaagcgaagatgaccttggagataatccagtgagaaaatcacactcaactggaatgtaaactccatgaaataagccatttcatactcacaactctattactaaacctaatagcttgcaataatacataagagatgtaaacagaagaggaaattacatgttaaaaagatagagtcttgcccaggttcacaaaaatagaatctaggtcttcacttctagctcagtgcttttcccatcatgccacactgagcctcctgaaggatatgatgtcttctccaaatcagtataatttaagttctagaataatgttttcttggttactaatgtgtaactcatactaaattcataacttttgaattggattatactgatttatatctgcatattacaaactatacctacttcacttgattttactattgggcattttttgttacaatttgtttacttaaatttggaactgtagagaaaataaacagaattagatgaccaaaataacagaaaggaaattgtttcatctttgaatagacaatagttaattaccaggtcctaaagccacttctaatacccatgaagtttcttagttatcttgccaagaatgaaaaataaatgaaattatgcaaaacattagttggtaggttaaattctgtggcaattaaaagcaatttattaagtgagtaatgtataccatagagaaggaaaaacttagcctctacacttctagggtgtttttccggcggagcctgataattaaattgacataagacagaacaacagaagaaaagcatacaagtgtatttaatacaaactacataacacaggagacttaagaaaatgaagacccaaagacatcattagagctgaacacctatatgctgaattggacaaaaagtaataagctgtgaaaatgtgacaaggcaaaacttctagggctatgggacttgtttgggtggagatgtgggcaggaaataagggttagtctgacatagtgtgtttgtacagatttttcttggtctcaccttctcatccttgatggtaagaatgaaactttccttctagtataaggaagatatctttcacatggggatttcatctcttgtttctaagaaacagaatgaagtttggatgatcttcttgtatctgcttttcttcaagtgtctttaactcagaatagtcaatattccagaatggcatattttagggtggcatattcttaactccttcaatacaaaaaggcttgtgtagagactttatttaaagcaacatttaatgttaatttttttaaaattatatgtccctttatcctatttgtttcaaaattttgctacttcaaacctaacactttccacagaaaaagcctgtcattgccttctagggataaaatactgccatgcagaacatggtgcacatattagacatttaagtaatttagatgctggaagggaatgtaacatattatacttgttaacattgttgacagcaacatggaaagctcattttgtctgattaccagccttatgcttcatccggaatcttatttcaatatttaatacatttcagcatcttcctttcttatatcaaagttaaatatattgtacccaaattttatcctcttccatattccattcccttagtggaaattgaggacagttggtcattttattctgggtaagattactatttacacttatatagcattgttaaatcacctccttgatctttgccaggcttaataattattataattaacatcttttgagttcctactaggtattatgtacttttacttgctgtattttatatgtttcccacaactctttgaaatagatgttacctctattttaaagatgaaacaattgatgcttcaagagaacgacttatcctagatcaactagtggcagagcaagttttagcaatgagtaacactgcaagaaacaaaaggataaagaagactcaagttacaatttgcagttgggttttttaacctctagctccaaagagatgaaataatgttcctctttcaataatgttttctctggtttgtcttttgtctctcagattaatgtgaaaaacactcttttgcaaaatgtcaggtattctggtaatctaatctctagattaccaaatcttggtagtcagtcctcttctttctacgatgtgaacttatgctgaaaaagactaaccttagtgtttttgtaatgtgttaggaaatatattagagttttctattgtcaaaacgtgttcctctctgcctgtgtgctttctaataactacgttcccctttccataaacatgagccttcagatacacagttgtatggccagcagtgtcacagaagaagaaacaaataaaatgcattcaataaaaatgagataaggaacacatggattccttattttaatttccaggaggatatttttcatcttgagtagctgaacaattttaaactaagacttatttttaaataagttttgccacctataaaattcaattatttaaaatgtatacatgccattaagatataattaccttgcattcagagaaaaggatttaaacattaggaaatttctttaacaggctgacaattttcttttttaataaatggaacaagaaaggaatacccagaaccacaaagaaacatatttaaagcattaatggaagaaagataaatgcatatctttaaaatgctacaattgagattaaattggtgattaaaatttgccatcttctgacaacaataactttttatatatattttaaaatgagtaatactattttcattagaaactgaatcttctaaaactggactacttattatctataattggtgggcggcaacacattaaaattcaaatttctacatatttccatatgtaaatgtgctttttatattttttaatatgctgctctttttaggatttcaaagttcagaaaaataagattgccttggaaatacaatttatttttctttctctttaaaagtctatttcatgagctttctgctgtttaagttttacagtagggctcctgacattcttcatagaaataaatcttatttcttttgtttacccaggaaaagagaaagaaatctgtagttcatttagagataaggtctgtctcctgctcaccctccgcctttccttccctccatccctaataccttttcttggtgattctgaaactctataaaatactggtatataataggcttcatcttacatttctctttaggcttttcttttaagaggtggaacagtgtaatgcatataactacttgaaaaggagcaatttgcctttgttcacttcattcgaagatatctatcaatttaacattattcaactgtatctagaagattccctttctgccaaattggaaaataggtacccatattgataataccaggcaagcatatcttactgatcagataccaaaatatgaggttgtaactatgatcgtaatatgatcagaccaaccatgatggagatgacaactctgtgtcactcttggaagcctaatgaaacacttaagctttggaaacgtagactgtttttaactatttttaatccatcagtggttgttacatacccaaaagataaatgattgctctttgaggttctttacaacactcgttgaaaaataaatgatgaatataatagattgaggatagacataacttatcctgaaactgctattcatttatagcattatatcatctagtcatacaaaacaaacacattcatacacagatgtacctgaatgccatattgagacttttaaatcttttttttttccttgcattctctatccctagtaaatgtaagctgaagtttcatcctggtatcgggggagagggataaagggactcatcatccataaaacttaggtattggtaaagaagaacaagctggccaggcacagtggctcacacctgtaatcccagcattttgggaggccaaggcgggcggatcacttgagcttaggagtttgagaccagcctggtcaacatggtgaaaccctgtctctactaaaaacataaaaattagccaggtgtggtggcctgtgatcccagctactcaggacctcagctccttgggaggctgaggcacaagaatcgcttgaaccctggaggcagaggttgctgtgagtcaagatggtgccactgcactccagccatgtgacagagtgagattccatctcaaaaaagcaaaaacgaaacaaaacaaaaaaagaagaatcatttaggaatttcagacaatgcgacctagtaaaagaatgactctctgttcaaaatgcttgacttctgagaattatcttttttacacttaaaaatttgttttgagaaatatcttttgaaataaaaatattctctgtacaagttcatacaattgctaaggcacatatctttccctgaaaaaaaatgacccttgccagcagtgaaagtatatttaattaatataaattcataaattctattttaataacataagcgaagagctttatattgagagccctttgagataaactgtatcaatagatttcacaagctactcagttgttattatgtattaatttagtatttttatattttttcatcagttttatcttagaactttcctgaagtgtcctattatgttttctatcatgtttgtttgcttgtcacattttctaaaatggttagctgaccgagactaaagaattcaatagaaattattaactaatctcaagtaaagatattgctcttagaacttttggccaagagttaaacatagctggaaaaaagtctaaagcttatacttattttaaaagaggcattgcctattctgaaattaaatgttcttcataaagtaaaagtatgctttggaatgtgctttattttcttcttagaagccaggtatgtaataataaaaaatacctctcttatttcacagccttaaattttttaggttacttttatttagtagttaccctggttctcttgactatttcttgaaagggggagatatttttctaaggaaaaataggcagataatttctacttttatgagactctttacaaacactctaagaataagtgcaaaagcttttttggcatataaagtattgcagcttttttgcaaaaataccaaatctaagaaaatgagaatggtagtgggaggattgtatttctcctcattatagtacattaaaaataggtctttacaggaaaaggactaaaacaagatacttaaaaaataaccatgatataaatggtttactattttaaaagtttaatttataatagctgtttttatcaaaaatctctgccatgaaaagcctttttcttgaagtctagacaggtaagaagtttatataaatacatcaatagatcaaaaggctaaaatctttcaattaataatgagatgtagtttgatgcactgaaagggaaacaagagcagtaatacaatttgtatactgcagtcatgacattttagtgaccttcaaatttgatggatatttgttttctaaaggttatcatcatgtttaaaaatattttattaatttataacatttataccataaacaccattaatttatatcattaataaattccactataatgtattagtgaaccagttagcagctgtaagattgagtaatatttagacttttattaatagtttctaaatgtcccagactaattaaatcttctcattccacaagaacaatgcttaattatcttgactacacagcttataagcaagatattaatagaatattcttgtttcacaccttcagtggtatggagactgtcagtaaaactatctcttttcattgctaacacttcattggaccgattagatgacttctgaattcattagtgaagtgctaacttcctactggaactggaactggcatagtgtgttttattactgtgtatgtttacatgtgctgatacacctttcagaaagttgaatctttgactaacatataaacctgaaattagacagtaacccgccaccagagggattgtcaatctctggattgcctaagtgtcagatgtctgccaggtgccatacgtttatctaaagcaggttatagcagtggattatcatagagtcatagcagtggattatcataaagtcatagcactttagaacaaaaaagagtctaatccaattgttctattttgcagaggcaaaaaatgaggattggattaactatttctacctagccagtactttatccgtgttaaaaatgttattactcaaattagctgatgtgcacaggtagtggtagtgattttgctacctgatattataatagaaaatgattatatttaatttcccctttttcagtgaagctttcatcattagggaaattggcctgatcatcttatgatcataattacaacctcatactctgaagggcagttgatatagaacaaatccttttcaaagcaacaatataaattgagatcatttgggtaactttcatgacagctcttccctattagcattcaccactttcaatattttattgttcccagacatgattaaaatgaatcttttataaaaataactttgttatctaaaactttttaccagattataatatgaaaattcttcagctgaaggaataatttttagctaccccacttcatggcatgttccagaaataattccccactgggtcaacatcccccagagctcttcttcacagacaaatagagacacaaagaatgtatgcaatttgatgttactgagcacatacacattttggaactattattccccctatcagatagtactattactcttgcttttagtggtaactttgacaatttattgctagaattattcatctttagtgaggctgaaggtccaatgttagaatgttttagagacttatttctgagagggccttaggtctatcaaggtgggcaaggttgttatttttaatcaaaataaaatgttatgaatcatttaaaaatgtaaactctttaaacagtctacaattttaaatcttttgtttaatttagaaagtaggcaaggctagaaaggaaaggaaattttacccatattacttccacacagtatatttatatattttatttaaaaaatttttttaaataacatttaaaaacaggttacaaaatacttatggcacacatcaatggatataactgtaaaatacattatataacttttatgcaattttattttacatatcctcaccttaaataaaaatagcaaaattttataacgtttcagataagaacaaaataaattaaataatacaaagactcatgaatttcaatttgtttctattttgaaagaagagtgagaaaatttttaaattattttaatattcaatgtagcttctttagccagtgctttccttaggttaaataaaatttgtgtgtaaagtcaatgatgggaacatcattttgaaaattacagtaatagttgagttcatgacactgacttaattacactgacgtttagaagagattttataaatttaaaagattattcctgtcatttaccccagctatattttcttccaataaggctttaaaacttgctttggaaaatgctatgcagaacagttacttagcatgtgtagcaagatacgaagtgggaaatacagatgaaaaacaagtttacactgtttagaaaacaatttggtctagtgctggttatatttgcactttcacaatacatcctgtgcattatgcattacttaaaaatgtattcgtgttttacacattttatgtactttcattgatttgagaatttgaaagtctttcaacatcatctcaaggtatcctgtactccatcgtttactggtacattgcttaaaatttcacgtgtgtcatatctagtctttaaaaatatttgtaattcttttatcaaagaacggataaatgcctaaaatttgtttttattttattatgaattttgtattgttattaagattaattaagattatattgcaataaaaattaacagttgacttgtttgtctaattttgagaccagcttaatatgatctataaagtttacaagtataatttctgaataatgtaagttttaaaaatattactgttttttaatcaaataaataatgagataggtaattcatagataaatgtaaagtgcagttgagactcttaaccaacggtctcttaatacacaatttattttgtctgccttcttttataaatatcagctccattcttgggcaacttttaatgtctcaagcgttttccttttctactatgctcctgatcttcattaaagttttctgtagaatggttataaatattaaaacggtcataaatgttgaaactttccttaagtaggtaatatttgttatccaacgtctcagaggaatttccatttgcttcataaagcatggcacttttttaaagacaaaaaacaaacctggaattgacattcacggccgagcacggtggctcatgcctataatcctagcactttgggaggctgaggcaggttgatcacctgaggtcaggagtttgagaccagtctggccaacatggtgaaaccctgtctctactaaaaatacaaaaattagccgagtgtggtggcacctgcctgtaatcccagctactagcgaggctgaggcaatagaatcgcttgaacccgggaggcaggggttgcagtgagccgagatcatgccactgcactccagcctgggtgacagaatgagactccatctcaaaaaaaaaaaaaagaaaagaaaagaaaagaaattcacatgcatctgggaacaagtgctactccaatgctgtagcaattgtcctacagcgcacaccactatgtagaaaaatgaatttttattaatgataaacatacataagcaaccatgacataatttaaaaatcgtcttataatttgtcaggtttaataagtagttcacttggttcagctgaattatacatgtagtacttttgctacctgggattagaaaactattttatcattcatttcttaatggttgataaggtgaattctaattttaacagatttttattcctagtcatagaaatgtagatgcgaattgagtctgtacatctgcttacattttctttctataagctagtaagtaaataggcgttttgtttaacaaatcagactgaacagagttagtacaatttggctggccagggcctagcattaaagagaaaactgagaaaatttgcatagctgtggtgttccagaccaccatttcttttattattattatttcaacattttctgggtacaggtggtttttagttacatagataagttctttactggtgatttctgagattttgatgcacccatcacccaagcagtgtatgttgcactcaatgtgtagacttttattcctcgtgcccctgtaacccttcccctcgagtccccagagtccattatatcatccttatgacttttgcatcctcataccttagctctcacttataagtgagaacatacaatgtttggttttccattcctgagttacttcacttagaataatggtctccaacttcatctaggttgctgtgaatgccattatttcattcctttttatggctgagtagtattccatggtatgtatgcgtatatatatatatatatatatatatatatatcacattttctttatccactcattgcttgatgggcatttaggctgcttccatatttttgcaattgcaaattgtgctgctataaacatgtgtgtgcaagtgtcttattcatataatgacttattttcctctgcatagatacccagtagtggaattgctggatcaaatagtagttctactttcagttctttaaggaatctccgtactgttttccatagtggtcgtactagtttacacttccactgacagtgtaaaagtgttcccttttcaccacatccacaccaacatctattttttttttatgttttaactctgaccattcttacaagagtaagatggtatcgcattgtggttttgatttgcatttccctgataattggtgatgttaagcattttttttcatatgccagacaaccatttctgtgtgacttcaaagacagcatcacttcctccaaatgaaagtgagtataggatttgtagtagtgaaatgactcattataaccaatcaatgtaaagatggtaaactataaactaacatttattataattttaatacaacatttaatgttcctaagtcagtaacttaatagttaaagtagaactataatatggtagattaaatttggtttgtgatgcagtactttttaaagtgaaattaagtttgcagttattgctgggatcattggctgtcatttgtgagataattcataactcatttttttgaactcattatttataaaaggtatcaatttgacagctctggagacacacttcattttttcaattcaaataataggaacagcaatgctgaaactttcagcagcatctccaactaaagcatctgtcacgtctatcactaatttgaaaagtctgtttcctgagtgaggaattattttggtcaacacatctgagcagcaccccagaaagtcagcctttatcctcagagcaataacgatgatagtgacagttcttgacttttgggagatgcagatgtatatctggttaagaacttccagcttgcaacccagccatttcctcctctccaagtagggggcaagaattaaatatgctaacatgcagaagttcttcctagcacagtacctttcatttaatatgtgatagttttccttttattgtttcttttcttctccagaatacttttgaaaagaaactaaaactaacactacattattttgatatttgactgtttttcatctgcctctatacccttcaagatgtttctttttcagtatcattttcttctctcatttttcattcaactctaacaataaaattgtacatagaaaatagaatacaatgaagaaattttaactgaaagcctgcattttaggaagtagctcacaaaaaaatagatgaaccataaaggatttctttataccataatgagcaaattagtaactaaatagaaaatcattgattctgggataatagggcaggtgctctcctttatattagttgagtatcagcttgagatgaatgttataaaaatagaactcaatacggattaaaaacaataagcatgcaatgttttgcttgattcatttaaagacaatactagaaaaaatttgagactgatttaatacatttatcgtgtcatggaaaacatatgacttataccctaggttgattccttttttgacactgcatcgcatcctatttatggatgagaaagagttgggtcattaaacatatattccttccatggatatcaatacttttactttagcatcacaatcatattgattataataattatcttaatttttatcattctcaatccttataaaaatcctcaactcttactaattccattttatagaagaagcaattgaaggtaaaaatgattgagtgtcttgtagaacaaagtcatacagtgagaaagacaggacttttctttaaaatgaatactagattacttgcttctttggttcccttgagaatttttcttagtagtgaaatactaattatacagaagtcaatggcaaacaagtgtttgtgagctagaaatgggcatatacaggactagggtaaaatgaaaatcacattatcaactgcccgatgctaagtgttagaggttacagaacaatattagtgatgaagcccacttatcatagaagtcaagcttattttgctctgttacagactaatgagagatgcaatttagaaaggatttctgtatgaaaccaaagtttacctgtttatcatataacacttgcttttttgttgactctctatctttgacaaagcaagtttttaaacaattatttgaattttctttttgattatattctctaccatacatgctatcttaattctgtgtatattctctacaatgtcttaactactcaatagtttcttcattcaatagatatttactgaactcctactttttgccaggtcctgtcttagggaatttactgacaaatatctacgctgatagttagagacatagttcggattcacttgatcaattatatttggtgtctttgaatgtttaatacaaattacaagtatatttatacaaatgaatagatttcttcataaaatgtgttcatcccagatggccactgcttcttagaaaaaaaataacgtctatatatcttcttgatacaattactactagcttggaatttttgaaaccttaggagagaaaataccacagccaaactattttcaggctttattttcctgctaagggaagattctgaatctttcctaaaaaataaatattacatttctcctaaatttttatcttcattttcatagagaaagtattcctctcaggagaagtgactatcaatttttctcttcagaagaatttttatacttcagaagtatttagtttgactattagacaatcccagaaaaagcattttgctcatctctaaaatgtgatgtttcaggttatatgttttacttcaagaagaatataattttaatagtcaccagatatcattactgaacattatcactttccagccaaaaagaaagtaaagcatttcagaaatacttattcctgcccactcatttcataataagacttcaagtaatttattgcctaatataagacaattagtgagttctacagtcaacgacatggacaatgccagttcttgtgaacatttccaagaggatatttatgcttaactttttcttttttaaaaaataaatagctttatgtaattaagtagctttaccttataacatataattagaagatttaagtattcattgtaagatcttttttatgtatacatttattaactagaggcatgtgacttcagcatcatgaaccaagtcagtatctgaatatatatattctttacatttttttttgccactacttttgagatctattactgtatggggtgatttgaatatactataaacttttggtaaaacttttctctcatgttaaaataactttttaagtgctcagcaatataggtattataagaataagtattgtgactaaagaagataatcagcagaaatgctgcctacaagataaatttgaaaaaatgaattaacataccaaacgttagcccatttccatctcaaaatacacagcttgctttttttctttgaaagccaatggctcacagaaagtttattcaacaagtatttcttgagtgcctactatgtacaaagcactgtatgaggactttggagcataaaagcagtataatacaaggaagagtatgaaaagaagcttgggaatgaaaccacgtgaaacagctgaaaggagttcagagataggagagatgacttctttctgtcaaggatagcatagtagatagcaaccagtttttttatgttattacagataaataatacaatattccctcaagtaactgtttaatatcaagcatataaatatttcaatatatatgtcaaacaaaaacagcatgtttcagttttttatgtttgttaggtaagatagagcaataaaggaagggatagagaaaggaaaatgcaaagaatggacagaggaaagagatacggaagaaggataagggaagtatggagagaaaagaagtgtctccatattactccatatcaaggattataaaatagcttcagatgaccagtataagagctctgtgtagaacatcccaggacttcctgtcttttaaaagataataggaagtagattacaaagatctatgtgaaacttacataattggatatagacacctcagtaaagagttatgataaataaaaagagattaagtcatggacaaggtatagctagaccagggtttctcatccttggcactattgacattttgggccaaatgtttctttgttgtggagggttgtcctgtgcactgcaggttgttttgcagcatttctgacattcacccactagatgccagtagccacagttttccaattatgaacggcattaatgactccagacatcttcaaatatctcctcagggataaaatcacccctggttgagaaccactgacctagagcataaatatttcagttgtagtgaaggagaagtttagaaaagaaagtacagtcacccgacacaaatgatagccacaaaatgaacgtcatgggaagaacagggattatgatctaatgtggagatacgtagaaaaataaatggaacaatgagaagagagaaaacataatggaagcacattgttcttttgggtagtttgcaatgccttatgtctgaagtctctctacctatgaaaaaatagacaaataatggcatgaccaaacaaaactctagaaaaagtatcatttagtgtcaaacatgatagtaattatcaaactttactatgtttttcctgacagttttaaggtataaacaattaatatctttggaactgcctcagattttagaattgccccacttagcttttccctgggaaaataatattgctcatctaaaggaaaaaagtaagataattaatgaaactgtttattttccttcactcttgaaagcatgaggaagaataaattttattccataaattttttcatggcttccatttattagtaattttcacatggtgaaattcaggtattttacatagaatttcttttttattttgttattacaattaatatttcgaacacccaaaatacattccatctacttgtgcgttatgaaaccatggattatatgtattccaaactctgttcattctattcctcaactaaatatatatatatacacacacatatttagacagagtctcattctttttgcccgggctggagtgcagaggtacaatctcggcttactgcaacctccgcctccaggttcaaacgattctcctgcctcagcctcctgagtagagtagctgggattacaggctcccgccaccatgatgggctaatttttgtatttttagtagagatggggcttcgtcatgttggccaggctggtctcgagctcctgacctcaggtgatctggcccacctcagcctcccaaagtgctgggattacaggcgtgagccaccatgcctgggcacaacaatctatttcaaacctcactagtagcacaatgtcctctgtatttctaaccaataatctaaaaatcactgctatattttgatattggagggttgcaaagaagtagaaaagctttattttttattttaatattttcagctattttcacagtttaccattgaaactttaaaatcaaggggcaagagttattgacaatttgcctccctttaggctttctcatgacaagcaagattataatttctggccttttaaaaataagaatgtggtgactacagactcatccccttagggaaatttgtcacgcaaaccgattacctaacttattaaggcttgtagaaatttggtatgcttttaagaacaataagtattatttgatgaagaaattttaaatagatatgattctttcattttgttagagaccctaaaatgaacctcgaaacagaagatatcccaatgattgtatgatatgggaacaaaaacatagcgttgggttttcttgttttgtttttgatactatagattcagactttttagctaagactaggattggaaggtttaaaatatgtttggttgtgcatgagtagagacaagaaacaacaaataggaagaatgctctttggctttcttaagctaaatatctgcttttactaaataatcgaccctctgttataaggctctgtttcaaatttatcttcaatgtcatcatgattgtcttcctttatccttacaagttcattttaataaacacaaaaaaattatttaaacatattgtattatataattcctagcaccatgatatttattcactgaaatcttttgaagagccatgaattttttaatagcagaattttataaacaataatttaaatattttcccattcagtagtaaacactagctgggaaccaccaacactgtgcaaatagtagctacagtgagcaaataattcctatgaggttttgtgagcttttcactcagttaattgaacaatacagttatatgctcaccctgaccctccaaactcagtaggagagttattatggggtcatttatcctgcacattgcaaatatgaaatgctatataaatgcacaattataataatgatgatgagttgcagtgaggcttaatgtcattgtccctatttaagtataatttaagattggatttagcaagatttctttttcattaacaacaggaatcacataatcacactaggaaacaaatgaatgtcactaatgagacagttttgttcaagtagcatgctttcaatatattagtcaattcctcaaagtcctataaatgagcatgctttatatattattgaacagcattatataggcatcggtacttttctctgacttcaagcaagaccatacattaagcataccaggaaaaaatgaacttatatctatcctccaaaggctgcagtaaagtttgattcactggtatcttttattaactacaacagtcacgtcacccttcatctttggcaatatagtgacttttaggctatgcctatatctgttttaccttcttccttccacctctacttgcaaacaaaatctgtatataatcaatagcatgtactgagatgatgcttcaaatttaccgagaaacgaaaaagaatatgtggaagaacaaagggaagtcttatatgtgctacttaaaatcacgaaattaagtgtagcagttacgtgtaatatttgagtgtagaaaataagattagaaactctagaaacaatgtttttcttcagtcaaaaaactccacaaagatggacagtaatagaagtaggagcaaagctgaattaaagtacacagataacaggttttttttttcttttttcatttatcgagttgaaagtcgttttattttcattgtttgctggactctattaaggatttacagggcaacaggagggaaaagaatttgataatctttgatcaaactatacgatgttaatgatacttattgctcatctttcttctatttttttctattattaattctctgtgggcctagcatttacctctttatcgcataaatcttaaagcaaagaaaataatgctcatagtagttgcttattaatggatttctgtgaggttacactgcagggaaaggatttaaaaacataataatcctgccagtcctttgaacagtttagagcacaggagatacttaaagttttatagcattctcctgggaagccatcagctctttgccttttctcgaatttaagattttaattgcctcagtgtttcaataacaattacagcctattcagaaatttcctttccatgatctgacagctctgggttttaatttctgagaagctttccttaagtaggtaatatttgttagccaaagtctcagaggaatttcaatctgtacattatggaataaatttcccatttatctgcttttgatccatcagtgttttgattgattgtgtatattatgcaagcagagctttccaatgtttcctttttctcttgtgccaccaatctagcaatgcattgatttgatcacttgacttattagttcatattaatccaaacaaagtatcttccgcttttttggcataaatttaattcaatttctattcagacttgttcaaatccaataaagtttttctattaagatggattgtggtgaagtgcaacttctgattctttcccaaacttctttgtccttcagaacataactttagaaaattctaagcctgaatcttccgtatttatttaggagaatatgagaaaaaaataaataaaatgtagacatttcctcaaatccattctctttgatagggaagaaacagttttacctaacaaaaaggccaggctttcacctgctacatcctgcaattcttctgttcttcacccctgttctctacgaatcatttggctgagactgtactttttgcttaagctatcatcctcattacttcttcttgtacctcttacattaactgtattgactaacagtattagttttctactgctgtgtaacaaattgccaaaaaaacctagtagcttaaaacaatacccatttgttagctcactgttctgtaagtcagaagtccagggacctcatctgggttctctgtttaatgtctcacaaggatgaagtctaggtgccagctgggcccagctcttatctagaggctctggaaaaaatctgctttcatgctaattcaagtcaatagcggactcagttctttagggttgtaggactgaggtccctgcttccttgctggctatcagccaggggccatgctctgctcctacaggcaacccacatttcttctaacgaggccctttccatggtcaaagccagcgactgcatgtagaagctttttcatgcttcacttggacacccctttcacttataagccagagaacattatctgcttttaaaatgttaataggatgagaataactccacttggataagtctttttgccaccatataagccaacatgctcacaggagtgatatctcatatttacaggtaagagaacttgggttagcatggtagaaaaagttccgttatcatggaaagacttccagtacccttcaatttttttgactgctatccatagcattgaaatgcgttgttctgtgcaatccagaacacaggcacaaacacacacacacacacacacacacacacacacacagagagaaatgtttcaccaaagagtacttatttttactttgtgcaataaatgttattttcaaatgtcttgtatttcattaaaggaaaatattaatttaacttaaaaaatttatgaccaaacctactaatgcattttgttttgttttaaccagattggaaaaggcagtcacttttgtttcactttttggaaacccatttgtaattttgatgttctacaaaactgaactatcaaaattgggattaagataacatctgaagtgagttatatgttctttttaatactaattcatcccattctccttttcacattagtgtctttgtcatgtgcacttaaatttagtttcaatgcgaaaaaagaggcttaggaattccattggtactcacatagctttttccatccaggtaggagcattttattctgtgtaaaacccaccacaatgttcaccagtataaatgatcactaatagtagttattgtgatagtcactcgacggcagctttaaaatctgtgttgcctgaaattaaaagtggccacagaggggagtctctatatatagtattagaattctgccccagtcacaattcttgtgattgttcaacaataaaacaaatattaatgtggtatagtttgtttaatgtcctccaattttcttttagaaatatttttatagatattttgctttaagctatgactttttaatatactcatcacacaactatagctttgcatctaccaaacttgagactgaaacacagctcttttttccaataacgctgtagcctaatgaaaaattggcacagcatgaatctttcaggttccagttaattgttaacttcttgaagaaaccacatttgaccaaccaatcaaaattaaactttccatagcttcctgccccttcccttcttagcactgatcataacctccaacaatatggaattggtgtaattatttctataaggcctttatgcttcatacaaaaaggattgtgtcaattttgcctaataccatgtcaccagcacctagcacaatgcctgacacacggaaggccctcagttaaggtttattcaataaattaatgatgaatatcagcatgaattattttctttattcctcattaagtgtattttgttagagaccttgctaacctgtaggttcatgtgagcttttcctcagagagtgctatggctaatgggcattcatgttactgccacttcaatggaaagcaaccacacatagttatactttgaaagtctacctccacaacttcacaatgataatgttgattttgaaaaacctttccatagctataatttttatggaagaggagaagaaatatcaagctgctaggcaatgtgttctttcttgcatctgtatttcttatgatcatatgattttatatgactgccagtttactcattaacatcaaaagttgctaccacagatattagcctattgcatttcttttgattaagttataaattttttggcaagggtagcattagtgtatagatttgaaagaaaatatgagcgtaataaatagatctcttcatttcattctagcagtttgtattggcaggtgattttgtactcattcatgttctttttcttctgtaataacataattagtgtaatgaagcattgagttatcccttaaagtagaatatgaatgatgcctaactgtaaatagggctcacataccactcaaaatcattatgaatagatgtgaaggcacataattccacctatcttaataaaaatattaatttaacttacaaaatgtatgacctccattaaaaaatcattatatcatgttctaaagtttgatggagataatgcaccttccctaattcactggctcttcattttattattgttattttattgaataataactaccctgcagaaagagaagcctcaaggatgttttgctgatgggatctgaatcaatataacggctttaaatgaattggacatgctcattttacccacatctacttccctgatttttctgaacttaaaagtaaaaatgacccaggtatttgattattttatgttcatttcaagacttaagaatgaaaaaaggtctggcaaccaagatggccaaataggaacagctccagtctacagctcccagcctgagcaatgcagaagacaggtgatttcctcatttccatctgaggtatcaggttaatctcactagggagtgccagacaatgggcgcaggacagtgggtgcagcgcactgtgcgcgagccgaagcacggcgaggcattgcctcactcgggaagcccaaggggtcagggagttccttttcctagtcaaagaaaggggtgacagacggcacctggaaaatcgggtcactcccaccccaatactgcgcttttccgacgggcttaaaaaacagcgcaccaggagattatatcccacacctggctcggagggtcctacgcccacggagtcttgctgattgctagcacagcagtctgagataaaactgcaaggtggcagcgaggctgggggaggggcgaccgccattgcccaggcttgcttaggtaaacaaagcagccgggaagctcgagctgggtggaacccaccacagctcaaggaggcctgcctgactctgtaggctccacccctgggggcagggcacagacaaacaaaaagacagcagtaacctctgcagacttaaatgtcactgtctgacagttttggagagagcagtggttctcccagcacgcagctggagatctgagaacgggcagactgcctcctcaagtgggtccctgacacctgacccccgaacagcctaactgggaggcacccccaagtaggggcagactgacacctcacatggccgggtactcctctgagacaaaacttccagaggaacaatcagatagcagcattcacggttcacgaaaacctgctgttctgcagccactgctgctgataaccaggcaaacagggtctggagtggacctccagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatgggaaaaaacagagcagaaaaactggaaactctaaaaagcagagcacctctcctcatccaaaggaacgcagttcctcaccagcaacggaacaaagctggacggagaatgaccttgacgagttgagagaagaaggcttcagacgatcaaactactccgagctacaggaggaaattcaaaccaaagcaaagaagttaaaaactttgaaaaaaatttagacgaatgtataactagaataaccaatacagagaagtccttaaaggagctgatggagctgaaagccaaggctcaagaactacgtgaagaatgcagaagcctcaggagccgatgcaatcaactggaagaaagggtatcagtgatggaagatgaaatgaatgaaatgaagtgagaagggaagtttagagaaaaaagaataaagagaaacaaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaaaagcaactccaagacacataattgtcagattcaccaaagttgaaatgaaggaaaaaatgttaagggcagccagagagaaaggtcgggttacccacaaagggaagcccatcggactaacagctgatctcttggcagaaactctacaagccagaagagagtgggggccaatattcaacattcttaaagaaaagaattttcaacccagaatttcctatccagccaaactaagcttcataagtgaaggagaaataaaatcttttacagacaagcaaatgctgagagattttgtcaccaccaggcctgccctaaaagagctcctggaggaagcactaaacatggaaaggaacaaccggtaccagccgctgcaaaatcatgccaaattctaaagaccatcgaggctaggaagaaactgcatcaactaatgagcaaaataaccagctaacatcataatgatgggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaagggacggaggaagatctaccaagcaaatggaaaaccaaagaggcaggggttgcaatcctagtctctgataaaacagactttaaaccaacaaagatcaaaagagacaaagaaggccattacttaatggtaaagggatcaattcaacaagaagagctaactatcctaaatatctatgcacccaatacaggagcacccggattcataaagcaagtcctgagtgacctacaaagagacttagactcccacacaataataatgggagactttaacaccccactgtcaacattagacagatcaacaagacagaaagttaacaaggatacccaggaattgaactcagctctgcaccaagaggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaaccagaactcaggattaagaaactcactcaaaaccactcaactacatggaaactgaacaacctgctcctgaatgactactgggtacataaggaaatgaaggcagaaataaagatgttctttgaaaccaatgagagcaaagacacaacataccagaatctctgggacgctttcaaagcagtgagtagaaggaaatttatagcactaaatgcccacaagagaaagcaggaaagatccaaacttgacaccctaacatcacaattaaaagaactagaaaagcaagagcaaacacattcaaaagctagcagaaggcaagaaataacttaaatcagagcagaactgaaggaaatagagacacaaaaaacccttcaaaaaattattgaatccgggagctggttttttgaaaggatcaacaaaattgatagaccactagcaagactaataaagaagaaaagagaagaatcaaatagacacaataaaaaatgataaaggggatatcaccactgatcccacagaaatacaaactaccatcagagaatactacaaacacctctatgcaaataaactagaaaatctagaagaaatggataaattcctcgacacatacaccctcccaagaataaaccaggaagaacttgaatctctgaatagaccaataacagcctctgaaattgtggcaataatcaatagcttatcaagcaaaaagagtccaggaccagatggattcacagctgaattctactggaggtacaaggaggaactggtaccattccttctgaaactattccaatcaatagaaaaagagggaatcctcccaaactcatttgatgacgccagcatcatcctgataccaaagctgggcagagacacaaccaaaaaagagaattttagaccgatatccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaatggaaccaaagtcaaaaaccacatgattatctcaatagatgcagaaaaggcctttgacaaaattcaacaaccttcatgctaaaaactctcaataaattagtactgatgggatgtatctcaaaatagtaagagctatctatgacaaacccacagccaatatcatactgaatgggcaaaaactggaagcattccctttgaaaactggcacaagacagggatgccctctctctccactcctattcaacatagtgttggaagtgctggccaggcaatcaggcaggagaaggaaataaagggtattcaattaggaaaagaggaagtcaaattgtccctgtttgcagatgacatgattgtatatttagaaaaccccattgtctcagccccaaatctccttaagctgataagcaacttcagcaaagtctcaggatacaaaatcaatgtacaaaaatcacaagcattcttatacaccaataacagacaaacggagagccaaatcatgagtgaactcccattcacaattgcttcaaagagaataaaatacctaggaatccaacttataagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacaatattggaaaaaaatactttaaagttcatatggaaccaaaaaagagcccgcattgccaagtcaatcctaaaccaaaagaacaaagctggaggcatcacactacctgacttcaaactatactacaaggctacagtaaccaaaacaacatggtactggcaccaaaacagagatatagatcaatggaacagaacagagccctcagaaataacgcctcatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaaggttagacctaaaaccataaaaaccctagaagaaaacctaggcattaccattcagcacataggcatgggcaaggacttcatgtctaaaacaccaaaagcaatggcaacaaaagccaaaattgacaaatgggatctaattaaactaaagagcttctgcacagcaaaagaaactaccatcagagtgaacagggaacctacagaatgggagaaaattttcgcaacctactcatctgacaaagggctaatatccagaatctacaatgaactcaaacaaatttacaagaaaaaacaaacaactccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatgacaatcattaaaaagtcaggaaacaacaggtgctggagaggatgtggagaaataggaacacttttacactgttggtgggactgtaaactagttcaaccattgtggaagtcagtgtggcaattcctcagggatctggaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcggtaaactattgcaaggaaaaaaaccaaacaccgcatgttctcactcatagttgggaattgaacaatgagaacacacatggacacaggaaggggaacatcacactctggggactgttgtggggtggggggaggggggagggatagcattagtagatatacctaatgctaaatgacgagttaatgggtgcagcacaccagcatggcacatgtatacatatgtaactaacctgcacattgtacacatgtaccctaaaacttacagtataataataatcaaataaaaataataaaaaagaatgaaaaaaatatggtctataaaaatagatttgcataaatacaatctgcagctggcttcattctctttttataatgggttggatcatagcaccatgttgagctaaaatctattgcttttggtaatccagtcaagaaaaaagtagtaaccaacaattacatataaatgacataattttataaagtgaaaatactacatggtaataatttgataaattacttaagaaaatttaagattgtaaggtttgtccagattttttcctatagtttattaaaaataatgaaccaaaacaaaaaatttcaattactattgcatataaagagcaattataatctgtcaatgactacaagccagccatcttaacatcaactgagaacaaaattctaaaaacaaattattcttataactttaagtaaaaaaattgaagaactaatttaagtgcatactatttgtctgcttagaaaatggtaaaatgataggaacttcttaaaggaatttctattcaaaatatcgttgcagacacttagattaaatcaggctgggcatggtgacacatgcctgtagtcccagctacttgagagaaagaggtgagaggatggcttgagcccaggagatcaagactgcagagagctttgatggtgccatggcactccagcctttctcaaaaataaataaataaataaataaaataaaaacaattttaaaaaccatgtttataaacatgtattacaagttcattatttaaatgagactataaaacctaaagatgtaaacatcactttaaaagccttcctacttttttcttgactgatttgccaaaagctgcagattttagctgaggatggtgctacaattcagcttcttttaaagatgaaggtgactagagagtgtacttatgctgaacctgcaactatttcttcactataagaaataatttctccttttacaggccatttattccatattgcaatttatgacttaagtaagtgacttttttctttccctgttcttgtaaattctcagagtgattgtcagtctttctcatttgaatatcatggaaactctaccatttcagttttagtccagtgcaaatacagtctattcagtccttctgatttcaactttgcctatttactatataatagtaaataggcaaaaaaaactttgcctaaatactatgtaatagtatttcaaggtaatactatttagaaaaatgtattataaccgtttttacttggtttgtctcccactctttaatgaagccaaagtaaaaaatccagttaaaataaatttttgctgagagttgttttgttaaaaacatatattatcagagttgcatattaggaaagtaatcaatgttaactattttcattaccaatcatgtcactctgaacataatctcaaaataatcacataattctattggctaattttataaaattcacttactcatgaaatcaacatacccctttattttatcatttgctaatcatttagatttttaagagcaatttcacatactatcaaatttttggccacatatcagattaaacaaaggcacagaaagattaaataagttacccaaatatcatagctaagaagtgaaagttggacttaattttctgtctttggaacccaaagttctatgctccttcaaatgcagcatacatgtgtcttccattaatgacaattaaagtcaacttattccattactgtatgcattttaacctgaaggtttagagacatagagttggtttcctgactcaaaagttttagcattggcctggtgtggtgggtgatacctgtaaatctcagccctactttgggaggccaagatgggaggcttgcttgaggccaggagttcaagaccagcctaggcaacataacaagactctgtagctaaaaaaaaatttttttaaatcaaccaggaatagtgattcatgcctttagtcctacctactaggtaggctgaggtgggagaattgcttgagcccaagaattcgaggttacagtgagctatgatcatgccactgcactccagcttgggtgacagagggagatactacatttttttttaagttttattattattcagcttcatatttaatggaccaaagactttctctggttacttaactatatggcttagagagaaaaggcattctttggcaaatcttaaatgatagttgaatacattattgcttcaaaaaagtcattgctttcaaaacaactaatacaattaaacagtgatagcaatatcaaaggcagtgctatcttgtgaatcacttaggttgatcatagtaagccacagctaaaagctatctcctattattagggtgcacccataaatgtattcttccaccttttttagattttcctttataaaagtcatttctgttattggatgcagagatactcttaactgctatttctttgttgttaattgtggctttcttttatcattaaaaagcgtctttctttttcactcttatttttttaacttcaaatttattttgtcagatatcaagattgctatttgaaacctccctagtcgattattattctgtccagaattttgtaaattatgtgaaattcacaaactatagtaaaataatgatctaggaatattggttgatgggattatctctgtactacttgtttgaataaaaaattggtatgtttttctacagaacaaaattgccatctttaaatttttcctctagtcatggaagtgttaattgtatttaaaaatcactttgttccactgctattgttgtgagtaaattaaatgatcaagaaagcaactgtgagatttaacagagttttgcataaacaacttatgtttgagagtagtcctgccagcatattcctgccagaatttgtccttgtaacagcagacattacatacccatgcagggcttccagacatctaggaattaatacagattttaggacaacgatttctttgcctttcttccttctgttctcttcttccttccttccttttcttattcctcttctccttcatttgctcctttcttcatgcctgcctttctgcctgagttccttctttgaatatttgcagagccaagtgttcagaaatgcattccaaagtagctttctactgcatttaattttgtagtctatgacatttccttcattttctttcacttaaagagaggcaatgagacaattgtcctaacagttatgcataaactagtgagacactgatcatccgtgactcttcgggctttttgctatcagtaaggctcagaatcaaaggactggaaaagaagcaggagactggcttcttatcttggcactgacaaaaattaacattaggacgttgaataagtcatttatctcttctggatcagattccttaactattaaaacagaaagttagaactttgcacggtggcatgtgcctgtggtcccagctcctcaggaagctgagatgggagaatagcttgagcccaggagttccataccaaccgaggcaacatagtgcaaccccgtctctaaacaacaaaactacacaaagcaacagaaacttggatggtcttcaagtaccctctttcaatactgctcatgagagtatgcttattagacatagagattgacaggtacaatgtttaatgtggaaaaatttatagtttcttataaaaataaaagaaccacaataagagatagtgatgaggagtgaaaaaaatgtagatattggagtgcaacacatctaaaattaaatcttgctctgtaacttattagttctatgtggtaattcaacatctcattttatcttttaatctggcattgcattgttttcatagtaaagattaaatgagaaaaatagagtgtttctcacatcacttggtgtataataataaatcagcaaatggaaacaattattatgtatctgtttttaatagtttttcttgttgagccatttccacaggaatgactcaactgagaggagttttttattcccttttctatttatcttagggcaacagatggtggcttagacagtagtacttcccagggtatatcacaatgacagatttagtgacatgaactttatgaagtcctctgctaatagcttctctactgccagaatgcaaggtatcaggccaaaaggtgtgtgggaggctaatgactacgtttccacaaatattggcatgagctggatacttgattcatgagagcaacttcccaatttttggcaagttacctgtaaagaccatttagaaaaatttctggctttctctgagtagcaagtgttttatgaaacctgtagaatttttcaaacctacctaaagtataggcaatataatatgattggctagattatctatggaggcattatattgccaattcttctatctttggctttcattttcttagttgcttgcctatacagatggttttaatttggaccaaaatattttagtaatttaaaataagactttaaaacttgaggaatctttcatgatacaataacaatgattttgtttcagtgccccaatatcagcagattgtagaaaaattaagtatgaatagagaatagtaatgaatatataatcacaaatatgttaggcagtaaccttaaagattgagatagtttgccaaaagcagctcgcatatctttcattcttttacttatagaacagatgaataaaatcttgaaaacatttagacattatactaatttattttaccataaattcttacttaagaaaaaattgataattaatggagagaacaagaatgtaacctctacatgggcagagctctttgccttattcactcatatatccctagtatatagaacattaccaagcacatacttggcattaaataaatgcattgaataagtgaacaataccttgatgaaaacataaactctttgctaatactgccttcctaaatgtgttttttaaaaatcacttaagcatgctttcagaatctgaatcctgccatttatcagaaaaaatagcttaacctctttgaacttcactatttctttttctgtaatatgcatttctgttaacatgaggtaaaactaacttttatcactgtgcctggaacaaagtaggtggacattaactgtttgtggattttgtttcataaacacaatacctgcatttaagaaaatagggtcctataactttaacctagaaattgttatttataaaagaagatttgtatcaattctttatatcaataaaagaagcatatcaattgttattaacaaaagaaaataatggctctttgtgacagtttttaaaatgtagcaatagaagaagcaacgctgcctatgatttactacttaagaacaaatgttcatgatgatgcatataatctatttttcttaagcaaatgcataatttagtcagcatcatatgcagttttgaaaagtaaagcattattatttagatgtcatttctgtgatctcatgaaatatagaatccctggaatgagagaaaagaataaaatattctctttaacatatttcactgcataatataaaaggtctgtaaaattacctgaaaggcaaaggtgtcacaccatacctcagtggtgatttgcaccaaatacactgtctttcataaatttcctgagcaaacagagatttccaatgagaaatgaatactttaatcaatgcaacttttcaacctatttagtccctgatcttgaaaaattatacccagtcatgaaggatggaactaattttgaatttacagagaaactcataacaaatttaaataccataatatgcgtattatatctgcagctgtcagaaaactttatttacagtcagttgcctttctctgaataatcatattgttgtcctgaaagatatttaagacctttgccaaattagaggtatggcctatatttagtgaatcatcatcattgcacctccccagggagagcttagatgagagagctcatgttgtcgtcagctgttgttaagtggaagggatggtactgatccaaagactttaataaattgttattggaaatgtggtttacccaaagaccattgttctcaaaatgtattatcataacatccactggagagaaagtcatcaaagacgaaagatgtctgtaccattttatatgatcaagaaagactaattttttgctatggaaaagacatcatcattattttaggagataattagaataatgtttttgtttgtttgtttttaaaaactggactggtgatgtataaaatgctaaaaataaaaactggattgagtataaaataatgaagtcttctatctttgacaaaactttatatttttcatgctatgtaatctaaaagcatatctcatttgtagttataaattattttaaaaacctttcaaacataaacagtcatagagacaacagtacagtgatcctccataacaccatcatccagattcaataattattaaaattttgcaaccaatctatccctttctctttcccattctcttcgttgaattatttaaaatcatttcacattgcttcagtatctatttctaaaattgtggctatattactgcaaaaccatgatgcaattaccaccccccaaaattttaggaataattccttaatttaataccccagtccatattcaaattttatttatagtctcagaaacatctcatttttttctttttaaaatgtactttaagactggataaaactgtagaacaacatgttgatattttagcaaaattgctacaattggtctatattatagaacaagtctgtgtgatagaaactgtctccacggcactcaagtgagtggaatgatcgtgactgaattctatatatagaatctttcagtgagaagtaaaaacagatgttgtatgaagcatctgatgtttcataaatgggttattttatccaaaatttcagtgatcaatagttcatagattttttatattaggtaagttacttctccctcttgaaaaacgtgaaggaaaatattcaaacattcaaagggctttgaattattatgaaatgattatgaaatgatggtgctttggatggtggttataataaaatgtgtgtagttgtagcacctttcttttcattcctcactctcaaaacacatgcatacacacgtatacacagacacacacatacacacacagagtcatgagcaaaaggatttgaagatttgttagttcgaattttctgacaggttttattttataaattgagttgtacaggaggtactctgagagggtaagttgaagaattctccacaaatctaattagaaaatttaaaaagtgaaaatatattacatgtcatttgtggtctgatattttagctttaattacactgaggggagttataaaataggcatatcagtttcgctaaatattgacaccatctgatataacgtttgtagaactgggacaggaaacactattttcaaagttgtcaaactgaagtactatttttctccataaataaacaaaatggtagaagagtacacaaaaccataaacagattctacctgagaattaaaccactaaagtagaagccaagctttagatagctacaaaactggccattacttcttatacttcacttttctgtaaaatattctaggcagaagattttttaaaataaaatcaccaataaacaattttgtttaaaatttttatgagtctgtgtggtctcctaactctttaagaatgagaaatgtatttaaggattcatttaaggaagtagataaaggcatggtacagaatacctacatattaatttgtgggatgtgtagactgagttatgagaatactcaagttaaaagtcactttcgcattcctttcaaacaaaaggctttgtcaggtgaatgctatgttttatatttaattagcaataacaagtaagatttaattgtaaccaaactcagctatttagaagtatcttgtttgtaaaacagcgtagaataatgtcaacaatttagcaagaaaacccaattcacagcatttcagagcaaaaagggatagaggtcctctattgcaacttctgtgtcatggatgaaaacagtgaggctcaaaaagtttgagtgacacatcaagaagtggtaagagtcaagactagaactcatgtctcctactgcccagcctaatgtcctttatgctaatcacacatatttaacggctagggtgttgaatgatactagaatgaattatacattatataaattattcattatgcaaattaatttttgttgtctcagttttctgtattcatgacatatttgaatttaacaagattcatctggtacttctagctatttctacattttatgagttgtatacattttatatcaataagttataaaacaatagcagaagtcgcttcttttttccagatgagacagcaaaaccagaaactgacccttcaactttgaagtagctttttgtttgtttctttcccctttatataggatgtcttgaagccgagaaggaagagctgttggagagacgaggagttaagagttcattcggctgtccagatgtatccaagtaccctgtgttatttggcaataaatacatctgggcaactgactgaacttttcacttttcatgactcagctggaaccctccacaaccagaagagcctgttataaagtgaaaagtttgtgatctcttaatctaatgaaatgggaagtaggaattgcttgtgggtgaagagacaccattgtaaatgtaagtgggaatgtattttagtatgcaactaaattgatttttaagtgtcttgacaaaagataaagaggatttttctagcttgcaaaattaaaatcaaattaacagaaaattttgatctgctcccatcagtgacacttgtcgtgtacttaactcaccggtataaaataactattttatactgtgatggagagtagctggcaaatgctggcaaatattatttgtatattacaatatttaaaagatgtctaacctcaagctatggctatgtacatggatccatctaatgtatttaccccaatcactctttatctcatgatgcaatttcattttattcatagcaattatcacgatttgaaattatcctacatctttgtttaaatgtttattttctgtatctccagctagaatgtaagctccattggagcaggggcctggtttaccttgtttactactacatgcccagcatctggcatagtgcctggcatgtaataagcaatcgataaatatttgaatatatgaaactactattatacagcttttggtcctgcagatcggttggagttggtctccaacacagatatttagcatatggtttgctccattagctctgctctttgaaaaccttcagtttgttgtgctatgtgcatactaacactgagataattcccagatagttctgctaccacctatggagaaagcagtttcaaattgctgggcattctgcccactaaggcaaattctctccatgtctgttactaccatcatagagtgatttgcaatagctactttaagtctatcaattgggaagtgtatgtttttaaagtattattttatgtaaatggaataggtctagctgtgaaaaacataattttatatgctgtagattttgagttaactgttgtgtgaattcgcacataatttaacaataatcacgctcatggaacatgtcaaacacaagcagaggtatttagtaaatacaaatgaggagaaaaaaatttttttttccatttgaattccaagcataggaggaacaggtaaatctgtttaaataaccacttaacattatcttggaggagagagaataaaagtaatgagcctagacttgcattcaaattgaataatcactggtggaagagtagtctttaatttcattgatgataataactgaaaaactttctatcaaaataataaaaattatctgatttgactataattagcaaaggtgagtttttagtatgacaaatgtatgatttattagaaaatcgctagagtacatttgaagttgaaaggaaaacttcctacaatattcattagtcctaaggataatttttgaattaaatgagctcccccaaaattattgtaaatctgtgccacattaatataatcttcccaggactaatctgaacatttatggctaattcatttttgatttagacatctgctaaaagctcactgggtataataactagagggataatatttgaattatgagtcataatttctgaacactgaaaattgataaaaatcaaacttctatatgtattattatttattcaatttttaaatgctttgttataaaaagtgagacagaagtgatctagttgactatattctacaatttcttttttttttgagacagggtctgttgccctagctggagtagaatgatgtgatcagggctcactgcagcctcgaccacctgagttcaagggatcctcccacctcagcctctcaagtagctaggaccagaggcacacgccaccacatctggctaattttttgtattttttgtagacatggggttttgccattttgtccaggctggtcttgaactcctgagctcaagcaatccacccactccggcctcccaaagtgctgggattataggcgtgagccatcgcacatggtctattctacaatttaaaaaaatttagtgtgaaatttagtctttcagtttgatagaaaatatgctgcatcattataatgtgctaacggaatttccagaaatctagtgtaaactataccttttcatgggtgaatctagactctccaatttttgttaaaacatgagtagaaatgctggcattttttcttaagactcatcaatattatcttcaaccaggtctgggaaaaaaagaataaaaagtagtgtgagagcagaaaacgtgattgaaacacgaccaatctttcttcagtgccaaagggtggaaaaggtaatggtaaaaatgaattataaatggttagctttagaagttgcaaggcaagcgttttcaataaagatgcaagcttctatcctctccaagcacaatttgggcaaaaccacagctcttcctttattcttagatagtatcttttgacttcacaccttaaatctcctaccttcccatcaatcagccaattactttgtacccaggacttggccaaggattgtggatgttacatggaaagtacatctatatggctcttctgctcaaaatttgcctttagtattaatacaacacctttaaaaagccttgttcgtgccagcctttgtgccccacagttttttgttttctttgattttgttaatattttttgagacagggtctcactgtgtcacccagactgaagtgcagtggtgcgatcacggctcactgctgctgccacctgctggcctcaagccatcctcccacctcagtccccaagcccaccccacagtagctgggactacaggcccgcaccatcacatggggctgattttttttgcagagatggcgtcttgctctgtcccatagtttttaaacttattttttaaaattatttttgcttccaaggtgattattgatgatgacttttaagtatttctgtgagtgatacggattctgatagtttgcaatttatttccaaatttccagtggagattcgattttggttcagttgttttggagtgttcacactattttggatgacatatgctgtatgacacatggcatatagccatataagcatagatttcataggcatgaattaaatataatactcatggtatggattcatacttaattaaattttcacattaattgaggttattctgcaatatcttgtgtaaaattgtactattgaaaattatgtgaaaactaatgtttctcccccatttgtcttagcaactgtagttactgttattgatgtctgaagattttacagtgctttagagaaggcatgaaaagatctgtgatttacactgtagaaaggattgagagattggtctgagtgtgtatttagtgactagtgatcctgatcttatttctatgatttaatctgtgattttctcttcatacttgagacagctaattggttttaagttaatcaatctttttctggacacgaaattataaatatgtatgactacacaaagtaacacagaaacacacaaatgttatataagttggttgtaattataaattatattaattttatataattatatatataatataatataaattatattaatattaatattaatatttaatatatataatataatataatataataataatataaaataaataaataaaataatataataatattaataatataattataattataaattataacacttattaaattatcaaacctactttcaaggcaaatattataaaatctcattaaaaattagtcaattattccgtcaattatctcacaagtgattttaaaaaaattttacaaaacacaatccttcacaaatttgaaaacttgaatttataagcattcttttgtgttcatgcaactttaaaagttccattacacagatcagaaagttccatatatgcatatcagaaagtttcattagagttgtttcgctatgtttttcagtttctgttattgattgatcttatccaagacaagaagttttgcatcaccttcccttttagtagaattactcacagaacatttcttattgcaaaatatcatcatcacagtggcctggccatttggggaaacatgtaagataacataatttatgttacataattcatataatttattcccatcacaccatgttccgaaactcttaccaccagttcacaggtattttctatcatgtctactcagtgttcatgcaaattttaacagcatgaggagacatgattttgcctacaagtcatttttgttaataaattggaaatctatatacataatattttttgtgattattactcattcttctcaataaaattggaacttagaaaaataaatatttgatgtttaatttttctgcttatatttctcaggaatatacatgtaaaaaagcataaggaagctggctaatttttaaaggaatataatattttgagtaacagtaatggaattcatccatagctaaaaatgtggctaataaagtgcttcatgagatgattattgtatcagcttgttttgttatactctattggagcacagcatatttcactctatctttgaacctttaaaaattatactaatatttggatacataaaaataaatattgaaaatcattttaatacttttagcataaggaaaaaggaaaaagtttgatacttattgagggctaagaagcaggatgggaccttttggtttcccttaccattttttctgtcacttattttcagacctcccagagaaagagatgtctgtgttgtctggtaaaatttatgggacagtattggcctgactaatggtcagggtgatatagctctctctctctcacacagaatattttgagttcctagatattggaaggccatattttatgtattacggtagtaaggggatgatttggagattgatttttgtgtaggtagcactgatagaactgataaatgagagctaagggatgaagaagggagaaaatattaactatgtatcttgagtgacaaggatagtgctattaaatgagatggaaaacacagggagatgtgatttcttctggttaaattttacttccaaatttctagaaggagctagaagcacactaaagaaagcttatcaagacagattttcacgatcatatttctttttcttttttttttttaattatactttaagttttagggtacatgtgcacattgtgcaggttagttacatatgtatacatgtgccatgctggtgtgctgcacccactaactcgtcatcgagcattaggtatatctcccaatgctatccctcccccctccccccaccccaccacagtccccagagtgtgatattccccttcctgtgtccatgtgatctcattgttcaattcccacctatgagtgagaatatgcagtgtttggttttttgttcttgtgatagtttacagagaatgatgatttccaatttcatccatgtccctacaaaggacatgaactcatcattttttatggctgcatagtattccatggtgtatatgtgccacattttcttagtccagtctatcattgttggacatttgggttggttccaagtctttgctattgtgaataatgccgcaataaacatacgtgtgcgtgtgtctttatagcagcatgatttatagtcatttgggtatatacccagtaatgggatggctgggtcaaatggtatttccagttctagatccctgaggaatcgccacactgacttccacaatggttgaattagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttaagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtgctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccgtttattaaatagggaatcctttccccatttcttatttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtatttttttccaatattgtgaagaaagtcattggtagcttgatggggatggcattgaatctgtaaattaccttgggcagtatggccattttcacgatattgattcttcctacctatgagcatagaatgttcttccatttgtttgtatcctcttttatttctttgagcagtggtttgtagttctccttgaagaggtccttcacatcccttgtaagttggattcctaggtattttattctctttgaagcagttgtgaatgggagttcacttatgatttggctctctgtctgttattggtgtataagaatgcttgtgatttttgcacattgattttgtatcctgagactttgctgaagttgcttatcagcttaaggggatttggggctgagacaatggggttttctaaatatacaatcatgtcatctgcaaacagggacaatttgacgtcctcttttcctaattgaataccctttatttccttctcctgcctgatcgccctggccagcacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgcgagtttttagcatgaaggattgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatatcggtctaaaattctcttttttggttgtgtctctgcccagctttggtatcaggatgatgctggcctcatcaaatgagttagggaggattccctctttttctattgattggaatagtttcagaaggaatggtaccagttcctccttgtacctctggtagaatttggctgtgaatccatctggtcctggactctttttgcttggtaagctattgattattgccacaatttcagaggctgttattggtctattcagagattcaagttcttcctagtttagtcttgggagagtgtatgtgtcgaggaatttatccatttcttctagattttctagtttatttgcatagaggtgtttgtagtattctctgatggtagtttgtatttctgtgggatcagtggtaatatcccctttgtcattttttattgcgtctatttgattcttctctctttttttctttattagtcttgctagtggtctatcaattttgttgatcctttcaaaaaaccagctcccggattcaataattttttgaagggttttttgtgtctctatttccttcagttctgctctgatttaagttatttcttgccttctgctagcttttgaatgtgtttgctcttgcttttctagttcttttaattgtgatgttagggtgtcaagtttggatctttcctgctttctcttgtgggcacttagtgctataaatttccctctacacactgctttgaatgcgtcccagagattctggtatgttgtgtctttgctctcattggtttcaaagaacatctttatgtctgccttcatttccttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtcctcttggtgtagagctgagttcaattcctgggtatccttgttgactttctgtctcattgatatgtctaatgttgacagtggggtgttaaagtcctccattattattgtgtgggagtctaagtctctttgtaggtcactcaggacttgctttatgaatccgggtgctcctgtattggttgcatagatatttaggatagttagctcttcttgttgaattgatccctttaccattaagtaatggccttctttgtctcttttgatctttgttggtttaaagtctgttttatcagagactcggattgcaacccctgcctttttggttttccatttgcttggtagatcttcctccatccttttattttgagcctatgtgtgtctctgcacgtgagatgggtttcctgaatgcaacacactgatgggtcttgactctttatccaatttgccagtctgtgtcttttaattggagcatttagtccatttacatttaaagttaatattgttatgtgtgactttgatcctgtcattatgatgttagctggttattttgcttgatagttgatgcagtttcttcctagtcttgatggtctttacaatttggcatgattttgcaatggctggtaccggttgttcctttccatgtttagcccttccttcaggagctcttttagggcaggactgatggtgacaaagtctctcagcatttgcttgcctgtaaagtattttatttctccttcacttatgaagcttagtttggctggatatgaaattctgggttgaaaattcctttctttaagaatgttgaatattggtccccattctcttctggcttgtagagtttctgccaagagatctgctgttagtctgatgggcttccctttgagagtaacccgacctttctctctggctgcctttaacattttttccttcatttcaactttggtgaatctgacaagtgtgtgtcttagagttgctcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagaggtagatttggtcttttcacatagtcccatatttcttggaggctttgttggtttctttttattcttttttctctaaacttcccttctcgcttcatttcattcatttcatcttccatcactgataccctttcttccagttgattgcatcggctcctgaggcttctgcattcttcacgtagttcttgagccttggctttcagctccatcagctcctttaaggacttctctgtattggttattctagttatacattcttctaaatttttttcaaagttttcaacttctttgcctttggtttgaatttcctcccgtagctcagagtaatttgatcgtctggagccttcttctctcagctcgtcaaagtcattctccatccagctttcttccattgctggtgaggaactgcgttcctttggaggaggagaggcgctctgcattttagagtttccagtttttctactctgttttttcccatctttgtggttttatctacttttggtctttgatgatggtgatgtacagatgggtttttggtgtggatgtcctttctgtctgttagttttccttctaacagacaggaccctcagctgcaggtcttttggagtacccggccgtgtgaggtgtcagtctgcccctgctagggggtgcctcccagttaggctgctcaggggtcaggggtcaggaacccacctgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggttccacccagttcgagcttccgggctgctttgtttacctaagcaagcctgggcaatggcgggcgcccctcccccagcctcactgccaccttgcagtttgatctcagactgctgtgctagcaatcagtgagactccgtgggcataggaccctcggaaccaggtgcaggatataatctcctggtgcgccgttttttaagcctgttggaaaagcgcagtattggggtgggagtgacccgattttccaggtgccgtctgtcacccctttgtttgactaggaaagggaactccctgaccccttgcacttcccaagtgaggcaatgcctcgccctgcttcggctcgcgcacggtgcgtgcacccactgacctgcgcccactgtctggcactccctagtgagatgaacccggtatctcagatggaaatgcagaaatcacccttcttctgcgtcgctcacgctgggagctgtagaccggagctgttcctcttcggccatcttgagaagtttttgaagaatatattcttaatttctttttcaaagcattgatttgaagccatgtctactccaagagggggaaatttggtataaaccatgtataaataaaacatatacagaaaatttttaaaaactgcgatgataaataattgaaaaatctgctctctttgccatattttatcacttacacagtataacatgcttacctgtttgctgaattaataactgtttcttatcaccattaagtgcatttaagtttatttaattggttactatgcaagttatttcgatgtttaactaattttctctttcttctttttctctccccagaaaggatgatatgatgaacctagcctgttaatttcgtcttctcaattttaaactttggttgcttaagactgaagcaatcatggtgaacctgaggaatgcggtgcattcattcctgtaaggatgttactacttattattttagtgaaaagataactttgcttggtagcttgctcaacatgttaaaaaaatgcttctatatgatcagctatatttgcctaaatctgcataaatggcttgcttcccaaaagactaatattatgggtgtttcctattcaaaaataattaatggaaaaaaaaatttggactctaattaagcacttgagctcatatacttaaacaagtaatatggtgataatgccctaaattcaaataatctcaatgttcatggctactttttccatgggtaaaacttagaaaggaaaaatttctgtccttttccttcttgcatgaactgaacagttaagagaatgaaatgcctctggttttgtgaagaatagttgaggtaggaaaagaaaaggttggaagttaggggatagggcttggcgatgtagctggatgggaaaaaccaatgtcatcctcagaagtattgatgcagtgacccagttgcagccaataatatacaacataaagggtgtaggtaaagatacaggagattcaaataataagcaattctaaatttgatctaatccaggtataccttctttttacatagaaaaatgttggtttcttccgaacctgctttttgaggaacgaagcatagaaaaaaatgatccaaagcaatgtaaactctgattggtatagttgagaaaccccaaatctccttgctcctaggtagtctcctttatgattcttgtaaaagagctcacccaggaaaaagtttacaatgtggtggagatataaagttcagcaacattggatcctctgcagtgtgcatcactgtggcccatcttgagtgtcattgttgtgatgatagtttcaagtatggaagagtccaagagaactagagcagacaactgggaaagaaaagagtgaaggacagtgataaagaagggaaaagaagagttgggtatgggaaaatgaaaggacaagtgttcctgctccatgagcctgtgccaacttagtatatagccattggcccatataccaaagtgtaggactgccgtaaagggcaccaaattattctgctatgaaattaattaaagaattcatatacaattgttttaaattctattgagagaaacaaggaagaattcctgtcttctaacaatgtcctaggtcatagaaaaactcagtagattttaaatatattcaactttttaaattaaattatcattttgtttatatactaagaatgtaaagttatgttttcattaaaactttagtagcaatgagtaaattatatgcatttcagagagaaattatgacttttgtatacatattttatgagattcctatgagcttaaaaacaattaggataaactttaagagcaagacctaaattactcctcttttgtaaaaggactttataatttcactgagcatgttaagtattaaaaattagatttaattataatacagccaattcttcattacaaaactgaagaataaaggattaaactttaataaaaatcataatatcttgtctataagtagtgctcaataaaaatttattaaactgaatttaattgaaaccaggaaagtgaagtaaatactttatcaagatttatcctaacaccattaccttattttgtaattcacaacagatatgtttacatctgacaagactccttccttcaataattcagtatttgtcttacagattcttttattaaaaaaaaattttctgaccagtagggataggctagataactacttgaaacagtccaaactcaaagatactcaaattataaaattcataatttgacataattttcttcgtatatgtttctgttatatataatttgtcctgtactcctctaccatttttagagacatatgaatgaatttcgatgttttcacaatttacttagaacatttgaggcagactgcatattcccctaggaccttattctataggtttaaggataaatgtatttgtcattctgcaatcaacaactgaagacgcagtttagtatttgagataaattcttgtgggactacttgagatgatcttcagctaatttaaaacagaacattgttttttaaaatgccagcaggacaagttttttatcagctaggccagaaaggactctggaaaacgtgctggatttaagattacttttttgagtccagttcttcacacatagacatcgtctcaaaataaaatcaagacttaaattatcctggcaaattttgaaatacatgagttgggatatagcaaacataaaatacttttgtttaactacaaagcagacagaaggtacctccagcatttactgagggcctcttatgacacaggtattaaaggttgacatatatcatttaattttcacaacaaccatatgatggagattgttcttgtacagatgaagttgatgttctgataggttaagtgactggtcaaaaattactgaagtcagatagccaggacattggccacatgccacattcaataaatacagtgacagagtaatcaaagctgagagcgaataacttgcttctgtttatttggtcctttatttcactaatttttactcatattaatcacagattaattatgacatagattttggaatcctgtattatttttgcctattttttatgttttgggaaaataatacatttggaagaatttactgattacttctcatcatttgataagaattacgatttctctgataatggtagtcagcaatgagtccattaaatcacacatatattatccctgcctggagatactatcttcagttcaaagaacaagtgactgggataatgacataaaaatacataatatggggaacacatagactctgaatgttatgtcatgtgttccatctccctaatttcagaaagaatcatccttcaactatcttgcatagaaaattatgtagcatatattgtgcaaccagaggcaatttcctcctctataaataatatcaaggttgaacaaccactacatataggaaatgtatcctcatgttgctgtttaacattaattaaataactattactacacatggaataaacataaatcagtcattcacaggtaatatttcttagttttaagcaggaaatattgaacatgcttggctgtcttgtctattttatgaaggaaaaaatgtgtagctttattagacattttaggagcttacactttgagagaatacttatgtacataactcgaataaatctcatgtcgccatagggggatattaatttagaatgtgcaaatgacaaccacatccatctctggcaatagcctgccacctggcctgaaattcctactggtagaatctaccaaaggaccatcatgagaaatgtacatttctaatgtacttaaatgacttaagagatttagttccagtgcatgaaaagtaacaaatccataggcattaatcatcaccacaaatcattatctagcctagaacaaggcccacaaaatataagacaagacagaaatgtggagagtggcaggtagaaggaaagtttatagcacaaaacgttaagaaacaattgaaccagcataatggcactttgcaaatgtgagaaggtagaaaaacttctgaaaagaaatgaaagggtattcttgtcaaaacccactgtacctcttccagacgctttgccagaatttgatctgatggcaacttaattccttcttagccttggatcaatagaatgcaacttccagtttccttgttagggtcatggatgctttaagaaaatcccccttcattctgttatcagctgtctcagaacatatctaaaggaatcagtattttaaaaatataaagaatagactattacagcaaatcaagcagtactgtggtttcagatcgcagtaaaagtttaaaacatagactttgaaatcagtgggacctgagtatggaccctggccccaccacttactggctgtttaggcttgaaaaagttacttaccctttctgaactttactcagtcttctcatctacgtgatggatataaattagaactgacatcatgaggttgtttaataagatcaaatgagattatacatatatgtttcagcaaactaagtgcctaactcataataatcactcaataaaagttggtaatttttggagagaaagaagaaatactgagattaattaagagagtagaaataatgatgatgacaatgatgctgatgatgataatgatgacaatgatccatgaagaagcagttgttttgcatgagcaacgtattgtgtataagtaatataatatgtacctgattgtttttttttttcttaattttcagtgtgcacctaattggcctattggtttggcaatgtgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatggtaagtacaattttattcacttttcaatctcgtataatgtcataaatttgtgtcatagtaaacactcataaagttaattattttacttgtaacatttggaaaaagaaaaaagcaaatcgtgtgacagaaggagttggatgtatgtatcatatttattaaacaaatcagtaacagtcttccaaaagcaaaacatacattttatatatattaaaatcatacatagatgctctcttgcttagtgtctttgtaaacaatgaatgaacagttagttgccttacaatgtactgaatgagacattaacagaaacatctttcaacccctgtgttctgggcagtacacatacctactaccatctctgatacaaagaaggaaaaaccggctcatcctctttaataaatatattttaagaaatccttttttaaagctgccaaactaagtggttgacacaaaacaggcactcaataatagctattcttcttgttcatggagtctataatttgtgttattacaaagagacaagagatagcaaaattaattactaagtatataagtgtaagttcatatcatcactttaaaaattcaggcattgaaagtttcaatatattgattttaaagaggtttttaatttttcttttgattttcttccatcccttcattctgttcattttaacctaaggttttgtttctagctaatatttatgatgaacaatcaaatagtttatacaactctacaaagtatctttactaggaagttggagagcccagtttgaatttaattgctaatatgcttatctcacaaaggagtaaaatagacttccagttgcctggagtgtataatggaattagactagaagaaataatattgaaagtgtatctagttgtcgaatcctaaaagaaaataaatgcatctagaaaataatctctcatgtaatgtaaaaattaagtagcctgttctatacctatggcaacagtagattatcttaataggcattttataaagtgttctcagaatatatgcttttcatattcttcatcgagtttcaatgatgcattagccttaaagcactagtattttatctgctcagtgggcattttaccactctattgctccaaaattaagaaaagattactggaatgaagtgaaactatgatttagaaggtatactgtgttctgtggtgtctgtttcgccagcttctccctttaaaaaaatgtgagtggccaaataatgatattagcataaatccaagtctcttaacatatctattcccctgcccaaataaacaaagaacaatataaaaaacaaataaaactgcacaataccaccattaagtgtggagaacattcaaatttcaaattacctgtaagtaggaaaacaaatgggaaataacattgaactatctattagacttctaccccatgctgttgcgtagaagaagagtagtccaggaaagatagcatgaaataaactagaggaaagctattaggaagcctaagattgatctaaaaccaccacaggtggccgggcgcggttactcacgcctgtaatcctagcactttgggaggcccaggctggcggatcacttgaggtcaggagcttgaaaccagcctggccaacagggtgaaacccagtctctgctgaaaatacaaaaaaattagccgggcgtggtggtgggcgcctgtaatcccaactactcgggaggctgaggcaggagaattgcttgaacctgggaggcagaggttgcagcaactcgagatcacaacactgcactctagcttgggcgacagagcaatactccataaaaaaattaaaaaaaaaaaccaccacaagcaagtaagtctaccccaagtacgaaaatactgaaaagtttctctagaaggtcagctttcagataaggtactgaaaagtatgcataagactcaagaaagcagccttggaaaattaactctttggaggtggaaaaaggtaaaaaaggaagcaagaggtgacttgaaaaaaaaaaagcacagtgaaaggaaaaagaagcaagagggggaaatttatcatcttacagtacagaaaatgtcaaaatattaggacccatcacccctccctctactgtctcccactgtcccccaaaggccctccagtaaagaaaccatactttgatacacaaagaaaagaggatgctcttgagcttggaattttggaagctacctacaaactgtcagtcatgttcatagaaattctgagatgcaaccaatcttcatctataccaagctactatagaaaaaaatcagaatatgagaatagaaagaaggcatttgatgaacattccctccaatacagaatgatcaagccgaagaatatgctagcaaaacacttcaaaaaaaatctgcaaacaagcatgttaaggtattaaaaaatgtactttgaagtagtaatctaataactaagaatagaaatggtcaaaaaaataggacagcatgaaggaaaattaactgaattcaggacaaataaaatagaagaaaaatacatcatatcaggaatgaacataaaaagcacccaacgaagaattgattcatatgaagcttaataaggagtatagaagaaaaacagattaccaaagagaatgaagatgagacgaagaaagaagtaaaatatgttagagtgtggttgaaatagaatatcagcaaaaatgattaaatgtatgtatgagaacccttgaaaaggaacaaataggaaaacagaattaatatttaaaactataatccaataatgtcttccagatatgaaagagagtctgactctacatattgataggttcaacccagtgctagaaaattgacctgaaacaatgaactctgagataaatctgagacactggatttttcaatataaagaaaaaatcctcagggtttccaaagcaaaaagagggaaaaatttacaagagcaagagtgttagactgccttacatgtaaaaaaaaaaaaaaaaaaaaagacaaaacaaagcaatagtgaaacaatactatcaaaacacaaccatttataggacattctttgaaagacaaatctatacagacagaaaacagatcaatagtttcaatggctgaaagtgggaagatgacttcaaaaagccatttattttgttattatgaaactgttttatatcttgattgtggtgatggttatacaaatatatatatataaatttgaagagctataaattctagtatacagttttaaaaaggtgaattttactctatataatagatgccataaatttaaaaatatttttaaatacacaaaatggtttggaaatatgattctatgtctagacaagttgtccattaaggctataaaaagtttaagtcttttaaaattcagggaattatgtaccacaagcccttttaaaaaataaaatagtggaggtcaggtgtggtggctcatgcctttaatctcagcactttgggaggcctaggcgggcggatcacttgtggtcaagagttcgagaccagcctggccaaccggatttctttagtagagacccagtatctactaaaaatacaaaaaaattatctgggtatggtgctgcctgcccgtaatctcagttccttgggagactgaggcaggagaatcgcttgaacccaggaggcggaggttgtagttagccaagattgagccactgcaatccagcttgggcgacagagggagattccatctcaaataaaataaaatagaataaaataaaattacaaaataaagcaaaataaaatagtggatgggattcatctaacaaagggatgactgggaaagtttcatcaaaaagactgatgataaacatttaatatatttaactttagagctaaaataaaagaaatggtattttaagagcagaaaaataccatgtcatataatatatattatgttttatctgttctaacaatctggaaacaatgcaaccaaaaattaggaagagaaagaggaaggggaagaggagagtagaatcatttcgttgattcttctataaacgaatgataagaattaaattataaccataaaaaactggcaaatcagaaagtaatagaattaataagaaaacatgggtctagggtcattaagcatgttataaatataaagttaaccactagaacaaaaatacacacgttcttaaacaccaaaggaaatgtaattagtagaagagccaaaatcagtcaaatagaggaagaaatagaagaaaataaggctgggcgtggtggctcacgcctgtaatcagcactttgggaggccgaggtgggcagatcacgaggtcaggagatccagaccatcctggttaacatggtgaaacaccgtctctactaaaaatacaaaaaaaatagccaggtgtggtggtgggcacctgtggtcccagctactcgggaggttgaggcaggagaacggtgtgaacctgggaggcggagcttgcagtgagccgagatcgcgccactgcactccagcctgggcggcagagcgagactctatttcaaaaaaaaaaaagagaaaagaaaacataatgcacttaacattatatgatgatataatatgacagagttaaaatcaaacatatcagtaagtaataatcataaactcgaatgaagaagctatcactctattaaacataaaagatttttaattaggcatatgaagaaagacccaagtatattccatatacaaaagtaacccttacaacccagggattagtaagcgctaaaaataaaggggtaggtgaaaagtataccaagcaaatggtaacaataaagcagaaattgcgatcttgatatctgacaaaagaaatttgaagtaaaaaaatggtaagactaaaaaagaaagatgcttattaatgataaaagaaagccacaattaaagacaaagaaatggcagttaagaatatctctgcatccaataacacagaaatgacttttataaaggaaaatctaaaaacggtggaagaatacatttatgggtgcattctaatatgggagattttaatatactgtactcagtacaagaaagactggaccaaaaacaaagaatatatatcttatgaatgtatattgaactttacactcttatcgtagaaagtatagcttcttaagtgcacatgaagtacgcaaaatttaatcatatattaggtcacaagaaaaggttaaagtagaaattttataaaaagttctttttgataacaatgtaataatactagaaagtactaacaacaaaagctttaatatcatcttggaaccataaattttaaacagctcttgggtgaaaagaagaatgcaaacagaaattaccaaatttattttaaaatatgatagcataaacactgctttatcaaaatctataggatacacataaaggagtgaacagaggaacattcacaattccaattacatttattagtaaaaaaccaaagtatatgaataaatttccattaaataatcttgaaaaaggaccaaaaaagagaacaaaagaaagcacaaagcagaaaaaaaaaataataaagataagagcagtaattgactgggtagagaacagtagagaataaaaggacagtatacctaatcaagaaattaaactcctggcttttttttcttttcttttcttttctttttttttttgagatggggtctcgctctgtcacctaggctggagtgcagtggtacgatctcggctcactgcaactttcgcctcctgggttcgagtgattctcccacctcagcctcctgcgtagctgggattacacacgtgcaccgccacactcggctaattttttatgtttttggtagagacggggtttcacaatgttggccaggccactcctgacctcaagtgatccgcccgcctcagtctcccaaagtgctatgattacaggcgtgagccagcgcgccagggcactcctgactttttaaaagatttttcacaaaatagaaaattgctagctagttttaacaaggaaaaaggaatagagcataaatatatcaaatataatatgagagggcatataatcatagaaaaaaataaattttgtaaatcacaagattaccttgtagatttacatgcaaatcaatggaaaacataaaaaatagataatttatcagaggaatccaggttaacaaaattgaccccatgagatataaaaggaaacagaccaatttcagtagaagaaatagttatcaaggaaacttgcacaaaaatccctccggactcaaatagtttcactgggctcttctagttataatgcttcaaaaattgtttcagagcattgaaaacaaagtgaaacttcctaaggtttatatgaagtgagaataactttgatacataaaccaggtaaagacagtatgaagaaaggatgctatagaccaatgtcacttatgactattaatgcaaaaatactttataaaatcttagcacacagaatccaatgtcatgtgaattgaaaaaactcaaagttgtagaagcagagagtagaacagtgtcttccagaggctggggtgatatggggtggggaagggagataggaattgttgtcaaagagtacagtttcagttagacatggtgaataaattctggagacctattattgtacagtataatgacaatgcttaataatattgtattgcatgcttgaaattgttaacagtaggtcctaaatgttccagtctcaaaaaaatgtatgttaggtggtggatatgttaattagcttgatctaatcatttcacaatgcatagatatgtcaaaatatcacaatatacaccataaatgtatactaattttaattgtcaattataacttaagaaaactgaaataaaaaagaatccaactccacattaaaaaagaatacaccacgaccaactgggtggtcacactattattactattctagtaacattgtgttactagtaacacaggaacagaaaaccaaacaccacatgttctcactcataagtgggagttgaacaatgagaacacatggacacagggaggggaacatcacacaccggggcctgttggggcatagagggggcaatgggagggagagcattaagacaaaacctaatgcatgcagggcttaaaacctggatgatgggttgatgggtgcaggaaaccaccacaggacatgtatacctatgtaacaaacctgcacattcttcgcatgtatcccagaacttaaagtagaaaatatatgtatatatacacacaccatgaccaactgggtggtcacactattattctagtaacactatgttggctcaatatagggaaatattttcctaaaatatattaacatatgacattaacattattactaataagcacatattaaaaattaaagctaaaatataatgaatattgataattatattaatacattattatatttataacattaacataaaaatattaatttaaaagtatatgatttatctctaaagatactgagtgaataaacatttgccaaaatttatagcttttttgataaaaatccctcaagaatatagaaattgatattacttttttactgtgataaaagataaataactttgtcagacagctggcatcttagttcataggaaaacaataaaagcacttgttctaagatcaggaaaaatatgagcatgccttatgtttccatttccacttaacattttgctgtagatattagtcaatgcagttagataagataaattaattagagttataaaaactgaacaagtataaccatctctttttccagtgtatctcacacttcataagaaaatcaggataaaactattaaaaaataagatattcagtgagatagcaggatgtaacattagcatggaaaggtctatagaattaatatacccaaataaccagttggagaaacctccatttaaaatagcaaggaaaagagaatacattaaggagaaaatatgcaaaatctattgttaggaaaaattaaaaacacccctaaaagacaaatgattgatatcattggcataacaacaataataataataacaataatacatgccaaacaccaaaagcaaacttcaaaaacaaactcatagaaaatagttgcaaaatatattgcaaagggctaatatctctaatacataaacaattctttataactgaagtagaaatccagcactcaatagaagaaatgaactaaagatgtgagtaggcaatttggattttttaaatatattttataggccaggtgcggcagctcacacctataatcccagcactttgggaggctgaggcaggtggatcacttgagcccaggagtttgagaacagtctgggcaacatagtgaaaccccagtctctccaacaacaacaacaaaattagccaagggtggtggcgggcacctgtagtctcagctacttgggaggctgagatgggaggatggcttgagccctggaggctgaggctacagtaagccattttcatgccactacactccagcctgggtgacagccaaaccctctctctctctctcaaaaatatatattttaaatatatatataaacatgtgtgaatatttgaattatatatatacacatttatatatatatatatggtccttaaatacatgaaaatatgtttaatctcaatcattagaaggaaaatgcaaaataaatgacaccatgataccattttttaacctatcagattggcaaaatatgacaagcttgaattgcactgtggcaaggctatggggacatcagcactctcgtatattgctggtgggaatgtcaattgctacaaaccattttggaggaaaatctgacaacactgaaaaaaactacataagtaattatgttttaactcagaaaactaacatctaaagtgttcactggatgataaacgtgtgttaatagcaacatatatatgtgtgagattattcatataagcattatttgtaattgcaaaatattctaaacaatctaagttctatatagagagagattaattaaatatattacagactatccacaaaatgggatttattttttaaaataaggaatttctttattacctgatacagattataaacagaatccaaataacttaattctatttgaaactaataacataaccacactgaagtacaaaaaaatctgacccaaataactttaatacacaatatttgtacaatatacattctgtctaaatataaataaactctaaatagtaggtttgctttttattggtgttatgcaatagtgattgtataacaccaccaatattgttagtgtactctgagattgtataagtgtgtaggtataccaaagacaatagaagccagatttctcactgttgcataaggtagttaaaaattcgaaagggggaaggaaataatgaactctacatcattggactaatattcatgatatccgtgtaaattcatagtggtagtaggtgatagttagctagctagctagctagagagataacataatatttatatgtatactttgaattatgtcctagtctgtccactaagagggcctagcagcagtgtcacatgcgtagcaatgagcgaaaacagaaacagaaactccttggggaaatagtcaatttcaggaatgggacagaaaaattacagcatgagattgggagggccgggcacggtggctcatgcctgtaatcccagcactttgggaggctgaagcaggcagatcacgaggtcaggagatacagaccagccaggccaatatggtgaaaccccatctctattaaaaatataaaaattagccaggcgtggtgacacacgcctgtagtcccagctactcaggagactgaggcagaattgcttgaacccgagaggcggaggttgcagtgagccaagagctgagattgcaccactgcactccagcttgggcgacagagcaagacgactccgtctaaaaaaaaaaaaaaaaaaaaaaaaaaaaaaaaaaaaaaaaaaaaaaaaaaaaaaatatgagattggaacaccttttcagctgaaaagtaaggaagtgaacatagaataatggaaacattaaaaaaaaaaaaacccacaggagccagcttaacagagcccccactgaccaaatgtgggaacattcaaacattaagtttaaataagagttctgatgacaacaaaaatagagtaagcccactaaaaactatctcttcttttgtattcaatcaataactctgtaaaaaaattcaaaagcaactacctgaggactcagaaaaataaacaaaaacagattgaaagggaaatcaaaacttagagaagtaacctatatgggaatgaggttcccttttttttccctctcttttctctagtagctttgccccaggcaggactcagtcacttagctgcatggtggtagcccaggagtggtttaatccttatggaaacccaatctttccagccagagtaactgacaaaaggagtctctatggtctccctaatgtaggggaaatacagttttccctcccttttttgtctcctggctttgtctggagaagactctagtcagagagctttgatagtatgagcactaaaattttgaagaaaccttttctttctggccagcagaccagaaaaagaggactttgtggaccagaaagcatgaaagggaaccccatagagtagacagctggtaaaaggttttcttaattctgcgtttaaacctgaaaaagtgccagtcttaatgctgagctttaagtaaacaggacagacttcaagaagcatagaaaagctttagaaaatttaatgtatttaaacatccatccaagtcagagaccatgccctgaatgacatgtgtgtgggacagactcaaagcagcgtagccaaggttataaaaacaaaatacattgaatccactcaccacagaggcaagactgaactctaagtctgaatttaactgggttttcaatgcctactaaatcaaacaagtaaacaaaatcagcattctcaagcagattttaacaagatctaaaatctacaaaatataaaactcagaatatccaggatacaatttaaaattgcttgacataaaatatatccagaaaaaagactaacagataccaacctcagattaccaagatgttgcaactgtcagccaaagcttctaaagcagctactgttttttttttttttttaatttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacagacgtgtgcgtgtgtctttatagcagcatgatttatagtcctttgggtatatacccagtaatgggatggctgggtcaaatggtatttctagttctagatccctgaggaatcgccacactgacttcctgttggtgggactgtaaactagttcaaccattgtaaagcagctactgttacaatactctatgtagtaatgaatagaaattaatggaaatatggatgctctcaaaggaaaaataaattattaaaaattgaaaattttaggacagaaaaatacaatatctaaatttaaaaaatatatagcataggcttaataacaaagtagagatggcagaggaaagagtcaatttgaagatgaatcgatagaaattattcaaaccaaagaatagaaacactgaggaaaaatgaacaatgcctcaagaacctgtgggattcagccaaattacagaaaatttgtgccattagagtcccaaagggagaggagaaaaagacgggttggtgcagaaagaaaatttgaacaaaaatgggcaatgattgccccaatttggtgaaagaaaaatttagagattcaagaaattcagcaaacctcgaacaggataaactcaaggaaaaccatgcccagacacattataatcaaattgccaacactggcaataaaaagtaatgaactattgatacacataatgacatggaagaatcctaaaataattaagttgagttaaagaagccacacagaaagagtacatactacgtgtccatttatatagaattttagaaactgcaaactaatctacagtggcagaaagaacagcagtgattgctggggacaatcatgagtggggtggtgcagatgaaaagggttattaaatgggaagaagagaagttgaggtgcagtggatatgttgattatctagatagtagtgataatttcacaaatatacatatatatgtcaaaacatcacattgtacattttaaatatatatagtttatgtttgtcaattgtatccagtaaagctgttgttaaaaattgtaagatgtagctaaagtagtgcttagaggaagatttatggcattaattacttattttagaaagtaaggacggtctcaaatcagtaatctaaacctctactcttagaaactagaaatgaagagcaaattaaacccagtgcaagcagaagaaagaaaataagaaagttcagagcacaaattattaagattaaaaataggagaactgtagaggaaaaccagtgtgttccaaagctcattcttttttttttttttttgacggagtcacgctttgtcgcccaggctggagtgcaatggcttgatctcggctcactgcaagctctgcctcccaggttcacgccattcttctgcctcagcctcccgagtagccgggactacaggcgccggccccaatgcccggctaattttttgtatttttagtagagacggagtttcaccgtgttagccaggatggtctcgatctcctgacctcgtgatccgcccgcctcagcctccgaaagtgctgggattacaggcttgagccaccgcactcagccccccaaagctcattcttttacaaaagtaatgaaattgacaaactgccaggaagacaatcaatttaaaaagagagaaaactcaaattaccagtatcagttattaaagaagtagaatcactgcaaaacctgtagacattaaaaaattatttctatcaattcaacaacttatatgaaatgaaccaattctcttaaacatataaactcccaaagattgcatatgaaaaaatggttaaactgtttaaatagcttaactctcgttaaaagccttcagtgaagagaagacccacagaaggggagaaaaatgtttgcaaactacctatctgacaaggcattaatagccagaatatataaggagctcaaacaactccatagaaaaaagtctaataatccaataaaaaatgggctaaatatttgaatagacattaaacaggcatatgagaaggtgctcaacatcactgatcatcagagacaagcaaatcaaaactacaaattaaactacaatctcgccccagttaaaatgacttgtgtccaaaagacaggcaataacaaatgctggtgaggatgtggagaaaagggaacccctgtataccgttggtgggaatgtaaattagtacaactccattagtatggggaacagtttggaggttcctcgataaactaaaaattgagctgctatatgatctagcaatcccactgctgggaatatacacaaaagaaaggaaatcagcatgtaaagagttatctgtactcccatgtttgctgcagcactgttcacaatagccaaggtttggaagcaacctaaatgtccaccaacagatgaatggataaagaaaaggtagtacttgtacacaatggagtactatttagccataaaaaaggagaagattcagtaattttcaacaacatgaatggaactgggggtcattatgttaagtgaaataatccagacacaggaagacaaacgtcagatgttctcacttatttgtgaaatctaaaaatcaaaacaattgaacccattgagatagagagtagaaggacggttaccagaagctgggaagggtagtggggggggatgggtggtagtgggaaaggttaatgagaacaaaaaatggctagaaagaatggataagacttagtgtttgatagcacaacagtgtgactatagtcaataaaaacttaattgtacattttaaaataacttaaagagtataattggattgtttgtaagtcaatgcataaatgcttgaggggacagatatcccattcttcatgatgtgattattatgcattgtatacctatatctaaacatctcaggtaccctgtaaatatatacacactatgtacctacaacaattaaaaattaaaaattagaaaaagtttaaaagcttctaaaaatctccatgcctggatagcttcactggcaaattctactgtacatttcgggaagaaaaaaataagaattctatacaatctctcccagaaaatagaagcaaaagaatacatttatatcatgttatgagaccaggattaccctgataataaaaccggagaccttataatcaagaaaattagggatcaattgcttcattaatatagatgcaaaaataatcaagatatattaacaaatttagttcagcaatatataaaagggataatacattctgatatagcgggcccaacattaaaaaatcaattaatgttgattaattgatcatctcaatagactaaagaatataataaccatatgatcatctcaattttggattagttgatacagaaaagacatttggcaaaaatgaactccaagataaaaacgatcaattaggctcagtggctcaggcctgtaatcccagcaatctgggaggctgaggtgggaggatcacttgagcacaggagtttgagaccagcctgggcaaccaggggaaacctcaactctaaaaaaaaaaagagaggccgggcacggtggctcccacctgtaatcccagcacgttgggaggctgaggcaggtggatcacgaggtgaggagatcgagaccatccaggctaacacggtgaaactccgtctctactaaaaatacaaaaaattagccgggcatggtggcgggcgcctgtagtcccagctacttgggaggctgaggcaggagaatggtgtgaacccgggagggggagcttgcagtgagccgagatcgagccactgcactccagcctgggcgacagagcgagactccgtctcaaaaaaaaagaaagagagagagagaaagaaaaaaagaaaattagccaggcatggtggtgagtgcctgtaaccccatctgatccagaggctgagatggaaggatcacctgaacccaaggaggttgaggctgtagtgagccatgattgtgccactgcacttcagcctggatgacagaacgagaccctgtctcaaaaagaaaaaataaagattaaaattcacccagaaaactcagaatggaagggaagttcctcaacttgataaaggggatctacaattatccttaagcagacgttgtactttatggtgaaagattgaatgacttcacctgaagttcaagaataagatcaggatatccactttcaccactcttattcaacatcatactgcaggtcctagccagtgtagtaacataagaaaaattaatgaaatgcacactggaaagaaaagaacagaactgttttggtttgaagatgacataattgtctacacagaaaatcccaagggatctacaaagacgctcctagaaataatacagtagcctgcttctgaaatggcccccaatagtccctgccacaatgatcccctcccttttggtgtgagaatagagcagaagtgattggatgctacttctgagattacgttataaaagactgtgacttccatcttgcttgcactttctctcttgctggcattctctcttgctcattcactttcttgttctgatgaagcaagctgccatgttgtaaactgtcctatagagaggcccacatggcaaggaattgagagaagcctcccacatccaatgtgggtcccaggccttcaatccaaaagccagcaaattatatgagctgcatgagtgaacatagaagtggatttttctccagatgagccttaaggtggctgcaacctggctgacaccttgattgcagcctatgaaacatgctgaagaagaggatatgctgtgacccaatgcctgattcacagaaactgtgaaataatgaatgtttttataagctactaatttgggggataatttgctatgcattcacagataactaaaataattattaagtgagtttagcaagctcttaggatgcaaagcccatatgcacaaataaattgtgtttctatatagtagtggtggaaattggaagtcaaagtttcaaagagtaccatttataatatcataaaaaatcataaaattataaatgtaaatctaccaaattatgtgcaggagctgtatgctgcaaacttcaaaatactgatgaaataaattaaagacccaaataaatggagagatatatcctgattatggattagaagaagaatcaatattattaagatgtcagtttgcccccaaatgatctgtagattcaacacaattgcaaccaaaactctcagcaggtttttttaatcaaaaagctgatcctaaaatttatgcagaaaggcaaaagaactacaatagctgaaacagttttgaaaaacagcacaattggagaactcataatactggaatttaggacttactgtcaagctacagtaatcaagaagaatggtattgttggaaagaaaagtgcatatatgaatggatataaatagaggatccagaaatcaacaaatataatcaattaatatttttactaaaaggcatttcaatggagaaagaatagtcttttcaacaaatgttggaaatccacattcagaaaaaaaacctgaattcatattttacaccttctacaaaaataaactcaaaatggaatatagagctaaatttaaaatgcaaaactactaaacttctggaagaaaacagaagaaaatctttaatgatattgggttaggccaagagctcttacctatgatgtcaaaaaccacaagccataaaaagaatgggtaaattggacttcatcaaaattaaaagcttttgctctttgaacaacaggattgagccaatgaagaaaagccacagattgataaagaatattcagcagtaacatattcagtaaacgatttgtatcctgaatagataaagaactctcaaaactcaaaataagaaaaatggctaattaaaaataagaagttatttgaacagacacttcaccaaggaagatatgtagctatcaaataaatagacaataaaatgtcaaaaaaaaaaccacacaaaacaacaacaacaacaaaccacttgctgagtgtggtgcctcacacctgcaatcccagcaccttggaatgcggaggcaggaggatcgcttgagcccaggagtttgagaccagcctgggcagcatggcaaaaccctgtctctataaaaaatacaaaattagctgggcatggtggtgtgtgcctgtagtcccagctacttggaggctgaggtgggaggatggcttgagtccagagcccaggaagttgaggatgcagtgagccgaggtcacaccactgcactccagcctggttgacagagcaagtccatgtctcaaaaaaaaaaaaaaaaaaaaaagaaaaaaaaaaacagtacttaggagtcttacagtagagaggctcaaaagcagacagttaccctgaaatatggcaaataggatgaaagagaattgtaggatcaaaaaaggtggtcaatttagtgtcagaaagcttcccagaggaagtgacatctaagtggggatctaaaagatatgcaggaattaatctcattacaacctgagtgacagagtaagacactgttaaaaaacaaaaacaacaaaaaaacaaaaacaaaaaaagcatttgtagtaattaaccaaaaggatagtaatcatatatctttaaggaaaaaaataaaaaatcattgctagtctaaatctattttcattataaaccgaaagcaacctcaaattgccccttaccattacatgatatttcaatatatatgttttcattcgtagagctatttgcagattaaagctaggttataaatatgagctcattcaattcctatacagataacagactttaaggctgaagttaggtgatcatgaagacttgaacttttaaacattcttattggtttaggagctcagatcacacccattttccttgtggccgattggcatgtttttgtctgagttgacgcatctgtgtgtaagtgcaactacctcaagaaatggctaacttaaacggtaccttcagaggcactgaaacgtgaattatcattctaccccatcattgcatttcaactaacaatgaactcttgaaaaaaaagatgataaagagttttgcttctgctaaattctacttgaaaacactgaacctctaactgtcattgttcaaataatttttttccggctttcttttcccatcctgttatcctgtcattgtatgtgtatttgaggtatcacatttaatctgttctgtcttctattactttgaagaaattagatatatatctcaaatctttgtaaataaatcagttacataaagatatattattcagctgtcaacactgtctagaggcaagtctttaagaaagttgtgtataattattcgtatgtagctttgcaggaaatgacaataatcatagctaacagttgttattccttacgtgccaggcactgttttaagcactttacatgtatttcatcatttaattctcgcaaaccatatgagttagattctgttgtcatctgtagtttacatacaatagaatagaggaagaggtctatttggtaattcacagaaggacacataattcgtatattgtagagtaggaattttaaactgaggctctgtggcttttgaaccaatgtttttaaacactgcaatagataacaaagaagatatttccctctttgtcaaagaaactaaacctaagtaaatacctacaaagaaaggtagcagacacaataaaaacaccaacgtgtccagttttaatcagatagtaagttcatacacataaaagggggaggtagtgagactgaagatgtatgaaattattggactagagttgggtaaagatagttcaggaagacttcacagagatggtgagactggttaaattttgaagagcaaggtttcattagaatttgagtgcattaacatgtcaagagcttagcagttgttatcattgtattttattttatttttatttttgtggagatggggttttgctatgttgcccaggctggtctcagactcctggctcaaggttattttaaattctcacaaaaacataacattatagacatgaaaagtgaagatcattcatttggcaattatttattgagcacctacagtattaccaagcacacatctaggttctgtgtctggtgcacaaaacaaatttttgccttcatgcagcttacttatttctcatttaggcaataacttgcccagggtcacatgattagactactagacagcaaagtcagaattggaacctagatctagctgattataacacatatttttatttgtcattatagcatttcaacactcatagtttacatttaaaaggcaggagaagattttgggggagaatgagggacatgtaaacttgattagaggaaaattaaaactcaaattgttccctagaataccaagaaggtaagtatgctgtttaaagaaatgcttcaaaattggcagaaatgaaggtaattttgtgaattggatcagtgcctcaactgttcatttggtgtcatttgagtacttacttcataatatgcttcaaaatgattatttaaaaataattaggcctttgggtgtcattaaggtacttagttcacagtatgcttcaaaatgattactcttgcttccataaatatataacttttttgcagtcatgtatttccacaatgacctctgatctctagtttgaaaatattttcttgctgtaattttcttcacccttcaaattcctactcactccaaatttctggaaagatctgctatggtaagattcttacctgggctctacttttcattaaaatagaaaacaaaaacaaaaaggaaataacaactataaaacggaactaatttcaaaaagactaagaccgttaaacttaagagatgcaaactgatacctgggagcagacatatcagatatataacagcatcttcaaattgctaatgcaagtgagcatacaccattaaatttattaaagttcagacactttttaatataatgatacagaaactctcagactttagatatttagacaatgaataagttagaatgaaataaagcacttaaatcagtaatttttggatttaataccttagacagcacatgtttattttagtacaacaaaggcatgcacaaatcagaaaaatattcaaatatatttgaaaatgtattatgtaatttgtgaaaatctcagtatctcttatgcaataagctgcatttttacttacagcattattattttttcttgctattcttagaatatcttcagatccccttccaagccacctagtaaatgttctccaggtaccttttgattctctcaaaagaaaagcgcatgccttctggtccactgtaccagaattttaaggctcatgatcaataactaattgattagtgcaattcaccgaagactatcataaacaaagagtagctgacatagctctgtacataaacacagagtagctgacaaagctccatttttgcatacagattggcaaaattcccaaggggcattataatgttgcatttagttagctaccactgaagtcacaatatcaccctatttctctcccaacagaacccaaccacagatgttcccatcctctgttaccagcctagcaccccttctttttgtcactcccagttgaattgctagtcggcttcatccacagtcaattttcggaacccaagaaattgtttcaaaatatttctaagttccatagtagcaattagatcttctaggctcatctaaaaaaaaaacttgtattattatgtaatatttgataactattaaaaatacatgattcaggacaagatggagtagactcacttttccctgctgatctcctctaaatacaaccaaatacccttataaataatttgatagacatttataaaaaacactctgaaagtgcaaagaagatgaactggctggggaactcaatacttgaagaatgacactctagtgacttccctgtggttttttttttatctccagtaccctctctgggtactggagaggcctgtaactcaggatcaccaacagttgtagacaaaaaccaaagaaaccaaagcaggaacttagaaaaagactcatatccagtgacagggtgggcccatctcccaatagcagtggaaacagtcctgggcacaagacaatgcattccccctaagattaagaataaggcaaggatatcaatgttcaccactgttatacaacataggactgaaagttgttttaagtcaccaagtttgtggtaatttcttacagcagtcataggaaactaatacatttgtcttcctttgttgagtagccattgcaataaggcaaaaagaggcatatatattagaaagaaagaagtaaaacagttcccatatgcacatgatgtaattgtttttgtagaacatctcaaagaacctacaaagaaactcctagaattaatgagttcaacaaggtcacaagggtataaaatcaatgcacagaagtcaatgacatttttatattaacaatgatcatatggaaactcaaaataaaattcaatattatttactatcacttaaaatactcaggtctaaacataataaaatatgtgcggaatttatagttaacattacaaaatgttgatgcatgaaatcaaagacctaaataaatcaagaggcataccctgttcatggattggaagagtcaacatagtaaagatatcagttcttcctctattagtttgttagagctgccataacaaactaccacttactgggtggcttaaacaacagagttattttatcacagttttggaggctagaagtcagaggtcaaaatgtcggtaggattgctttcttctaaggtctttctccttggctttgtagatggccatgttcttcttgtgacttacacatggtcttccctcagtactgtgtccacttttcttcttcttaaaggatactagtcatattggattagggcccaccctaataacctcattttaacttaattacctctctaaaggcactacctctaactacagccacattctgaggtactggggttaggacttcaacatatgaatttagggggacacaattcagctcataacacttctcaaatttatttaatgcaattcctaccaaaactccaaaaaggattttaagacatgatcaagcttgttttaaaatttatatagaaagacacaggtaggtccttgaagaactaaaataaccttgaaaaagaatgcattaagaggaatcactgtacctgatattaaggattacaagacagctgcagtaatcaagataatatcatatttgcagaggaagggacacatagatcaatggaacagaacaaagaattcagaaatatacccacataaatatgtccaattgatttttgacaaaggtgcaaaagtaattcaatagaggaacaaatggtgccaaagaaaatggtcctccataggtaaaaacaaatgaactttgatctaacttgatacctatacaaaaattaaaacagaccatagacttaaatgtacaatgtaaaactataaaacttttagaaaaaaaaaacacaaaattttcagaatctagggcttggggtagttcttagatttgacagcaaaagcccaatccataaaatgtaaaaatgtgtaaattggactttatcaaaatgaaaaacttttgctctgcaaaagagccctttaaaggaattggaaaaccatctacagcgtgagagaaatatttgtaaatgatacatccaacaaaagaagaatgtattagtttcctatgtctgctgtaaaaaaattccacaaacttggtggcttaaaaccacggaagtggccgggcacggtggctcatgcctataatccctgcactttgggaggccaaggcgggtggatcacctgaggtcaggagttcgagtccagcctggccaacatggtgaagccccgtctctactaaaaatacaaaaatcagccaggtgtggtggcaggcgcctgtaatcccagttacttgggaggctgaggcaggagaattgcttgaattcaggaggtggaggttgcagtgagctgagatcgcaccattgcactccagcctgggggacaagagcgagacttcatctaaaaaaaaaaaaaaaaaacacggaaatttattgtctcccagtcctggaggtcaaaagtctgaaatcagtactattaaactgaaatcaacttgtctgcaaggtcatgctccctccctccagagattctaggagaatatcctttctttgggagttttagattctggtgactactggcattccttggcttatggccacatcactcccttctctgcctctgcaatcacattgccttcttctcatctttttgaaatctatctctgctccccttctctgaggatacaagtgtttgtattcagggcccacctacatcatccagaataatctcttcatcttaagatccttaactacctctgcaaagactcctttttattgccatatgaggtaacattcaaaggttccaggcatttggacttggctattttttggggggtcatttttcaccctactacaactggtatatagaacatataaataattctcaaatttcaacaggaaaaaaataaaattttatttagataatgagcaaaagaccaaaaaacacatttcattgtacagaatataaaagatgtttgacatgagttattagacattaaggaaatgcaaatttaaaccacaatgaagttttgtaaatcccaaaactttaagaggatagcatgagaccaggagtttgaggacagcctgggcaacattgcaagatcctatgtctacaaaacttaaaaaaaaatagctgaatgtgggggtgtgtgcctgtagccccaactacttgggaggctgaggcaggaggattgcttgagtccacgagtttaagattacagtgaagggatcaaatcactacactccaacctgggcaacagagcaagaccttatctcaaaaaaccatacaaaaaaccccccccaaatcacaatgagatactactccatatctatcagaatggctagaataaaaaatagtgacaaaactaaatgccaaggatgtggagaaactggatcactcatacattgctggtgggaatgtaaaatgggacagtagctttggaaaacactttggcagtttattacaaacctaaacaaacaactaacatgcaatccagcagttgcactcctgggcttttatcccagagaaatgaagatttatatttacacaaaaacctgtccactgatgtttatagcaacttgattcttaatagccccaaactggaaacaacatttaacaggtgaacaagctgtggtacctccataccatggaataccacgcagcaataaaaaggaatgaactattgattcttgcaacaatcaagatgattctccagagaattacgctaagtgaaaagtgccaatcccaaaacatgacatgctgtatgcttccatttataaatatttctatgacaaaattatagaaatagagaccagattaatgcttttcagggtttaaggatggggagcagagaaggaaagtgggtgtggttataaaaggccaacaggataaatccaaatggtgatgttaatgttctgccatcttggctatatcaatgtcaatatcttggttgtgctattttattataattttgcaagatgttaccattgcagcaaactgagaaaagggcacatgtgatctctcggcataatttattgcaactaactgcatgtcaatctacacttatctttaaataaaaattttaattaaaaaatgtatatataaggcatatataagttgtgaagcaatccagactcatttcatactaagacctggaacttccatctctcaggagaccttgatctctctagtgaggaataatacatagaaaatataaaaatgtataataatacatatatgtgtaatatattatttaaatgctgacagcagaaaatagatatctatatacaaattgctactattttagaaattacatccttcaatgaggacaatgtttataactaaggttataaaaatttaaaaaacaactggagttaatggtccttgtcatcattctattatggattaactcagttttcaattaaattgtgaaaagaaaaccctattttctctaaataatagtccatagactgtcacagtaccaccaactccaaatttatatttcaatcacatctcacatattttcagtagaattgtaatttttttgtcaccagtttagccacaacttcataatcttcaaaaacataatgaaacaaacaaacaaaaacaaaacaaaacaaacaaacaaaaacaggagaactccaaaatgtataaggccaagtctttatctttcttttgtaaattctactgcagccaaacaagtacccaaatcgttcaggtaaactagacactctgtgcctatgaactcaacttgaaattctatagtgatagtgctccaaaaagccacccaataaaaactaaaatctctgaaggtttgtattcaccaacataatttttttcctcgtctgcttaaagtcaccaatatgtaggtattaaatagttcaaatgtgtttagttcaaattttgctaacagaattgttatattctacaatttcaatttgcaatcatcattttattgtttaacaaaaacaatacctagcctaaatatttctattaatgcatattaggaaaccaattgcccttgccctctctacttcttgccagcctgctaagatacctgtaaagaggtagatgtgtgttctccaccttgtaaggttaggaggaataaaaccttaaaaaacatgaacacacatacacacaaacacacacacacacacagaaataataagcctttgcccagccacataccatgtaatcctatgcctctttttcctgcagatttgctactctaagttttaataatgaccacactcacatcgtgaaattatacaccagtttattcaaatcaatgtacaaattgaatattatcacatttattttgttcattggaaaagacaatatgtcatttcagtttattttcatttttaaacaccaatatttaagtcttaaaaggaaataaaagtttacaataatgatgaatgtcaaacttaaaggtgtttgttatctggctgggcatggtggctcatgcctgcaatctcagaggtttgggaggccaagacaggagaaccatttgagaccaaaatttgggaacagcctgggcaacatagttagacctctatctctacaaaaaaaaccaaaaaaatagccaagcatagtggcatgccagtagtcccagctacttaggaggctgaggtgggaggatgggttgagcctgggaattcaggctgcagtgacctatgatcatgccactgcactccagcctgggcaacagaatgagaacctgtctctaaaaaagaaaagatgttttgttatctattaggcctttcaaaaatatatggttttttctgaggttttcaagttatataagacttctatgccagccaccctaaacaaaacagaagaagcacaaatattactaaacaaattaatgcttcattaacaagcaaatcaccaatggtgaaaaaagaacacatttaaatcaaaatcagtactgatacagaggtaagaattacatccaggcacagacatttggagttattcccccatgttaaaaattccatcacaatgtgcaaaataattattaaatcttctttttgaaatatatccccccacttttgttttgcctgatacagatattttaaccttaggtgtacagaaccctattaaagaacccagattacaattttttatcatttacataacagtggcagttttctcccatgttcttgcacaaaaagaatttattttcacataaattacaccctgcatttttcaatagtaggaataaaaaatactcatgttcaggtttacatatatttaccatgactaaattggaacaaatcagctcacagcttcctcatgcctacagttcaaattaaatttcctcttttatattcctagggcttctctagttgcatgtcaaacttttcagatcagctgtcttgattcctatcttttcctctccttgaaaaataagtgtatcttccatctcaaccatcctccttttcagcagcttccatttgattggtctggtaacttactatcatgagtatctttgtgctcagaggagacatcaggctgcctagtttactagatcttcatttattccttctaattttgtggtcgctctgctagtaacacattgtaaggtttagactcaatctaccccaggcttatttaaaattaaaacacgagtatatataaatattaaggttatatgtttaaaacttaactgctttggcatataaattgcatctataaaaatattaaatgaaaatttggcttaaaaatgtaacctaaatatagaccttgtaagtttaaaataatccttgtcctcaattttctttaccaagtttccaaatatttacatcatctttaactttccacggggccccaattcgtcaatctcaactccttgagttgtttttttggattttaagtgctttgtacaaactcattgatgagtggaatggagccatgctctctggtaccttgcttgctctagggtctgatctctctttctcacacttcgtggagtaacaacttccccatacacttactgaacattggaaattaccactttattcccactccatggctctactcaacccaccacattaccatcaactcagattcatagattaggtgccatattaaatgatatgatacagcaggaacagaaaacagacatgccttcaaggagtttactatctagctggaaaagtagaggcaagacagtaacaaagatctggatggcaccctcactttggaaattggcagtcattcataagacacagatatattcggagtaaggagagggaagcaactgggaaaatatcctttccagtaataagcaaaaagcaagaggcaaaaagaaatgttaactatttaagtcacatacttgccaatctatgtagctttgcaggattaaactacaatttattattattattatacatttctatatggttttgaaatggttgttccacaaaggaagggtcctccagaaagtttctatagccttctttttgggtaatttttgcctaccaatatttgaggctaccagatgaaagtaatttctttttcaaagcaattggattaatttttacaagtacacggagtcaattcttgaacttctgattctctatctagacattatcataaaatatctgctatggagcactcatgatgctttcatatgtgttatttaatttaccacaatggaaatacacaaccccacatcttttatttttttcttttttgagacagattcttactctgtcacccaggctagagtgtggtggcacaatcacagctcactgctgccttgacctcctgggctcaggctatcctcctgcctcagcctcccaagtagttgggacaacaggcatgtgacaccatgctctgctaatttttttttattatttatttgtagagatagggtctcactctgttgcccaggctggtctctaagtcctgggctcaagcaatcctcccacctcggcctcccaaactgctggaattacaggcatgagttaccacatctggcccacatcctctttctaacagccatgatttcttttcagacaacaacatatttataattcatttgcaacacttcaaccaaactagacatacagaggatgtgggagacataggtttctcacttcattactagcatgcaacccatgcaatcaaacatctgtgccagaagtagattttaggttactttgttatggaaatgcattctccattttagtagcattttttttcttaattagaggaagtgctttcagaaattgcaaattacataatgtaattacagccattttaatgaactaaagcaagtaaacatcaatataattttaagatatttaaaattctttatagttttttgcttatctttctaagttagggctagtagtaataactacctaaataatttgaatcccttgagaatgcaaatgtattaggcttggttttctgttcacctgagtcaaaaaacctgtggatcagaaataagtctggtagctaaaattcctgtggaagttataaaagggttgttttttatcaaaatataagattatctatgtaaaaaggaactaatcaactggttaagtatgttaattggaatttggaaggatttgagaactggaagggagagaactaaaattgttgactagtaactttgtaaagccctagacaacaatcaacccatttcatctttacattaaaaataattatcattaactgagaatatactataaccccaggcattctgcaaaaaatttcacatgcgttaactcatttaactcttccaaaccctttcaaagaaatgtgtattatctattttttcatattttaaataaaggaaagtaatgtatagaagagataagtaatgtgtccaagaccttagaacttttcagtaacacaactgattattaagcacaggcctataaaactccaaagtccttgtttgtagtcattgcttcatgttatatgtcacttagaatgatcctttaatgaataactacattaaaacatagaactgataaataaggcaccctccccccaaaagattactctctatctctctctctctctctatatatatatgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatactatttgtacacatatatgtgtatatatacatggttttctagatatatacgcatgacagtgaattatctttgaaatttaattattccattaaaatggaatatatgcttataaatctttctggattttgtaattttgtcttcatttattttgaagaatgccttaaatccaaacccccttttgctagagatttatgcctttttgtaaaagatagatattgtcaaacctagaccagaactatatttgggaaagagggtttgggaatggatctagaaagtgtagatccatcatattttccactgtcatccctggggattttcaaggattccatcaaaagttactcactggagtccaagttgtcctaaatgttctcaaaacatatacagtttatgaaaataaacatgcaataaataaaatctccctgatttcttcgaattggttaatgaatggcagaagacaatcttctcatatatattaatacctccaaaatttgtataactagaggtcattctcaaagtgaaacaattttcttgtgtgtataaaggtggtaccatatccctagatagatggcatattaagccctagggtattggaacatattgttatagtggctctttggctgaattttgcctgcagataaattttgttttggcctagccaacaatttttaaactttatcatttgaatacattttaagagtgagttccaactttgctatcttttctaccactccccatcttcttatacccagctgtcctacccactgatattacctacctggtccctaaaagtgtttacatttgtgatgggcatcacagctgtgagcacagaagaaatagctttcatgttgatactccacattcacccctgtgctaacaaaggtcctctagccctctagaaaaagtacactcattttcccctaagtacttctagaagtcaccagtggttctctcgtgtgatcatgagcaaatcaattttcatcatgcactgctgcaattattctgggctttcatggagcacacatgtatccaccatcacccgtcatcattcatagtatctgctgggcattcatcatctaccactgggcatccatcatctcccatttggcattcatcatctcccactgggcatccatcatctgccactgggtatccatcatcatttgctcggcatctgctgagtaccgccatgtctgttgggcatccacagtctcccaccaggcattgtggtctccgctgacgctttgccatttcgccaccggtgccttccatgagaatgctggttacttctccagagtgctgtcacccggggctgccaaatctacaaaccctcaagataccaggtgtgctgcatttgcgtcagtattcattgtacttagctgtgttccttgcataaattaggaaaatgcccctttataactgtggcacattttgttatctaaacattgaaaaagcaatacttgtccctgtccccttcacaaagtccctctgtaaaacagctatctctgttttatctttctttgttacttatggttatcatccacagggcttacgtattccacagggctgatcttgagtctatacactgatgccttaattcctgtcctcaggcattcacccaaaaaacatccctctgaaaagcttagcaggtaacttgtcagccttgtgtacttgtatatacctagcatctactcctatatctggtctttttttttttaatggatagatgaaggcctccttcctctttgcaaatcagttcatgaggtgatattcttggaaattcccaggcccacatatcttcacctgtgaatcattactttgggtttgaaatgtcttctcccaatatcacttttccctttaacaatatccttaatcacttcactgcgggatctttatcctagagaaaaaaatttctttaccgggtaagtttccattctaaatacaaaaagaataatggtatcagtatatttaaattataatgacatatgtggaagaatacagtccagaggtcctgatttttgttcttatatctagagtcttctacctctggttatcctttgctgtttctctcttctatcctccttagaaatgtacaactttggctgggtgcggtggctcatgcctgtaaccccaaccctttgggaggccgaggcgggcagatcacctgaggttgggagttcgagaccagcctgaccaacatgaagaaaccctgtctttactaaaagtacaaaactagctgggtgtggtggcgcatgcctgtaatcccagctactcaggaggctgaggcaggagaatctcttgaacccaggaggtggaggttgcgatgagccgagatcgcaccattgcactccagcctgagggcaacaagagtgaaactccatctcaaaaaaaaaaaaaaaaaagtaaaagaaatgtacaacttttacatattaattactggtttaattccccaataaatgcacaaaataaataaataatgtaattgtagttaacattccagttctggttgcaaaaataatttcactacaggcagataggcagcactgtcaaagctaaataacaacggccaacacttgagtttttgctcagggccagacattgttccaagtattatacatgtactatccctatttaatacataaagaaaacaatgcaccaaaagtttaaatgctatcagtattctactgccaacaatgggacgcacctcctacgttttcttccttaagaggagacatcctctgtcttctcaagaaagattagaattccctctgtagtgtcaagttctggtgatttgaagattctcctcatttttctttttcttcttaaatctcactccttcatggaatcaatctttctttctttctttctttctttctttctttctttctttctttctttctttctttctttcttttccttccttccttctatctttcttccttcctttcttccttccctccattcatcccttccgtccttctctctctctttctttctttcttttttctttctttctttttttttctttcctttcttttgacagagtttcactgtgttacccaggctagttgtgaactcctgggctacaacaatctacccacctcaggttcacaaagtgctgagaatacaatcatgagccaccatgcccagccttggaaactttcagtgatttttatattgtctgctaatgtgccaattcctagagagctaagttctcagtccttacttcatgaacttttccctcaaagcctgtatgtctatgccaagagccttttaactgggttgaatgatggtggtgaaggaagctattataacaagtactataatagctaactttaattgaacacttactctgtccatttatcttattcaatccacacaaccaacatataagtatttttcccactttacagatgagggaaattgaggtatacaattttacctcattttagggccacaaaaggctaatatccatcctcacatcactggtattaaaggtcccattctcccagctagccagagtgctatttctgccaccaacccatggaaatgttgaacatactatgttcctgaaaaacaacaacaacaacaacaacaaatattgattcttgcttgatgtcttgatatggctctagagacacagagtaacataactaaggaaatagtcttttgtatatttaagggtaatttctccaagccctaccataatactaatagttaatagttattgtgtacttattagtactgtacatggtcctagctgatacacactgttttagaaccatagctttactcaaaataattttatttcagttcagttcagactctattaacacctgcctaagacagtttgaaggcccagattgcaatgcctctgctatcatgcaattagaaatggaattaaggagaaatgggaggggtcatgatatatcttcaaagacttgaaggattttcatactcatacgcttccaaagacaaaagcaagataaatggtaaaagatacggaaagaatcagcttagggttcaataaaagctctgtctttcaaagagaggacaccaccagccatcactagtggttatgcaaagaatttgtgcctggaataagagcttgaactagattttttttgaggttgtcttttatgtcttaagattctataattaagatacctagttatgccactttgaacaagttactcaaaatctgaaagtatcattatgaagttagaagtttagtgcttttgtcaatgatagggagatgaaaataagaacttctatttcatacaatagtgttaatttcatatgtgcttttatgttcctatgatctttataatcagtttggttagtcccagcaagagatcatagatgaaaaacctagtcattaattatacattattttaatactcagaagacattttatccttgttgccatctaagtgaacataaaagaaaatttgcttagaatgaatggactatatatccataatcctcactcttaaacattatgcgatgaataagaatagcctacttagcttttatcttaaagggcagtaactctatcttgaaagttgtctttcatatgctgaatagaatatattacaactatggatcttaattgttcgcatttttctgtatgtactcctaacagagtgcttgaactgtgtagtaaaaggatcattgggctaatcattaaaagttagtttctttcttttcctctttagtcaaatttccatattccttgtgtgctgaagtttgttttgtatttcaaataaaacctatcaaaaatctaaaatctttgccatctagttattctgcattcaaaatgtagtaaagacaagctgcttactcaatgctcatataacattaagtccccaaagtaaacttaatgaattaagttttcccatgacccaatgccattgtttcttttaaaggaagagcatcaacaagacaatcaagtttgaatgaaattgattttctaatggagttctttttactgagaaatatttagtaacacagatattggagacagaatttttattttcatcctgtttatttctgtttttattctgtagtaacatgttatgggatatataagagtttttatgggagcatgtacaattgcaaattagccaagccactgaagattttatattgctgttttttatgtaattgataagatcatgacaaatgtggttttttgccctatttagaataaagcagaaagagtattctgagttcgtacttagagtatacatgggataattagaacaggctgtcttctgcagagcaagaggtttccttattctagatcatattcattcttggaacccaaaagcttgcactggctaagaaaaaacctattttctcctcaaaattctgtagaacaaaactttaaaggggaattaatttagaggcatttgatattcattaagcacttattcattttctattttactttaaccctatcttataccccatattttactttaaccccatcttagcttaatatctcctttatattgatagggaggaaaaagtttctggatttactattttaagagcaagtacaaaggacaaagctgaatatgttctattaaactaatagctgaagctaacttttatgtatttaattttgtatgaaaatatattcaaaatagaaggtatataaaatatatataatgaaatatatatataaatcaaatatatttaaaatatatataaaataaataaatgaaatatataatgaaaagtaaattccctgttgtttgaagtgtttcttgtgatggaagaaaatgaagtgtctaattttgaattcctcataaacctgattacaaactctgtgtatacatgaatttcaccagtgagtggcacatataaaccgttgtaatcaacctcagtgttctgttgaagggcaactggagtaaaaaataaagatgacaaattatttccactaaacattatagtataatttgtttggttactaataaaaaggaaattgctcaatagaaaattacataaaagctaaacattgataagttaatcatatacatatttaaatttgatagtttatagcctttagcattaattctggctaagaaatactcttttttaactaagtctttttgatcaaatgactcttaagtaatgttatattagtattttgattttggtaagtcactggttatctctacaaactagattctcttttataaatgacttttactgtgcatctatcttgataagtattttaacctacagtatctcacttagcatctgcttcacaggtatttgtgaatattaaaagctgaatgtgaaaatatttagtaaattttaacttactatacaattttaaggttatcattatttttagtattacattaaaccaaacccctatttacaaacaaaaagatattatgcatataaaaatgtaaattatgtattttcacgtgtaccaaaacaaatgttctagaagtagtatattggttcaaatataatgtaatataatataacataacataaatatatattttctcagtttaaatacaatggagtaaggtaagcttcttgttatttaagtggaatatgaaaattaaatgaccatttccccaaacttatttcattgaaaaatattaaggcaatttttgaagaccagtgtttcataaataaactttttagcgtgtattactatgacaagttactcaattggcttttactctgggttattcaactaaaagtttcattttcagtgactcataatattgtttacacataatttgtaagctctatttaattacttatgtaaatgactaaacaaaagatggcaaatgcagtgaatctaagactgtacttaattctggtgtaaactattctaacaatgtaattaagagctgtccaatttacactttgaagtaaacaaaagatcttacaagagattgcaagtgccatcatatgacacttctagctttacctcatgttcccttgcagtttttttcagacatgtgttaaaactatttgaaaaaaaaagcagttaatttaacagtacacaaaggtgatagttaataggaaaaataaaattgtaaataaaaaagtagtgaaacagcaaagttaaacctagactcaccttactttcttacctattgctattatttattcaatgactactacagcaaagctgtggccttgaggaaatgattttatgctatgaatacaataacaataacaaaaataaggctaataatacatataggtacagtatattggattccagctagatgccaagcagttaagcataacaaaattaggaaaggtagttattattattcattaaattcctttttggatttttttcactatgtttttattttattttatttacttaaaaatagtattagtgtttgctctggggcttacaatatacatcttttaatttttattcctttttaaaattgagatataaatcttataccataaaattcaccctttaaagtgtacaattcagtgatttttagcatattcacaatgttaggcaaccatcaactttatttaattacagtagaatttcattatcccattttcagtcactccatatataatatgcatcttaatttgaaacaatcttgttaagattaacattaaacttcaatagtatgtagacatattgctccaatatacttccatttcttcccccttctttgtgatatcattgtcatgcaaattacatttttatacattataatgcatcaaaatagttttgtgttttttttcatggagttgtcttttaaaccatttggaaagagaaaagagttttcattcatgtggattcaagttaccatctaccttttcatttcagttgaaagattccctttggtagatataggttaggtatgctgactacaacttctatctatttttttattttgaaacatctttctctttcatttttttaagaaatagttttactggaaatagaattcttggtagacagtatttttctatcagcccttcaaatatgtcatcccaatgctttctggctctcacagcttctgatgaagtcaactgttaatcttatttgggtccctttgtatatattgagtcatttatctcttgcttcttccagaatttgctctttgtcattgcctttcaactatttgactatgaagtatctaggtttgtatccctgagtttatcctaattggtgttcattgagctttttgatgtgtaaattagtgtcttctatcaaatttgggaaaatttcagccattgttttttcaaatatcttttctgtatctttctaacctatccttctggactcccattatgcataatttgatggtgtctcacaggcctttgaggctctgttcattttcctttattctctctgttcttcagatgggataatctcttttgacttatcttcaagtttatcttcaagtttattgtttctttcttctgcctcctgaaatgttctattaagcctatctaatgaatttaccatttcagttattgtacttttcaacttcggaatttttgttcttttaaatattaaattaatttgtatatctttactgattttctctatttagtgagcattatcatcatagttttctttaattctttaaagatagtcttctttagttctttaaacatatttatatagctgatttaaactccttgtctgataagtccaacatctaggccccctctgtacactttctattgacttctttaattcctgcctttatgccatactttcctgtttcttttctcttttctttctttcttcctttttttttttttttttttgaggtagggtctcattctgttgcccaggctggagtgcagtggcatgacctcagctcactgcaacctccgcctcccaggttcaagtgattgtcatgcctcagcctactgagcagctgagattacaagtgcctgccacgacacccggctattgtttgtatttttaatagagacgaggtttcaccatgttggtcaggctggtctcgaactcctgacctcaagtgatccacccacattggcctcccaaagtgctgggattacaggcgtgaaccaccatgcctggcatacttccctgtttatttgtatgtcttacaatttcttgttgaaactcggacattttaaataatatattgtagtaactttgaaatcagatctactccaacctctagtgtttattgttgtttatgagattttgtcctcattgctgcttgcttcagttactttcctagaatacttctatagattctgtattccttgcaatatgtggctgctattttctctggtagcatttttctttgatatttgtttttatttttaatccttcttaagagttgcccctgaatcagcattgtttgtagtcagctaatgattgttcagaatattctgttaaatgctatgagccagtttttcttttaccctgttccaaggagatttttgtgggaggtcacaccttcaaatttcagagaatttacaagtcaatattagcttttacttcctgctcgagtccagcatcaaaggtagctagagatgagttgttggtgtcctctctgagttttcttgggcatgtgtacagacatacacatttgtgcagccttttagatttcctgaaatatgctggagcattttagaatcccttatgttggtccttttgccattaccgatgtattccttttacatttttagccaacttcttgtttgttacaactgagttcacaggcttaggcaactgcaatgttattaaatccagctcatgttattgttttcaaaactctggagataaagctttttctgaagaactgaactcagagtcaggacaaatagcccaattacctgggaataatgtgtttcaaaggaattattgtaaatattgttgaaatattgaaagtgttctaaggatggggctttacatgaagctccaaaacaaatcagtccccactcaactggctggttactgtgctctgttactgtggtgagaggggaatgaaagtagccccaagtgaaaacaacatagatcccactgttctaactgaagttcagtagactgtttttaaatgaatatcttttaagccaaatctatacctttagttaatttccaagattctaaaacagttgatttttgtagttttgcaagtatttttatagcttttgtgagagaaagaattcaccaaggttgccattctgtaagttctgttctcataagtacttctttatacaccttgaattataatgacattttaaacataatagcataaaatgattttactgcataaagttaaaatgattatttcatatcatctactacctaatctgtattcacttttaacaaatgactcaaattaggatataaattagttgctttatttaaattaggtttccaacaaggttcacattttgcatttgttttttatgaaactagatttttgtgtatgtgtggtggcggggcggggcgtggtggggggggccttgattctgacctttaggagaggaaacatttttcagagggagacaaaaagtcaaagaagtacttcaattgttggggagacttgtacatgtttatgggatcaagggaaatcactatactttctggcttaagaaacagccctattcatgtcttgtccaacaaaggctagtaattccaggttagcctagggcccaagagatgaagcaaaagctgaaactgggaaaagaataaatttagaaagggacaaggtcaatgaggagagttggtagggatataatattattaagcaaatcatcaataatgtaacttggatttactttgggatgccagactcttggtggattactctttcttgtgaactatttcaccattctgcatttttacattttccttcagttggttaaaactacgggatggtagagtactgaagtcctagcttcaatttccagcttttccagtaactgtgtgatccaggttcagccacatggcttctttgagcctcctttgatttgtgaaatgagaggactgggttagatgtctctaaacttgattttgtctccaaagtatgatttttctaagacctttcttaagcaggtatatgcaataagtaaaaactgtttttagtaactgagcttaacatttttgctttcctcaccctgaaaatcaggtacacaagaacttctttccccctttcccattataacttgttttatggaaagaatcttaaatcagaattaaaaactggtaaacacagtattaataagatagaaatattaccctttcctcccactcaaatctcaaaataaagcaatattactgcaacaaggtatacttcatttttgtagtaagagccagtttcataagtgaaactatatgaaaaaataactatgggagttaaagcaaaatagcgtattgtgatttggaatagccaaatacattttatgcgtcagttttccaaaagttaaattttaaagtaatcttggttaaattagaatacagactcttaaataatctacaaacagacaatttttcagataccatggaatcataccttttatcaagaataacagttgtttgtcagtgcactttgggatattgagcagatattttggagatcacttatgctgaacaatatgatgcatttattccaaaaattacaattgcatattttttgtattacatattttagtcagcaaataaaacaactgcaaccacagaatctattcaggaactagaattaaacaagttcctttagaaactgattaaataaaccacataatttccaaaatgcctttcactttgtgcacttagctttggtttctaaaccccttctgaaacagatatctaaatgaaattaaaatctttattttacacagaggcttcccatcccatcccaccctgtgtccaaactccatcatctttaacactttaagcagttattatgaacccagaagccactaggatagagatgttctaacaaagatcaaagaaaacaaaaatcattgttaaattattataacccgtgggtcaaaccacaatcaatataaagacacttattgagtatctgctctttgtcagcactgaacaaaacacagtgggatgtcataatatattagtcccaatccctgcttatgagggagtttataatataattatgtgtatgcatatgtgtgtttgtgtgtgttggttggaggcagaaatttatgtaaaaaataatgaacaacatgaggttatgtgctaatgatggaatgcatcgaataaataataggtggttaagaagttcagaggaggtacatgtctccctagtcaattggtaagaatagggctcacaatggtgcaatttaaattactataataaagtaaatgggatattttcccagctcccaaattaccacatagacgattgttttcatacttattatatatagtcataacgtcaacccaactttgaagggaaatagagaaacccaattttattgtagttacaccttcaggattgcattttgctactaataatttatacaaaatgtaagtgcttatatctctgtaacttttagagatatattcttaacgcagtgttaaactatatatttttgtgccaattttaaatagttttatttaagacattgcattttccacttacagtacagtgcttataaagtgcaatgttatttccctcccctgtgcacatgttgcatattcaagtattgagaattcctagtaacttactacagcagctgaacttttaaacactgccacagaatttgctacaaatttaggtccttcaatgttttaaatgtgtggaacaatgctacatctatatttatgttggcttaatcaacctcttcagtgatgggccttgaggaagcaccactagagggaggagctccaccaccagggaatcccccaggcattcctccaggcatgcctcctgcactctggtaccgcttgctaatgatgagattgcagactttctccagctctgtctgctgatgttcaaattcttccttcttagcagcctgattcttatccagccatttgataacttcattaaacttgtccagaatcttctgtttgtcctcaccattaatcttaccttgaagcttctcatctttgactgttgctttcatgtggaatgcataggactcaagtgaattcttggatgacactttgtccctctgcctcttatcttcagctttgtacttctcagcttaccggaccatatgttcatgtcttccttgctcaaacggtgcttgtcattagtggtagtaatcgtgttctcttttcctacactcttgtccacagcagagacattgaggatgccattggcatcaatgtcaaaagtgacttcaatctgaggaacaccatggggtgcagaaggtatgcctgtgagttcaaacttgtcaagcaggttgtcatccttggtcatagcacactcaccttcataaacctgaatcagcacaccaggctggttgtcagaatagataggctgtcagaaggtctctgtctgcttggtaggaatggtagtactatgcttgatgaggacaggaggacagtcatgactccaccagcaagttcaataccaaaggaaagaggattgacatccaagagcagcaaatcttgaacgttttcagatttgtctccagataggatggctgcctggacagctgcaccataagcaacagcttcatcaaggttgatgctcttattcagttcttttctattgaagatgtcttggagaagcttctgaatcttggggatatgagtataaccaccaatagagacaatatcatgaatctgtgacttgtctagtttgacatctcgaatggctttttatacagggccaagggtgccatggaacaggtcagcattcagttctttaaattgggcacaggcaatggatgtacagaagtcaattcattcttagagagaatcgacctcaatactggcctgggtcctggaagagagagtatgcttagtgtgttcacaagcagtacagaggcgtcttatagctctcttcttctcactgatgtctttcttatacttatgcttgaactcagcaataaaatggctgacaattcggttgtcaaagtcttcttcacccaagtgggtgtctccagatttgacctcaaagattccatcctgaataatgaggattgacacatcaaaagtgccacctctcaggtcaaagataaacacatttctttcagctccaacctttttgtctaagccgtaagcaatatcagcagcacttggctcattgataattctaagtacattgagaccagcaatagttccagcatctttggtagcctgatgctgagagttattaaagtaagctggcactgtgaccacagcattggtaacagtcttcccaaggtaggcttctgcaatttccttcatctttgtcaggaccatagaggacacctcctctggatagaagattttggtctctcccttgtattctacttggaccttgggcctgtcagtatcattcaccatcatgaagggccaatgcttcatatcagactagacaacagcatcatcaaatctgcatccaatcagatgtttggcatcaaaaaccgtgttggtggggttcattgcagcttgattctttgcggcatcaccaatcaatcattcagtgttcataaaggtgacatagcttggagtggttcagtttccctgatcattggtaattatctctacttttccatgctggaaaacacccacacaagagtatgcagtgtcaagatcaataccaactgcaggtcccttcgacatggttgctggcgtgtagggccggctctgactacaaagaaagacacagaaacctccagaactgtgggcgcattcaatgagctatatttacttcttgaaagggaaaatagatgtaatttaaaatttcatagcaaatactatggaacaaaaaaatgatgtcaaaaacactacgattaaaaactcactgatatgctgacaaacatattacctcaactatcatctgctgaattaaaacagcaccaaagcgtaagtaaaatgacaatgaataaaatgaccaataaatgtactaatgcccttacaagggctccctgtagtacttagtaatgacaattaagaagtattgtgattaggtactaaaaagttgatctatttccatactttttctgaagattttcctgactgcccttttctgcatttatatttcatctacttctagtccagttagttttatatttatgttctaagacatgctttagtctgaacagttcataaggtctaagaggaaaatgacctttgaaggcactttctgggataatgtgtcaaaatttcaggccaccaaatattattgaatgcccattctgtgttaagcattgcacttggcattatggaatacagagatgtgtaccagggccctagcctccaagaaaatgcttcacttttagaaatatatttaaataatttaaaagggttatatagtgtagaattttctaacttggtgtgactagataaaatatctaattttcaacatcagctttgaataacttgtggagaattttctattggtatttatttattcatttattaagacagagttttgctctgtcacccaggctggagtgcagtgacacaatcttggctcactgcaaactccgcctcctgggttcaagcgattccccttccgcagcctcccgagtagctgggattacaggcacgcaccaccacacctggctaatttttgtatttttagtagagacagggtttccctatgttggccaggctggtgtcaaactcctgacctcaggtgatccacctgcctcggcctcccaaagtgctgggattacagggtggagaggtttttaaattagtattgtccaaattcagtgactctgactaatggtagctaatggaaagctgaaatgttcagttccaacgaaaatcctgaggcaaatagtggttttgttacattctttaagagacagaatgaattcctgtagaaatgcataatgcctatatttacataacagaaaatgtttggcagaaaataaagtgctgtcattgtacgagttagtatctttctttctctgaagatattttttaataatgaaagtagaatgtactggaggtgccatgtcagttcatctgtcaataaacataaaataccattaactcaatggtattttccgaggtgttgtagtgaagtagaacttgagttttggtatcacatgaacataagtttaaatccctacaatctcacctttttaaatgacctcttatttctaaataaacattttctcacccacattagcagggaaatagcatggtattgagggttagaggttaagctcataaagtatctggattttagtacatgtgatattttaattattaacaaaattattcttaggaattgattttattagaacattattttagaagtgatcaggcaaattatattgaagttcacatggtagaaacttctgagaatctgtcctagttgagtggtaatacagtaggatgagataaagcaatgaggaaaaaaaggagaaaatcagccttttccaaaaaaaaaacaggcaaaaactgcaatatctcataagtcagcttacaaatggaagtgccttccagaccacagtacagtattggattagtgtttttgtatgctacatatatgtcttagtgaagacagaaatgattatacacaattcatttcccatttttcatgtaaaaaaaaagtttatgtctgccattatattatagaaacagagctatctagataaagcctcatctgtaagagataatgtctgaccttcaggacacagatggaaggctgtgctattgggccaggaaaatttgctattccaagtcagcaatagaaaacattaagttcctggctagtagtccagttcccattttaattctctttactatctttttgaactcttcataaacaaaagaaatgaagaatagatatatatagggccaagtgattaaacagaattaaaagttccgtatataaatcttatgttcttaattatagactgactaggctccccaggattccattttagaagatatttggcaaaacatcaaattgccacttggtgcaacatcattttttaattttctttaattgtctagacctgaatttagctcagtacagtagatatcaggacagtggaagcgcaggcagttaaagtttgtcatcttggggggaggctgcagctgatatcttaaatatttgacatattcataatatcttttgaatatatctctgaacaaccttgtaaagtgaataaaataggcaattttctcaaattttagacaggaaaactagattttgaaattacagatagtatgtggcagaacaggtactaaaagaagacttctttcccccttacctacaaccattacaaccacagaatatgttttttctcttgtgtctttcagagtgtacctgttaacagtactgatgttttccatataggttggtgcaaaagtcattgcagtttttgcagttacttttaatgacaaaagctgcacctccaatgcagctttttattctaagtaaaaatccttccaactcaagcagggtaactctttcacatggacattagggtcttgagcacattcagactcaacattgccagtactctggaaggccacagggatattttcgtagtcaggtactagcagctatctcaaacaacaagcctatacttggattacaacatctcttcagctcagattcttgttatcttttgttgcatgtcaacttatttgtaggaggattggagacattgggtacaagaagatactttgtaagtttatgaatgaattctgctctatgtaagatgatagactaggtttttggaggtaacactatcaaacaagtatattggatgtatatgtatatgtgtgtgtgtgtgtgtgcatatgtgtatatgtgtgtatatactgtcagccttttgcatctggaagttcaaccaaccatagatcaaaaatattttaaaaacaacgaaactaacaaaacaatgataaaaaataatacaaataaaaacaatacagtataacaagtattcacataagatttacattgtattaggtattataagtaatctagagatgatttaaagtatacaagaggacgtgcatcagttatatgcaaatattatgttattttatgtaagggactaaagcatttgcagattttggtatctgcgggtgtcctggaaccaatccctcatgaataccgggaaacaactgcgtgtatgtatatacactcacacacataggtatgtatgcatgtatgaaagtatcaaagagctcacatgagagtaaggaattagagagtaaaatctatatgaaggatggaacccagatgtgggcagctcaggactgagcagctattgtcttgtggaaatttgcttaacaagggaatttttaagtatgcagacaaggattcaaatagaaggttatcctcctttaagctgacaccctaaagagctataccataagtataaggataaaacagaggtaaacatgaaccacaacctcacccttagggtctgcaagaaaaggtgccttagaattgaggggaggagtaaacctgtccctgatcattttaaaccacaagccagaactcacagtgatttgtcatccagattcatatcaactgggttgtccagaaatctcaagctataaattttgttgataataattttggaatgtatgcccctaaaggtctcaaagaagcaaatgcaaatattctctgaaaagcaaccccattctaaaaataattttccaaagagaataagtagctccttgggaaacagcaacaattaggcacgcacaagttcaaagtaccactggtaagaggcagaaaaacaacaaatataataaatatacctgaaaaacttcaggcattgtatcatcagacattattgctatcaataaagaaaaaaactataagatgaaaaatttctacagggaacaacaacatctgttgttctgcttttaatttttagaagatccactttgttctttttcagataatccaggccatttttatagtaatttgtagagtaaattaagagcagtttaggcaaagctgaagagagaattcataaacagaaaattatcagaagaaagtgtcaaaaatgcaaaagagagggagatgttgaaaacataagagaggttaagaaatatgtaacataggctgggttcagtggctcatacttgtattctcagcatgttggaaggctgaggtgggaggatcacttgaggctacgattttgtgaccagcccggataacataacaagacgctgactctacaaaaaaattaaaaaataaaaaaattagcctggtgtggtggtgtgtgcctgtagtcctacctacttgagaggctgaagtgggaggatccgttcagcccaggagttcaaggttacagtgagctctgattgcatttctgcactctagcctggatggcagagcaagaccccaatctctctctctctctcttttttttttgagacaaaatctcactctttcgcccactttggagtgcagtggcgtgatcacagcccactgcagccttgatgtcctcggctcaagtaatcctcctgccccagcctcctgaatagctgggactatgagtgtataccaccacacccagttaatttttaaattttttgtagagatagtatctcgctatgttgcccaggctggtcttaaactcctgagctcaagtgatcctcccgcctcagcctctgaaagtgctgagattacaagcgtgagccaccacatcccagtcaaccccgccgtctaaaaaaaaaaaaaaaagtaacatacagtgagaagtaaccaaatgtctaattgggattgaataggaacagagaaagagattgggttagaggcagtatttggaaacaatatagttagaattttctggagataatcaaagacatcaaagacttaagaagaccaatgattacccaagcaaaacagataaaaataaatctacacctagatatgtcacagtggaactgcagataaccaaagacaaaattaaatcacaaaagcagtctgacaaaaatgcatattactcaaagggaactattaaactaatagctgacttctccaaaaaaaaaaaaaaaaagccaaaataatatattcaatatgttaaatgaaaataactgccaagttaaaattctgtatttagtgaagttatacaagcatgggtgtaaaataaatacagatgaaaacagaggaactttctaaccagtaattcctgtttcaggaatttgaaaaggaagtatttcagtaaaaaggaaagtgaatctagatagaaggtctgaggagcaaaaaagaatgaagagccaagtaaatgatgaatgtgtgaataattctaatgaaatattgacttataaaacaaaattaataatattctgggtgggcatggtggctcatgtctgaaatcccaacactttgggaggccaacgtgggaggaatgccttagcccaagagtttgagactagcctgggcaacataggaagaccctgtctccacaaaaaaattaaaagattagctgggcatggtgatgcacacctgtggtcccaactacttgggaagctgatgtgggaggattgcttgaccccacaagatcaaggctgtagtgagctgtgattgcaccaacgcactccagcttgggtgacagagtgagaccctgtataaaaaaaaaaggtgtcaaaatagtgtcgtaagtgagtacatattttaagaagataaaatacaaggcaagaataacataattcaaagttgaatttaaatgttctaaattcattgtattgtccaagaggaaagacacttattaacttcagactttatgaaacacacacacacacaaacacacattaatttaatttataaaataaccagtaaaagaaaaggaaaaatgtgtacaactttgaaagagaggcagacagaaaaactgagatgttaaaaaatgattaatataaaaagggtaagaaaggaaaggaaacaaaaaattagcagaataagtagactgcattaaataaaagagtagctataaacccaatgatatcagtatttacattaaatgtaaatggtctaaaatttcaggaaaaagttttcagactgggttaaaataacaaaataaaataaacataataacaagacaaaatgaaataagacaaaataaaaatgaaatctaaatctacaccatctattataaatacgtttaaagcataggatacagaaattttgacattaaaaagacagcaaaatacaccatataattagtaactgaaagaaagatggtatagctactgaaatagataaaatagctaagagagtaaaagaacattactggagacgtagctgttaacttcatagttatacaaagttctattcatcaggaagatacagcaatttgaaacgtgtatttatgcaatagcatgattaccaaatatataaagtaaaaactgacaggaatatgaaaacaaatagataatttcactaattgatagaacaagctggaaaaaaaatctaagtttataaaatatttgaaaaacatgactgacaaaagtgaaatgactatataatattctgcacccaaatgtagaatacaaattattttcatgcatacagggaacattgacaaaagttgactatttactaggccactgagaaagtttcaataaaattaatgaaatttaattcatacaaacactgttctctgaccgtaaacatataagttaaaatcatatataaaatgacaactagaaaattagcaagtatttggaaattactaaacattttgaaataatccatgaatcaaaaatcatattgaaaattagaaaaatttaaaaaactgaactataacaaaatactagatatcaaaacttgccagatgaatctaaagcagtgtttaaagcaaaattatcaggcttaaatgcatacattgtcaagaataaggctgaaaattaatgagcaaagcataccctcaaaaattaggaattgcagactaaattaaacctaaggaaaatagaatggagacaatgataaagacatgagcagaaattaattaaataaaaacaaaactgtatcaaatcaaaccaaacattggttctctgaaaaaaaaaaaaagacagacaaaccactgactagattgattaatagagaaaaaaaaaagaaagagaaggcaaaaacagtgaatatcaggaattgaaacaaaaggatatcactgaaaatgctacataaattaacataacaaaaggatattataaatgattttatgcccaaaattgaaaagttagaaatatgtacaaatatctagacaaacataacttgacaatactggcagtcgtagcttgtgaggtctttccaaggaaattaccacacattcgtggcttaaaacaacagaaatgtattctctcacagtctggaggccaaaagtccaaaatctaggttggttctttctggagtgtctaaaggaaaaatcatcctagcttgtggtagttgccggcaatccttgacggtccttggcttgcagatgcattacttcagtctctgcctccgtcttcacatggccttcttcttgtacatctcctgcttgcttaagttgccttcctttttttttttctcgctctgtcgcccagggtggagtgcagtggcgcgatctcagctcactgcaagctccgcctcccgggttcacgccattctcctacctcagcctcccgagtatctgggactacaggcgcccgccaccgcgcccggctaattttttgtatttttagtagagacggggtttcaccgcgttagccaggatgatctcgatctcctgaactcgtgatccgcccgcctcggcctcccaaagtgctgggattacaggcgtgagccaccacgcctggccaccttcttcttataaggagactagtcatattggattttgagcccaacataatccaatatgacttatcttaagtaattatatctgcaaagactgtatttaccaataaggtcacattttgaggttctagatggacatgaatttgaagggacactattcaactgagaacactgacttaatgggtcacagaaaatgttaatgcttttataatcattaaaagaaccaaatttctttccactatggcaattccagaagtagatggctttatgtggctggagagtgccacaaaacattaaggaaccaaaaatgtccaatcttatataaagcattacaaagaaatgaaagcaaaatgtcactcccaattttatgaatatagaataaccttgatattagtgagaaaaaaatacaagagtagctcagttatcaacatacatgcaaaaaatccttaaagaattagaaaattggtctcaaaaaattagaaaattgaaggaagcgacttatgaaaagaaaaatacattattaccacattaggtttatcttaggaatgcaaagttgatttaacattagaaaatcaattagtgtatttacagctttaacagattagatttgcagattgatatggagagaatggacttttccataagtggctctggaaacacagggtatcaatatggaaaaaaaatcaggccactccctcatactataccccaaataaattagagttgcattatagacctaaatataaagtacaaaactatgaggatttcagaaaatgatataggagaatatttacatgatcttgcagtaaatgaaggatttcagaaagcagcaatttaaagaagcaataaatctgactacattaaaatacagaactttggttcatcagaaaacaccctgcagtgaatttttatggaaattatacttcaataaaagatggggaaaattcaaaaactgtatgacacctggcagggtcaaaaaacaagccacagaggtggcaaacatatttgtaatacaagtacccagaataagagtagtaaccagagcatataaaaaacattgataaattaataagaaaatagcaaacaatgcaatttgagaaaaggacaaaggatttcaaggggcacttcacaaaagaaatgcaagtggacaattaatatttgtaaagatgctcaaacttagtaatcagggaaattaaaatcgcaattaaatgccagttagtagtcaccagactggcaaaaattaaaagtgtgacaatacttatgttggcaggcatatggagccataggaactcttatatacttcttgtggaaatgtaaattgatacaaactatactaaaaagcaatttagcattatatagcagtagaaaagtgtgaaccccatgatccagaaattccatgcttaggtgtatagcctacagaaagggttacacatgagcaccaagatccatataaaagaattatttgtagcagtattgctagtaattatcccaagctgaaacaacttctacattgtaaaagcagcagcaaaaaatactgaaatttatgcctttagtaatacaatcaagtattgtgcaggtgaagaagctgaggtgcaaagaaatgcaaatgtttaccccaaatcacaataattaagtgacagaggtaaccacttaattgtggctgcaagcaatctaacaccaaacctttagctattatattacactctgctgcctctcatgaatttgttatgggtggaaaggaataaaattaggttgaggtatatgaaattgatatttttgaaggttagggagttgaatattagcaatttgatatgactcagactaatagtttaaaagttctgagcccaattggcctgaaatcacatagtccagtgtaacagcctacttctccttaggggtctcagtttctaagttgtgttttattagtttaaaaaaaggtgggatttttgtttttttgtttttgtttttgggtgttttttgttttgttttgttttgttttttgcttttttcccctaaaagccatcattgctaagtattctggttgattctttctcctggttttcattttattaagtggctgtggcacaaaacacaggcgactgaagtgaaagcaattacaattttcgacatctgccaagaaatatagtctttggcatgcatttgtactagtcacccacttttgggcaacagagagtctttccaaattcaaagacccagacgaatctttttctggaccgcattatatcctgaataagaaggagccatctgtccttgggcctggttccccagaggactatatacaacacaaatccaccaataaaattgaaagagccttccaagatgttacagaagccaattgttgtagtacacattgcatcagtttgcatgcaataacacattgcatcaattttcatgcagaaaaatatctaccagaactgtattttaaggttttaagaaggcagtagaacacagaggagtatgaaaagcaggtcacgaaaaattgggttccagaaaatatttatgatttcacaagtcagaaatctgttgggtatggaaaaaatgaactgaaagtttataaatgctcgagagacctcatcttgaatacaggagattgaattaaatagcttagaaaaggaaaaatataaaacggccattcagttttgccctaaatggttctaatggttgaaagccagggttttcttttcatgcagaaataaagacatcaaaactaaattagaagtcttcaaaataggccaggcgcggtggctcacgcctgtaatcccagcactgtgggaggccgaggcaggcggatcacgaggtcaggagatcgagaccatcctggctaacacggtgaaaccccatctctactaaaaatacaaaaaattagccaggcgtggtggcaggcgcctgtagtcccagctactcgggaggctgaggcaagagaatggcgtgaacccgggaggcagagcttgcagtgggccaagatcgtgccactgcactccagcctgggcaacagagcgagactctgtctcaaaaaaaaaaaaaaaaaaagaaatcctaaaaaaattccctggaataatggggaaattaattttttgatacattttgagttcagataagggtttgaagaatgagaaaatcctgttaaagttcagggataagtcctgttgttgtttttttacccaatagtattaattaaactaagagaaaactaagtaatttcctgttcctacccctgcatttcctctcttctatctccggaccaactacagatttagactaaccatatacagtttggattctaataacgtttttacccttcatgagttcatgagtatggattcttttttatttttattttttgagatggagtttcatccttgttgcccaggctggagtgcaatggcgccttctcgactcactgcaacctctgcttcccgggttcaagcaattctcctgcctcagcctcccaggtagctgggattagaggtgtccatcagctgcccagctaaattttttgtatttttagtcgagatggggtttcactatgttggccaggctggtctcgaactcctgacctcaagtgatccacctgcctcggcctcccaaagtgatgggattacaggggtgagccacctcacctggccccatgagtatggattctaataacatttttacccttaatgaatataatcttcccaattcagatgaaatgaggtatagatacaagcaaagtcagggacatttttttcagacagtatcttgctctgttgtccaagatggagtgctatggcataatcacggctcactgcagcctcaatttcccagggttcaagtgatcctcccacctcagactcctgggtagctgggactacaggcatatgccaccatgccgagctaatttttgtattttttgtagagatggggttttgccatgttgctcaggctggtctcaaactcacagggtcaagcaatctgcctgtgtcagcctcccaaagtgttgggattacaggcatgaggcaccatgcccagtgggatatttttggaaaatattgtcaatatatctcatattcaaattttcatcttcctactttaacttaagtttggcatgaaatgactttattaatgtcagtcttttcaaagtaaactgaaagaactattcgaaaaattacagttctcaagaaagctgaggcctcctccttagtgacattatctcaagaagaaaattatttgcttcacacttttggcgcagggataattctataggaaagaatttgcaacagtttaattacccttttgtgataatttaaaaagaagactacttgagattttagctgtgccacagaatgccaaatattttagtgtaggtcttgttttgttactatgtaagagatttaagattaatgttttatcatactttacacttacaaggaacggaatatcctcgtgcttctcactgactgcaggcatacaccctataaaatgttgaggcagatattcccagggcttcaatttctcattggaatttaaagctttcgaaagtgtcattaattctttctcagttgattcctgcagggaggctgatctgttccaggcctttctcagaaagaaagaaaataattaactaattaacaataattagaagtgaccttgattgttaagatttaaaaaaatgttaacgacctctgaaaattaaaaaaaaagggctttgagcttagaacatagagaccatagaggtcacaaaaggaattattgctagcatacccacaactaaggtcaatattgataagaaggataagaagtttgtgtcttatccaaggactctcataaactcatgattcctcatctttaaaatggggatgatcatagtatgtgcctcacttgatatgcggactaaggcaccttaggtatgggatataaggaatcgtgtatgacgacaaagcacctgtaacagtgcctggcacatagtaagcaacatgtaagtattgcctactattattgtaaaataatatgtttagcattctaagaattttgttttatttcctatcaagtttttatatttatgtgcaggtacttaaagtgtcttttgaacaatatgctgagttaggtttgcacttctaagcgtttatattttggttacattttgcataaaataaattgtttattctgagatagactataagtggttgagtagtttgtgagagatattattgcattgtttttgttattcagtcatattagaacctaaaaatatctgtatggtacatggagttagatgtctgtcctctttttacagatctctagggacaagatcccatcccactcttctttttcaggataatcaaaaaccttatggtattcaagaagttccacaatagtttaaatgtgaatattcagttctatgtccttccaaatccttactcctactcattttattgcatttataatgagttttaaatgcaatttcttccctgttatatgcatatgtttgaaggaaataaagtttaaaaataccattacagtgaaatgttttacaaaatcaaaaagattcctaatcccagccaattaaccacttaggttaggtaatattgaagttgacccacctcattacagcaaaaataattttctactttatgggaattcattgtaataggatgtttgatagataaatagactttcattctatttgtaaaaattaattttagaagtttaaaaataagcacttaaaccaatgtacatgtctattagaggcatagcgtagaaaatgaataccccttttctttctctcatttagaaaatagcactgcttaacttccaacaatatattaaatagattatgacattttgtttcatctgcacttaatgaattacatgaagatttaatcacaaaaaagagtattttgcccatttcttcttattcacaagttttattatggaaaaaatataactattctttacgctcaagattatttagttcatcactggaacatttggaatttttaaaataagcaaatgagaggttgcaatgagctgaaatcacatcactgcattccagcctgggcggccaggggagaccctgtctccaaaaaaaaaaaagaaaagcaaacaaaatgtttcatatattcttctagcagtatcaaagaaaagaaattgccaagatccttttaaattctgaataaatatggctttctgaccatgccaattaatagcgccatgagcgcatcaaccaaacccataaatgggcttacataatacataataataattcaatcatattatagaattgatcataagatttgcagaaaaattaaatggaccaacacatttatcatgttctggtacgttaatctgaatgtgcttatgaatattcagatacaaacatataaatgagtataggaatgcatacttacataaaacatgtacaccaacacatcaaaattgacaaagcagtctatgcaaattttcttagtcggtctttaatccacaggaaatgaaactattattactttaagaagagataatccattgcattggtatgagggagagggagggtatggggtagaagaaagaagtgaattcttcctctcttctcagaaaacactggaaaatttcctcccactcccaagtttataactatttaattcaaaactataagcaggaaaatggaatagcttgagccaaattttcttcaatatttgccaattagagatcagaagttcattcattcattcattcattcagatactgagtatatatactaggtgctgggtttacagtgataaacaaaaagcatagtacttaccttaaaggaaattgaaatcttgtagagaaccacagacaataaacacacagacacacacacacacacgcacacacaccaaaagaactattatctaatgttttaattaaataattataaaatggctaaggaatttggtaaatttgagtttactagtccgtatttcccatacgtaaacttgatgcgtgatctttagatggccattttcattcattgtagtcacaattcttagaacatgaccatgtgcatcagaatttcttgatttttggatcagcattcaaaactcactgttccgtgtgatctttcttttagaaagacaaattctactactaagccccaaggtctatccattattgtccagacaaataatacttttccatttttggttttatttttattttaatttttttattttactttaagttctggatacatgtgcagaacgtgcaagtttgttacataggtaaatgtgtgtcatggtagtttgctgcacctatcaacccgtcacctaggtattaagcaccacatgcatcagctatttgtcctgatgttctccctcccctcacccacaccaacagaccctagtgtgtgttgttcccttcactgtggccatgtgttctcgttgttcagctcccacttatgagtgaaaacgaggtgtttggttttctgttcctgtgttagtttgctgaggatgatgacttccagcttcatccatgtccctgcaaaggacatgatctcattcctttttttggctgcatagtattccatggtatatatgtaccacattttctttatccactcaatcattgatgggcatttgggttgatctcatgtctttggtattgtgaatagtgctgcaataaacatacgtgtgcatgtatttttataatagaatgatttatattcccttgggtatacccagtagtggaattgctgggtcaaatggtatttctggttctagatccttgaggaattgccacactatcttccacaatggttgaactaatttcattcccaccaacagtgtaaaagcattcctatttctccacaacctcaccagcatctactgtttcttaactttttaatcatcactattctgactggtgtgagatggtatctcattgcggttttgatttgcattcctctaatgatcagtgatgttgagcttttattcatatgtttgttgtctgcataaatatcttcttttgagaagtgtctgttcatatcctttgccccatttttgatggggttgtttgtttttcacttgttcatttaagttccttttaaatgctagatattagacatatgtcagatgggtagattgcagaaattttctcccattctgtaggtggcgtgttcagtctgatgataggatttgtgtgtgtgtgctgtgcaggagctctttagtttaattagatcccatttttcaatttttgcttttgttgcagttgcttttggtgaattcatcataaaatttttgcccatgcctacagacatataatacttttctaaagatcatcttgttattgttttcatcatgatcccatacattaatatatttatctcagccagtctagaagacagagtgagattttgcaccatctttaaaaaaaattatttaagagtgaggctccttggaggacattgacgtgttactgatctaatctctatactttcagttatttgaagctatgcatcactgtcttctttttgtttcttggacataggacaattaacttttcataggaaatgttcctagatcaattaatagtcttcaaatagttttcaaatcaaatagtcctcaaagaataatcttttcattacatttattagctgtattatcctattcccaccctcctttaatgggagattattatggattttcatacttatctttctctttcattcatagggagtacgggattgaaagtcaggaaatctggtatctagatctggctctattattgaataatgcataaacacagaaaaatcagtaaacaacaccttaggcttttttttttatttattcatccatccatccatccatccattaattcagccaatatatattaagcacttactactttgtattatacactctcctaatcattgcagctagagtggtgaatataaacagacataaagcttatattcatgggagaagagagacaataaataaaataaaggagtcagtatagagtaagttagatgttagtgagtgctatgaaaaaaaataaaatggtgagaatagcgagtatcagagagagagagagaagtatgtacagtgttttgttagtgatgcctgtacaagatcacttgatcatgatcagtgattttagtatttgattagtgtttgtgacaactttaaaagtctatgctttactgtttcctgcctcaatcagaaaataacatgaaaatagcaaaagcttaaggaagactcactaataattcaaaccccaaaattatataaccaaaatgcctgcaccttatttctagatgtgttctttgttgcttgtgtaaaaggcaggcaataataaacacctattatgcttgtttttgctaatttatggctacctcttttaagcagcagaatacaatctggtaatattctaaggatgtgttcttcttcaatttactgttgagtttagccacatgtctttttttattttattattattatactttaagttttagggtacatgtgcacaacatgcaggttagttacatatgtatacatgtgccatgttgttgtgctgcacccattaactcatcatttagcattaggtatatctcctaatgctatccctcccccctccccccaccccacaacagtccctggtgtgtgatattctccttcctgtgtccatgtgttctcgttgttcaattcccacctatgagtgagaacatgcggtgtttggttttctgtccttgcaatactttgctcagaatgatggtttccagtttcatccatgtccctacgaaggacatgaactcatcattttttatggctgcatagtattccatggtgtatatgtgccacattttcttaatccagtctatcattgttggacatttaggttggttccaagtctttgctattgtgaatagtgccacaataaacaaacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaaaagtgtaaaagtgttcctatttctccacatcctctccagcacctgttgtttcctgactttttaatgattgccattctaactggtgtgaaatggtatctcattgtggttttgatttgcatttctctgatggccagtgatgatgagcattttttcatgtgtcttttggctgcataaaggtcttcttttgtgaagtgtctgttcatatcctttgcccactttttgatggggttgtttgtttttttcttgtaaatttgtagattctggatattagccctttgtcagatgagcaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattacctagcttttcttctagggtttctatggttttaggtctaacatttaagtctttaatctatcttgaattaatttttgtataaggtgtaaggaagggatccagtttcagctttctacatatggctagccagttttcccagcaccatttattaaataaggaatcctttccccatttcttgtttttgtcaggtttatcaaagatcagatagttgtaaatatgtggcattatttctgagggctctgttctgttccattggtctatatctctgttttggtaccagtaccatgctgttttggtgactgtagccttgtagtatagtttgaagtcatgtagcgtgagtttagccacatttctttgaaatgtaagaggctatcctggatctacgtcaaacagaccaactcaccacaaatcaaagatctatgttccagactggaaggatttttctcatatttgttgtgctgacagagagctgttgtttctcagctaagaatactgggtgttgggattgaaggaacataataccttagagctaatgttgttgctgttgttttcccttgagttttcttcttaagatatatagcatatatagatatagagataaacttggataccttcctgccaagatcttaggatacttatttacaaagagagaattttcgggaatggcctaagtagctgcaaacatctgagagatgcaatgaatgctagaggtgtgatttgctaattattgccacttttgaaattctaattcacataaagattaagtgttaggtataggaaaaccgcagaaaacttcttggatttgtagaagtgtctgtaaagtctgattcaaacaactcaggacaaataaaaactaaaaataaatttgcagaagctcaggattgggtattttacatgtataatctctgtagcacataacctggcagtgtgaattccgttttggacaggtaaggctgttaaatgcagcagaggtcgctgaaaggatctgcatttgacactttggagatggatatgcatggattctgatcctaattcctgttacttaatgtctatattactttaatcagttcttaaacttatctgaacctcaccttctaaaacatctataaactgcagaggaggcaaactgcatttagttatgaatagcaggcaccacatgctccacaccacagggccatctaataaatttctcagatataaatacaattgttttctttcatttggctccttgtgatgtcaaagggctcccattcagacaacagatctctcttctctttgtcttcctaagacctgatcttcttgactcagtaccttctgtgcctcactttccactacccagtgatcacgtacaagggcaaaagctactgttatctgaggatagaatgcccccgtcacctcactgaggataagtctttagttagttgtatctggtcatgcagatgcatattccaagaaaatgtgactctcatctaataacagcataaattaaattgttaaggagaatgtccactgtcgtgagaaatactccttggataaatgtgagatatccctaaaataattcatgctggtaaggttagtttcattgaaattggctccaaacatctgtttttgcaaatctgcagctggaaaaaggttgtgatgcagtaatttgtcttgaaagaagacattcttattaatgcataagccaaagttagttgacttcctttagcttactttcattatcaccttatttcctggccatagcttcttgcatcttataagcctttagtcaagcaacatttttttaaaatagtatcctgttctggtaagaccaatatgttgtcacctgaaatctatttggtaatatttttgtctctctatatcttgaattttgatgcctgtagagacattctttctgccaagttgtggatttctttactccaatctacctgtatttgtcctgaggtaaattcttgtgaataccatttaatatagggttttctaattattaagagttcagtttcactgattggtcaacactgtgtcttgaatttctaacctatgccacagtgtatataaactaaacatccatgggcacagaagtggccttcagattttacttcctggccttaaagtaattaaaggaaaaattccttgttgtgcaatcagggttaaatagggttagtgtctataaaggagcacattgttccataagtgttctcacttgggaagttggcaacaagtatttaatcaagctaaagaaaagtttgccaaggcagacagtgggtgactgaaataaccttagtcagactggaatgaagtctgttctcataaatggagtacctggctgtagccaagaacagtatatatgaaaaagaataattcctgggatttgaggactgaacgatcagcaattagggaacaggcaatgtctgactgggaaacaagagtaaaattaattttgtagttattacctacaccagatgttctggcgtgcatgtggtaaaatagaggtcttcggaaatcacaaattttggtaagaacatttgcttacttcatgtggtttcaaacaagtataaatataaatcttgctgtagattagtagtattagtattaacattgccctgttaatctcattgagcctataagaatgatttggacagctctatattcctcagataattaggaagacaattactagtttatactcagagtcttagaactagaagagaccttaaaattcaaagcgctctgttccttcattttgcagatctggaaaccaaggcttagtgaggtgaattgattgttctaatgacacagagctaagtattatgaaagccaggagtggagtccatatccagggtttgtccactgaaccagaccacagtcctttacaatcaagagaaccctaggcacttagggcttctcaagaatacctggccttggttatgccaagaacttattaatctgataaattcacagtgtttggggtattaatgtcagaaaatcatgtaattattgattttccctaggatgtatgtattttagcatgctttaaacattcatgctttaatgtctaaagtgttcagttgcatgtaataatttttaaagtgtggatgttagcagaaggctgcataacttaacgggatttgactgatgtttcaggccagaagtaggttgcctacacaaagagaaatttcaaacagggctcatagtctttaaatttagttaagtgaaaacccattatgttttctctgcaatgttaaaaatgttatgttagttatcacataaaaatactacttaaccataatatgttattgcaggtcatagtaaagacaacacattatcttagcactgaataaaaagctttctcattctacacaaatctaccttatatgtctaaatccttgactcctaaaacattaggaaacatctcctgttaattaagtagctaattactgaataaagtattttgataaagttatttccataaggttaaacagcccagagcgcacacacacacatatatatgtacacttaggtgccccaggtacgagtgacacagaaccataacacatgattcctaaccttgatgtttccagaaaaaaaaataaaaagcaatgcagagtagtctagatcaagtgacaaagctataataagtgccatatgaagtaagagaagggagagatgactaagaattagtcatcagagagaggctttattgagacattatcaaactcaaatgacattttcttgaagttcaaagttaccactagtgaatttcaagggatggaaaacttttaactttatgttcaatatgttctcttaagataatattctgtagagaaacaatttctgccacaacccactaaaaccaaatgctgctcaaaattataaaataacagtaagataaatctcagcattgtgaaccctttggcatttgttatcattacttgtttcaccccttgtgagttacaaagagttagcatgaaccataagtccaaaggtcactcgaaatccctcctctctggaaaaaaaaaagaattactttaattacaaaaaaaaggtatttttagggatatttcaaaaattttagtacatatgcattcttaccacaatgggcagaaaaataagcctttttcaatatcttaaatatatactataaataattcattaactaaaaaggaataaccagtagtatagacttgaattcagcagtagatgtattcattcaagaagttagtactaagtaagacacttactttgaattacagaattttctaggttctagaaaataaaagtgaataagtccacgtcagtgttttcaaggaatcatataattataatttgtctatttgtatacaaatcatataatttgtcttatttgtatgtttatatatatgtacatattccactatgataatatttgataaatgctaaactagaggtatacacaaacttctaagaggaatatatcagttcagaagtctgattcattaatttgttcatttattaatttaactgatattcatttagggcccactatgtgtgaggcactgttctagatgtttcccaaaaaaggtgacttttgagtagggtcttaaaatgtaactgggtttttgagaggcagaaaagaggagataaggcttgattttatagacagtgggaatgacataggaattaatgaaaatgtaagagtgtgatgtcatcagggaacctagccctttgagtcaatgtcagaggaagctggaaaaggtgggtagatgttaaattataatatgctttgaatttcaactgaaattaaagtaaatttggagattattgtttggaccatagaacaccatatttttcctgttaaaactttttgaagctataacagaaataatatgatttctattttagaaaaatacattttgtgggaatactggattcaagtagaggaagactgaaggcatttatcttttacccacatccatcttttatacattttctcaagccttctcaaatcatcatcctatctgaaggacatttatgccccggaagtaactcgtggcatcagactgaccttggccacacttcagattgatggagaatgtaagcattagcatttaattcattggcacttctttggctagccatatatattttttcttggctgtccttatttttctcatatattatgccaaagagcatctcagacatcagtagctggtaataagctgaaatagctccatgtgtcactgcaacatttacgtaaaaatagatattactagcagaatctttacagtgtggtcctcgcctttgcaataaagacaaagaccaatctggcttagaaatcaactcacagtattggtgatcatataatatatactgacttatcccataggaacaagtttctttagcaatttatttagctgtcttctcacagaagcaactcacatttcacaataagatatgactcaatagtctctctgcgcatgcgtgtcagccaataatgcttagtcagaagaactcaagacagtctatgaagcagtagggaatataaggcagcagtgaaagaacttagagagcccattaataggaaatggagagcatttggccgtctttattgggagtggggagaagcagacctgtatattcacatagctaccaaggcctaattcaggatttttttcctcaaatgttatttctgatgttaatatttttcctctggcttttctatgttgcttaagcatacagtattaacccgtaagcatttaaaaatacttgtctagatcacatggaagaggttccactcagaattgtacatgttctcccaaggttcatccatcatcagtgtatccaagaaaatgtaagcactaatttacctggaatctaaggatagaaagaaatgcaacatcattcattagttgctatagatagatgtggtatcctgatgtggtaaaataaactccaatcaggagtaattttcgtgcatgactctgactattggggatgtatctgcctgcctattaacgtggtgtactttacatagatttttttaattttgtgagttagatcttagaaaataaacactggctccttaatagaatttgagcatttggggacagctgtaaccaatctgacaaattctatcaaataacttccttgtcaggaaagcctggtttgaatacacatattataaaggtattcaattgaataactttaattgattcagtctttaaaaaatatttttaatatttgtgggtacatggtagatgtgttcgtttatggggtgtacatgagatcttttgatacaagagtacaatgcataataatcacaacagggtgaatggggtatccatcacctcaagcatttatgctttctttgtgatacaatctaattataatcctttagttatttaaaaatgtatgataaattattattgactgtagtcaccctgctgtgctatcaaatactagatcttatttgattcaaacttttaatcaaatggtttaattaaatcattttaatttgaatgatttaatttaaatattaatttggttacattttcaaaaccacaaagaaacagtctctgatgaaagtagtagtgcaatgagatacaggggcaacaaagaattctcccccacttcaaaaaggtccatttatgaaatttcttgcatcattttttcaagagatctgcctaataaattaatttaaattgaggcaccgtaattttggaatcagcaacagggattttgtaatagaattatgggagccatttagcactggctatggtgtattcatatgtgattttaattgcatgaagttccaaatacaagatcatgaactttcttatctatctcttttacttaacagataggggcctctggaagctagctgcaaagttcaatctaatgatactgttagatactatgatgggaaatcatagatgagagcaggagcttttgcactgaatttctgtgccatttcctggcactcatattaaaattataaactacttaaatccaaaatgtagccatcttagaatgtgccacagagttttacaattttttctcagaaatatggttcagtatttccagagagctaaattaattgctagaaactcctctgacaacccaaccaaacacaagctgttatgaagcccatgatgataattaagacttaatgaaattttgctcatgatgatgcctttagctttatattttctggcctgattttattgccatgctatgcttagattctttctttctttctttctttctttctttctttctttctttctttctttctttcttattattatactttaagttttagggtacatgtgcacaatgtgcaggttagttacatatgtattcatgtgccatgctggtgagttgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggcgtatatgtgccacattttcttaatccagtctatcattgttggacatttgggttggtcccaagtctttgctattgtgaataatgccgcaataaacatacgtgtgcgtgtgtctttatagcagcatgatttatagtcctttgggtatatacccagtaatgggatggctgggtcaaatggcatttctagttctagatccctgaggaatcgccacactgacttccacaatggttgaactagtttacagttccaccaacagtgtaaaagcgttcctatttctccacatcctctccagcacctgttgtttcctgactttttaatgattgccattctaactggtgtgaaatggtatctcattgtggttttgatttgcatttctctgatggccagtgatggtgagcattttttcatgtgttttttggctgcataaaggtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctcttcagtttaattagatcccatttgtcaattttgtcttttgtttccattgcttttggtgttttagacatgaagtccttgcccatgcctatgtcctgaatggcttagattctttttgtccacatagctgaaaaaaatattataattcctctattttcactcttcctttaagaaaaataaatcaagccacttaaatattgcttattcacctgccttttcaaatatttaaaggaacacctaaattgtgctgagctgtgtgttgagtgctggagatataatagtaaacaaatgctccttcgttttaaggagttgtaattgaggaaactgacatggtagctaatcattttaatagaaggtgggataattgtaaagctggatctatgccagagtttcttgtgaatataaaaggaaaataactcatgaacgaggggacagttccaagaaaggatttgtggaggtggttacacctaagctactgatattctgtctcaaacttaggtttttctagtctcaaagtccacacttattccactgtatcacattatagtagaggctgtacaatgccgaactaacagctaaatgtggctgaacaataagtttcttaatctaataataatatgcttctatttctcataaggttgttgagatgacaagaatgaaaatcattaagaaatagttctctccaagatgatgtaatgctaaaattgcatatgattactttgtttctgcaaaatgttgcaatagccaagagactttaaagtgatcaaaagaaataaaataaaaattaaaaacccttcagctttagtatatggattctggagtaagatactgttatctactttttaagaaggattaaacaacattattaaaaacatttcaaatgaatgcttacaccagaagactgtagaatgctgaacaattatcagtgatcttaagtggcaagtaagctagtcttttgccccatagcatcctgtgttagtggtccatttaacaccttcagctagtatttccagggacttgttacagggacataaatttcaagcagaaaacaattcaaaaactattgaagtccttggtctggtgtctgcttcctctacattctttccctaggcaatacaaccactttcattttttatgctaccatttgttgatgacacctagatctaaaatccaggccacaggctttttccagactttcccttcaagtgttatgaagattttttatgccaagaggaaggcttatctttggtgaaaaagtatgtcaaagaaaaaggaaaccggtcattgtcctgggaacgaaatataaaagttgagagttaggtatatagccaaatagttcatttaatctgcaggaaagaagcagaacagaaactaggctctgccataggtacaaatggattaaatgaagcttttttgctattatgtttatgctggtgtttcccatggggtgccatgattgttctattttactctgtagccattttttcttgccctttttgcttttgtttctgcgtgcctgattctcaaactttgacatatgaccaatctgtttctcaggctgtagacatacaccttcattccttggctaaccttttttcttccttcaccagaactgaggcccttctcttgtgatagagtgccaaagtcaatccattattacaactctgcacctgtctccacccctttttttttttttttgccatttcctgacttcaattttaattgtgaagcaagattttatttcttttaaattttaaattttggtgggtacattgtaggtttgtagatatatatatgcaccatatatatatggtatatggtgtatatatatacacaccatatagatacacaccatatatatacaccatatatataccatatatatacacatcatatatataccatatatataccatatatatacaccatatatataccatatatatacaccatatatataccatatatatacaccatatatataccatatatataccatatatacaccatatatacaccatatatacacctatatatacaccatatctataccatgtatatacaccatatatataccatgtatatacaccatatatataccatatatataccatatataccatatatataccatatatataccatatatatacaccatatgtataccatatatatacatcatatatataccatatatatatacaccatatatataccatatatatatacaccatatatataccatatatatacaccatatatatacaccatatatatactatatataccatatctatacaccatatatataccatatataccatatgcataccatatatacaccatatatacaccatatatataccacatatatacaccatatataccatatatgcaccatatgtatacatatatacaccctatatatacaccatatgtatacatatatacaccctatatatacaccatatatataccatatatatacactctatataccatatatataccatatatataccatatatatacaccacatatatacaccatatatatacacaccatatagatacacaccatatatatacactacatatatacaccatatatatacaccatatatatacacaccatatatataccgtatatatacacaccatatatatatactgtatatatatacaccatatatatatactgtatatatatacaccatatatatatactgtatatatatacaccatatatatatactgtatatatatacaccatatatatacaccatatatacaccacatatatacaccatatatataccgtatatataccatatataccatatacatcatatatatcatatatatcatatatatcatatatacaccatatatacaccatatatataccatatatacactatatataccatatatatacactatatatactatatatacaccacatatatacaccatatatacacaccatatagatatatacaccatatatatacacaccatatatatacaccatatatatacacaccatatatatacacaccatatatataccatatatatacaccatatatatactgtatatatatacaccacatatatacaccatatatataccgtatatataccatgtatatacaccatatatataccatatatacacacaccatatgtatataccatatatataccatatgtatataccatatataccatatgtatataccatatataccatatatataccacatatatataccatatatatcacatatataccatatataccatatacaccatatatataccatatatacaccatatatataccatatatacaccatatatataccccatatatacaccatgtatatatataccatatatacaccatatatataccatatatacaccatatatataccccatatatacaccatgtatatatacaccatatatatatacaccatatatataccatgtatatatacaccatatatataccatgtatatatacaccatatatataccatgtatatatacaccatatatataccatgtatatacaccatatatctataccatatatatacaccatgtatctataccatatatatacaccatatatctataccatatatatacgccatatctataccatatatatacgccatatctataccatatatatacgccatatatataccatatatatacgccatatatatataccatatatatacatcatatatataccatatatatacaccatatatatatataccatatatatatatggtacataagatattttgatacagacatacaatggctaataatcacatctaggtaaatggggtatccattaccttaaatatgtatcctttctttgtgttacaaacaatccaattacattcttagttattttttatttattcattttttttttttgagacggagtctcactctatcaccaagctggagtgcagtagtgcgatcttggctcactgcaacctctgcctccagagttcatgcgattctcctgcctcagcctccccagtagctgggactacaggcgcataccaccacgcccagctaatttttgtatttttagtagagacggggtttcaccatgttggccaggatggtctcgatctcttgacctcatgatccacccgcctcggcctcccaaagtgctgggattacaggcgtgagccaccgcgcccgccccattcttagttatttttaaatgtacaatataaattattgttgactatagtcaccctgttgtgctgtcaaatactagatcttactcattcttcctaactatattattgaaactattaaacatccccacttctctctcccctcccccaaacccactacccttcccagcctctggtaactgtcattttaccctatctccatgagttcaattgttttaatttttttagctcccatttataagcgagaacatgtgaagtttgtctttctgtgcaaggcttattttgcgtaacacaattacccccagttccatccatgttgttgcaaatggcaggatctcttttttttatggctgaatatactccattgtgtatgtgtacattttctttcttcattcatctgctgattgacacttaggttacttccaagtcttacctgttgtgaacagtgttgcaacaaatatgggagtgcagatatctcttcgatatactgatttcccttattttgggtatctactcagcagtgggattgctggatcatatggtagctcaatttttagcttttggaggaacttccaaattgttcccatagtggttatattcatttacatttccaccaacagtgtaccaggcttccgttttctccacatcctcgccagtgtttgttattgcctgtcttttagatgtaaggcattttaaccggggtgagatgataccttactgtagttttgatttgcatttttctgatgatcaatgatagtgagcccctttttgtatgactgtttgccattcatgtgtcttctttggagaagtatctattcaaatcttttgcgcattgttcgattattttactagatttttcctatagagttttttgagctccttatacattctgcttattaatgccttgtcagatgggtagtttgaaaatattttctcccaacctgtggccaccaccactgggactgtactaggtcagacctgaggccaacacagaaatgggtctgcccaggtcctgcaatgaccactgcctggctactgtctatgtttgctcaaggcccaagggctccacaattatttgatgacaaatccagccaggcctgtgtccttcccttcagggtggtgagtttccttggccctgggcaggcctggagttgctgtctgggagccagggtctggagtcggttaccttaggaatctacctggtgctctagtctattgcagctgagctgacacccaagctacgggacaaagttcttcccattcttcccttccctttcatccagcagaggaatcacttcccatggccgccaccaccccatgcacgtgacgagtactgcctggctacccctagcaatcactcaaggcccatggggctcttcagtcagcttatggtaaatgctgccagtccagtgccttttttttgttgttttttttttgacagagtttcgatcttgtcacccaggctggagtgcagtggcgcgatctcgggtcactgcaacctctgcctcctgggttcaagcgattctcctgcctcagcctcccgagtagccgggcttacaggcgcccgccaccacgcctggctaatttttgtgtttttagtagagacagggtttcactgtgttggccaggctggtctcgaactcctaacctcaggtgatctgcccacctcagcctcccaatccagtgccttttcattcaggccagtgggctccactctggctcaaggaaggtccagaaatgctgtccaagaaccaaggcctggaaccggggaccccaagagcccacttggtgctctgccctactgtcaccaagctgttacccaagctacaagacaaaatcccctttactgttccctctcctttcctcaatcagaaagagtctctctccatgaccatcacagctgggaatgtgctgggtcacatctgaagccagcagggctctgagtctcacccaaggcccatggcaaattctgctcggctaccactgctgattattcagggacaaaaggttctttagtcaggaggtgatgagttcttccaggacttggtcctgcccttcaaggcagtgggttctcttctggcctaggtgtgttaagaaatgttatccaaaactaaaacctggaatgagggcatcaggactctgcctggtatcctattctactgtggtggagctggtatccagattgcaggacaaagtcctcaatcctctccccttttctctcctcaagctgagggaaggagtctctcccagagctgtgagctatggtgtcagggattaggggaggggtgatgcaaacattcccttggccacgccagctgatatctcactaggtctcatgcaccccaagtgcactggctccaagcccagcacagcaccaggacttgcctcatagcctagactgcctttcaagtttatttaggacccggggggcacttttgcccatggtggtggggcttgccagacagaactcaggttctgaccactgggatggacaatttgcctctagctagggctcatctaaatgctctctcagtgggcgctggctgatttctgccccatgttgcttaccagcactgagttccaatgcaaagtcccacagtcactgcattctccctccaacaagcatacagattctttctctgcaccatgtgaccactgccagaggatggggcagtggtggtggtgtaggcaattcaagactgtctttcctaccctctccagtgcctctttccttaatacaatgttaaaaccaggtactgtgatcgctcacctgatttttctttgtatgaaggtgcttttttttgtgtgtggatagttgttcaatttggtgttcctgtgagtgggggacaattgctggaggcttctattcagccatcttgctccacctccctgaagcaaataaaaaagctttagaaaaatttgtacccctcacaccaaagtgattaaatgatagtgatagtccacctaaaatgtatagtttctgatttttaaaaccagtttatatattttatatttcattacataaatgtacaccaataaaatggccaaaaatgatatagtaaggctaattatgtcattgaatggccagttgtgttctttgaaggcttggagttcttgaagttccaagaaagcctctgagctggtgtgatttggggggcactgctaaagttgtctttcccgcatcaggcaaaatgtcttgctatcacctgtcactctttatagtcccaataatagtcatttaactttaattcaaagtgcctaattaaaatataagcactattaatgggagaaagaggtttgaagtaaagaaagggcccaaaggccagtctttttttttttttcatggtttccctcagaccccacccaatacgtttttttggaagattaacatgctaatgtttatagaatgctgtaaagtcttcgtataacaaaagagatctacatactccaatggcaatagtaatacagtataatgttcaaagaacatatagatgtcacatatgtggaatattcctatcagggaaacccttacatattccctctgttacctttacatggcatttcttcttctattattcctggcaatgtctgccttagtgaaaagacaggggtcaagccaatatgttcccattgcatgcactcgttacaaagatttaattcgctgataaacatgttaccatattaaatctgcagcttgcctaccaagagtaaatgttttgtgtgagtgtgtatctaaatgcatagtctgaaaagaagatagggggcaagttattgcaggaaaattcttcgtgggaaactattgccttctgatgagctactatctgttcccagcatgtgctttcattagtcatccattaacaaccaccagttcatctcctaaacattcagggttcctcatggtaaaataactgtttcttcctagtgtcacgtttttcctactgtgctatgcagccataatttttgagattttttaaaatttttatttttaagttctggggtacatgtgcaggatgtgcaggtttgttacataggtaaacatctgccatggtggtttgctgcacctatcaacccatcacctaggtattaagcccagcatgttttagctatttttcctaaagctctctctccccctacccaccccccacaacaggacccagtgtgtgtttttccctccctgtgtccatgtaatcttattgttcagctcccatttttaatcttgctaccttctcttctgctcccttactattctatgagtgattatctacctacctaaattgtttttcagtagaaagaaagcattatatagagtggcagccatcccaaaactctgtggttacccccaactttttccccaccctctacatgggttataaacttaacaaacgaacattatgaaaaccaggctatattccatgaagacaccctccagtagttcagacagagcaagaatgtttaagcagaataatgaaaaggctatcttgggccgggctcggtggcttacacctataatcccaggactttgggaggccgaggtgggtggatcacttgaggtcaggagttcgagaccagcctggccaacatggtgaaaccccatctctactaaaactacgaaaattagccgggcgtggtggtgagccctgtaatcccagctacttgtgatgctgaggcaggagaattgcttgaacccaagaggtggaggttacagtgacccgagattgcgccactgcactccagcctgggcgacagagtgagactccatcccaaaagaaacaaacaaacaaacaaacaaaaaaaaaaacaaaaaaacaaggctatcttgttaaacccaaataacctggtagtgaattgaagtagctgatagtaattttcagttttcctctgagtaataccagtttataaattgaattattatggtaaatagtggatattttgtcaagtaaaaataaaaatataaaatagtataataaacatttgcatgtatttaccagacaagtggccctttaatatttacatttacgattaatttttaaaaatataacatagacttatgaagtagaaaaggactttacagttttgtctaattaaattatttgcactcataaaaatagtcatgccaccccacttataaatatctacccccgcaataaaatccttatatacaaccaaaatatatttcacaatgtcctttattaatgcataacacttaaaagtcttcccttgatgattaaataatgtcaaaaacagacttaaaaaataaggatttggaaatttttgataacaatttagtgggggcgatccatcaataacttcataaatttcttccagagtaggataacatagttgaaccacaaatcctgttcccatcttggagtctcactcagacagttgaattcaaattcacaagtctaaagtaccaagatacagtccaaattggagtacctggagagtccaagaaagctgtttgtgatgtcacatgaggtgtcttcaatagtgttgatattcaatcctgagagaagatgtaacccaggcgaagattttaatgtagaggaatctggaactgaggtgagatctggaaagccaaatgtaggtactctgctaccagacagaagtaagttttgtctctggtcagacaacgatctctttctgtagcaaggacgctgtaacagctaggctttaggaacctaagcagtgagaccagctgctaaacagcccggccacagagggcaagagtcatttgagaagagcttcttatatactactaggtcttctctcattggttgagagtctgggtggggctgattatgtcaataatcaggtgaattgtgatatcatagaccatgtaagtactgacatatatgttattatattaaccaagctatgttgtacattacagagtacaagggcagattgtaatgtcataaagtttacagtgtaccaggagatataaacagaaaattacaatacaatatatatgctaggatacagatatatgtaaggtactgagagaagacatagcaaggagtaattaactctgtgtgtggaggtttagaaagggcttcccagataaagtactgtctcagctgggtctttaattatgggtagacatttgcctgtgtgtacaggaaggaggtttgaaaaaggggtatattacagatgtcattctaggcaagacagacaaaagtatacaaaagcacagaaaaatgaaagggaaaaaatagctggagatgaggctggagtagaaagcatatctcagacctcaaagtaacctaattcttcatgatatagtatgcctttttagtcaagttttattcttaatgaaatgaggaaatatttgtgtaagaatacttacaagtcatcaccaatgttgtatttccctaaaagctacagaacataatctattaaaatcctatagatttactttaataatgcaatgctgtcatcataaggactttcctgtgaagtcatggaacctaaaactataatttgtatacatctatccagtgttaacaatttgtagggcatcagaccaggaaggaggtttggaaagttagtagcaagtcaaaatgtgacttcagtactactaagaaaatagggtgatattagataatcaacatttataatgttatggaattattaatagaatatcaaaatattaatgaaacataaattgtcctgatccaaaatggaaccatgcattattcaaattatttactgaaagaaaacctgtgttcatctaccaagtttcacagaacatctatcaagtttcacagaacatctaatatatagtatatatattatagtatatataataatattatatagtatatatcatatagtatatatcatatagtatatatcatatatactatagaatatatattataatactctatagtatatatgatatatactatagaatatatattataatattatatagtatatatcatatagtatatatcatatatcatatatactatattatatattatagtatatatacatataatacattatatattatagtatatatacatataatactttatacatagtatattgtatatcatataataaatggcattctgctttataagcatttcttttccctgctaaaatataattttactcatcctcaacaggttttcctaggaatattgagtaaagtgccttttctgtacctctttcatttttctctgcttttacttgtcagcatctctttatttcaatctatttgatcataggttttcaaaatcaatgtattatgtttagaagggctgaagtgttatttggatgatgactagaaagagatactgctacttctaacaaataggcacacctttctttttgatcctttcctccaaccccaggccacaactaaaactgcttcttttgaattaccttcaagtaacagagtatgtaaacgtggtggagactgttcttaaaatcttgtgcaaatcctgtaaaaccaaacagaaaaaaatctaaagtcctaccagaaattaatgagcactgaatacatggtagaattttgaagcatttgtaaaaactacattgaagaaactagagttagaaacagtaccaaagttctgcctcctaagccaggatgaggacatggtaaaagaatatcttgatgacctccaaccatcgtgcctaaattattgataaattaaggaagctggaggatgagaaaatctgtaaatctgtattaacctaagaaattggcagaggagaaagtatagtatatagatagagtgtatgtcaaataaggcagcaataaatatttttaaaagcaaaaccatctggcaaatttagaaactatatgacttttatggctactcttagaatttgccaaagattaagaattgcccctcctctgtgatcagttttctgcttctcaatgtaaagttcttccttccagcttttcaacacttttattcacaaatatcattctatgacatcattactgatctccttgacattttcgacaaatctcttgcttcctccaaacttcactctcttccctctccagcctgctttgaaaaagcttatctcataagcttgaagagaattaagtatatcatacacagtactcccagaacatcatgtgtactgcctctgtcatagaatttacaatgatgtactgaaatttgcttgcatgtctgtctctctactacacagtaaattcctacttactaatatataaaaattcaaatgaaatataatacgaattgtatgaccaggatggaatcataactttgaagatgagagatgatagatagataggtagatagatagatgatagatagatagatagatagatagatattcaaatccaaatgaccaaccgcatcactttgggcatttaatattgccaaatctcagtttgtttgtttgtttctttttagttttaatctgtaactactttataaggttgttgtgaggagtaaacgagataatgtaaagtttcccagaaaaaaaaaatagttaactcatgctagtttcattcatctcatgattttaggggttgttcaatacattatgaaatatataaatatggtactgcagtaggttaaacaccataaactatagttcatcctggtagaagctgaaaatcatttaataaacttcaatgtatatttataataaatacatttcaaatatgaaaataggaaggccatcccttactatattacaaagtaacaaccagtataattataataatgtgtggctataggattaggaagattaagcataaaaaaattacagcaataagtcctactatgagtgataaatgaagcatcaaaatcaatgataaaagaaaacatgttagataaattcagcttctcatctcatctcacatataaaagtaaattctgggaagatgaaaatgttgacgatttaaaacctattcaaagaaaaacaagaataatagaatagaatatttatccaactatgtatttatccagcatctaagattaaaaaaaaatagatgattacacaaatgagaagactgacagatttgcatgtaaatataaaatgtttatctatgataacttttgttaatgtgaagtggattgggattaaataattgcagcaaacataaacataagcaaaattaaaagataaagactggcataaaatatttgagacaatttttaataagttagaatattatatcataaaatgtgtctgtaggttttttttaggacagtgtataatgcacctcctatatactggaaaatgaatagaaatgtaatatttacatattctcatttataattcttttcaaaaccaccattgtctacattactctaaattagtaatatgctttcattgtacagaattttctacaaatgcaatttctaaactctgtgagattatagaagtataaaatgtgttcataacacaaaacttacattggaggcatcagcaaaaatggctaagtactttcaaaattctctccttcataaaagcagtaagaaaatttacagaaattctctgaatcaactatttcgggactttgaaaattaactaaatgcttgcagcaacccagaatgtgtttgtttaagaaaatggctgaatgttgttaagaatagcaatctccgtgacattttaacttgtcctattcccattcccccttcaagtgccatggtagccttaaaaaccaacatcctacaatcatgttgaaaacctgcagcctggcagctactggatgggggaagggaaggggtagaatgaggttgcagctccttcagagcctcatttccagagaattttcattatttgacttgtctggtagttccctggaagcattaacaccaatccttcaaaaactaccaaaaaacaaaaatgggaagaatatttcccaattctgtttatgaggccaatattatcctgatgccaaaatcaaacaaggacatcacaagaaaactacagaccaaaaccccttacaaatatagatgaaacaaatcctgagcaaattactagcaaactgaatccagcagtatataagaaagattgaacactgtgacaatggtgttatctcagaaatgcaaggttgtttcaacatatgaaaataaatcattataatacactatattaatagagtgaaaaacataaactacctgattacttaaatggacacccaaagaaaccatttgagaaaatccaatacactttcatggtaaaacaacaaactaggaatagaagggaacttccacaacctgatcaagagctttgtgaaaagtgaggctttgtgtaaagtgaaggacacacgtatatgagtttgttgtgtttatttgattagagaaccttcactactactgaaaatagaggatctcagtatctaatgaaattaaacttcaggtgttcaagttcctcatgaaattttcttagtggtttgagtgaattgctttttaaagccttctctctttcaaatagtaatgtctttcatgaaagctaatgactatccttatcaatatgcttattctatgcagctaaagcagataccttttgtgtgcctggattattttttcaattgtaccctaatatacatagcatttgctctatccctgatcacttcaagcaacagcattgaacataagaataaatcatctccatcaatcaatacatccaccacatctcagcttcacccttcctagctctctaggtcagaggtcagctaaccacagcccatgggccaaatcctgctggctgcctctttggtaaaaacaggcatactagaataaaaccacatccattattttaaagattgtctatggctgatttcatcctgcaatagtagagttgagtagttgcaatgaagattgtattgcccacaaagactaaaatagatactatttggccctttacagaaaatgtttgctgttgtttggcctaagatgcagtgtttttatttgttagttttgttttatgtgtgtatttatttatttattttgctttggctttcttctcttaattgctgcaattttttaaatgccttttctactccaatgtgcatttatttgcccaatttattatttaactaattttgaccacataatactcctcactatattataaaaccatgagaacaagtataattttaccttctgaatcattatctccttctgcccagtagattttaacaactaaatatttattaaatacataaataaatgctacatgggtaaaatacttcaaatttattttggaataacaaagagaataaatttattaaatactccagttctcctaaaacccatttcaatattgttctaatcatactagcaagttgaataatttactactctgaaaatgacatttctgttattaaatatagtagttactgtcaactgaaataaatgcatacatttagaaaaggagagaaaaaaatttatttcttataaagggttacagcatttggaaggaggaggtgtgggggtaggtgctttatgatgaacaggttagctaaacatacatattcagcagattacaggatgatctgtgaatattcatgaaaggggttgtgacacatgcatattgaatacacatgcatataacatatgacccatgtttactttgggatgaagacttaacttttacatgtattacaattaggccctctatatcaaaaggtcttttcaggacatgaaggtgcacaagtgcacaatctccgtaagccagccagaaccagttcatagtcagtggtcttatctggagaaagctaatgaaatcagtctcttgtccagtcagagctgtagttatagcttgtggaacacgggctgaggatcagcctagtcagcagctggtggaactgaaaattgttttaatatcacttgttttgagaccagtgcttgtttagctgctagagaaaaagaaaatccttgtgacagttagaacatagtttattctttaagtgcaggaatgtgtgatttaacctttgcctggcatgtccttagataatgtttataatctaatatcttattgtcacatagagtctgttctgtcagccttttaatctctattttaacattaatgctggtcagttgttctgtccaaaccacaaaatggagggggtgtaacaaggtgtgtctgaccttccattctgtcatggctgggaactcagttttaaggattttctgcgttcccctttgccaagagagggtctgttctttcagtggggggcataggattttatttttaaattttaaaatttttaactttgttttctttggggtacatagtagatatataaatattataaaatattataaataaatattatggggtacatgaaatgttttgatacaggaatggaatgtataatagtcacatcatgaagaagggggtaggagttttttttagtttacattactttaatattggacccctgaaacacactgtcctttgtttaaaaaagtaaatttgaaaaacttttagggaaatcttaaaaaatggcaataatttaattttaaaccacaatttatcagtcatatatacatgactgatatatagagaacacagctttatatatacagtgtttagctattgatatggtttggctgtgtccccacccaaatctcaacttgaattgtatctcccagaattcccacgtgttatgggagggacccagggggaggtaattgaatcatggggcccagtctttcttgtgatagtgaataagtctcatgagatctcatgagtttattaggggtttccgcttttgcttcttcctcattttctcttgctgctgccatgtaagaagggccttttgcctcctgtcatgattctgaggcctccccagccatgtggaactataagtccaattcaacctcttttacttcccagtctcgggtatgtctttagcagtagcatgaaaacggcctaacacagctgtgaagttgtatatcaatatcactttctggttccccttagaaccctcaggagtttctcttttctgttaattaaaatttcacagtcacttttaatctattatcattattctgcagagtgaactgtttgaatagagaatcaattaaaagcatagcacagtaaaacgtggggatgttttgcaacttgggcatatgaaaagtagtgaataagaatcattttcaacctatgatatgaaagaagggagatcctgggggcatccatagtcaaacacttggttgtacacttggagatgttttttcaagccttggattattactaacagtaaacaagaaattcactaactagagaaagcagatatgagtacgtacagactatcagatcacaaacagcagttagtaaggtgatctaactaaaagctgtagatggtgtctctttgaactaatgctactttgagcggtctaaaagcatgattgctacatgatgctttaagaaatctgcctagtacctgacagcatattgttcatactagtatctgtagctgtaaatttagattttaataattgtttggtacatattaatatataattttaagataaaaaggaaattgattttataggttatatcctatatctttggcttaaaatatattgtagaaaataatgtatcccatcaaattccatggtaaattagtgagtcacagcgaaagttagaaacactggcctacaacttttaatgattaattacttggccatgaataagccatacattatttagatgtatatttaattttaaagaaatctgcattttaatatttctgaatatgtcattagttattaagaagattactataaaaagcagtattcaaaaatatattttacagtttactttagtttttagtgaacattagaatgatagcatggccatgttgtttatcactgaagcacctaggagagttagcaaatgttaatcctgctagtgtcatcaagactaaacaaattataaagactaaatatccttttttttttttttttttgagatggagtctcactctgtctctgaggctggagtgcagtggcacgattttggcttactcctacctcagcctcccaagtagctgggcttacaggcacgcaacatcacccctagataatttttgtatttttagtagagatggggtttcgccatgttggccaggctggtctcgaactcctgacctcaggtgatccacccactttggcctcctaaagtgctgggattataggcgtgagccaacatgcctggcaagattaaatatacttttaaaaaattatatttttttctattgacttagaaatcactctacattaatgacatagtcaaagagattttacttttgttctcttgtaaataaaataccagattaaaggtatgcttaatgtgataaagtaaagccaaaatccaaaccagaaaatctagagtcataaagttaaagccacaattatatcttattctcttacctactcatttctttttccccactactgagaggatagagtcacatagtacaaatcagcagaagtcctcattattatattcttgcttaggcaagaattcatgattgcttctttgtccttatcccttttccaccactcaagatccatacaatagaagaaatagagaatcatttaataaagttgtcttccattcaactctgaagaaaatatcaacagagaaatggaagtcttttccatgcactcataggtaaagttttgagatcagcttgaaaggaggtagctcaattggaaattacataaaaaattccaggaaagatgggttgtgagactatctcagaagagaaaatctagggtttgtttgtttgtttgtttgaagatattgtagattgtattgaacctctcaggtgtcaggtcctgatgaaattgtaggctcacaaaattttgcagataggaaagttcttggtgctgagagacttgagatgagcaagtacataatgcagaatttgctaagctaaatgaacagggctgattgaatttgtccttagctaagtttctttattttgtaatgtggtggtcacattgcagagccgcagagcctaggatctcatgatgcttctaggcctgtgtttttggcaactaaattgtgatacatctgggatagctttggtaaaaagtgtgtgcagcccatctggggtcttccagccatagaattcctctactgtcatgtaagaagtctgtttatatgatttagaagcaggtaatacaggttgactaaattggaagtggagctgggcagtgtttgtaacccagaaaatatcttggtacctataagtgtcaggagatttttctccttttatttaattggtgggaaatgatatttttgagataaggggtttaagttcaagtaagagatgagttattggttgacaagcttttggatcatttaggctacttgtaatcacaaccagttcatcaggaaaagaccaccaggccagaagaggctttcatgacagcatttacacagagaagcatcaatcaatgtcaagcctttcagcagaaactggaacttcatggtgcagcagttcatcttcgcatgggccgggaggttgaacatcctgcatagtgctgccaggaaatccctatttcatataagagggggctggctggttgcatatgtaggatgtcccatctcccagcccacttcgtcatgacagacaccagaaacaccactctgcttcactgaagaacaataaaatctgcgtgtcatggaaacacagatgctagagctgcatcactagaaaggcattctgacaaatgtatttagaggagggtagagtactgactgctatgaccttggctcataagaggcagtgggtatgtgagtggatctttaagctcagggccagtagatctgcattaaaccatattagcaacaacactggccacacagataatgcctccagaattgtgccacctactctcagagctacaccgaattagggagattcaatagttgggcatatttatttaggctagccagagccaaatacctagaggtagagagaatctaattcttaattatagaaaaaaacaaagattatatcctgaaaagcagcctagaatttcaagtctgagggtcaaggtaagatagtaaattaaaaaatatgtctcaaagtcagaagaaggatatttgggaggagtattccagagaagaactaacaattctaaattgagcagaaacagtctattacactttgaggcaagaatcaagttacaaggaagtaggtgtgattgcaaagggagaaagttagcggcatgtccctacaaatatttcagagatataatttctgtcagctgcagtatccaatcatatccagggaattctgtcaaaagcaaggtgataggaaatatcgagagcagggcccagctcttaaaaacatagggcaggattaaaagtaatgcaaaatccagccaatcctagcggcccttctacttctggattggtacaggaaggatataatctcagaatagaaataagccatttaaatggaatatatttagctttataaataattggctgttatacataattttccattttcactttagactgctgaaatttcactatggatctttatatgaaaatgactaatctgtaggagatgctactggcagagaatcaattatgtcaacagcacaaacttgagttgtatcctgggatgctatcgagttttccactgactttaaattagggtcaagttaaacaggccatctccaaagactttggggttctaaaaaatgttgatttgctatgcattcgaatctgggatgagtttctagtcaaccatcctggctttggcattcttcacagtggatggtaagtgggccaatcttaggctgaaaaacaggctgatttagggtttgggatttagagcatttatatctctttattttcctcagcagcacagactctccattggaattaggggcttagtgaatagttcaaaaaacgtatggtttcatatacaaggaccccaaagttccatgcaaatgtatgagcatactgttatgtataatacccatgtaatttctgtagagtctatagagatatcacctctttgatcactgataattgataatgtgtggcttctacctttaattcttagtcgatctgttgagaggtttatcagttttattgatctattcccaataaagtgcagcattttatttcattgaattctcaatattatagtattgcctaaattttattgatttctgcttttatatttatttatttcttctggtacttggatttcatttttccttttttgcctagcactttaattttggaagcttagatcatggatttgagttttcttttctaaaataaaccattaacgttagaaaattccctttgagtactactttagcaccatcagacaaattttagtacgttttgttttcattttaatttacttcaaattattttttaacttcatttgccttttccttttgaaacatgaattatttagaattgtgttatttaatttgcaaatatttgaacattttcaagatatctgttttatttgttttcaggttaattctgttatactcagacaacacacgttgtttgattgcaaccattttaatttcttcaggtatattttatgagccagaatatggtctttcctggtcaattttccatagttcttgaaaagaatgtgtactttcctgttgtcaggtggtatgttttatcaatgtcaattaggtcaagtttgttggtaatgctgttcagttcttttacctcagtgataattttctgtatgcttttctgtcaattaactgaggaaggggtgttgaaatcttgaagtgtaattgtaattctacttttgatttcttctttctgctctaccattgttgtgcttcatgaattttgaagccctgttattatattttaaatgttattatattttaaatgtattataaacgtttaggactgttatattccctcgatgaattgacacctttatcattataaaatggtctgtgttacctctggtgatatccgatgatctgcaatttactttatctgttattaatataaaaattctagcatttgtttaattagtgtttgcacagtatatcttttatccatacttttattatacaggttgagcatctctagtcccaaaatctgaaatctgaaataatccaaaatcaaaaactttttttttttttttgagacagggtttttctttgttgcccagtctggagggccatggcacaatcatgcagcctcaaactcctaggctcaggtgatcctcctgcctcagcctcctgagtagctgggaccacaggtgtatgccacgatgccgggctaagtttttaaagtatttgtagagacaggatctccctatgtttcccaggctggtctcctgggttcaagtgatcctcccacctcagcctcccaaagtgctgagattacaggcatgagccaccatgaccagccaaaatacaaagctttttgaacatctatatggtgccacaagtagaaaatttctcagctgacctcatgtgactggtcacagtcaaaatgccatcaaaactttgtttcatgcacaaaattatttgcaatattgcataaaattaacttcaggccaaaaaataaatgaatttcacgtgtagacttgagttccatccccaacatgtcttattatgtatatgcaaatattccaaaatatcaaaatgtccaaaatctgagactcttctaatcccaggcatttcagataaaggatgctcagcttgtacaactatctatattattaaatttaaatttgtagagtttcttatagacagcatataattgtgtcttgtttatttttattctcaattttaatccaaaatcgctatctctttccttgaattggtgtgtttataccatttagatttaatgcaattattgatttgtttggacttatgtctaccgtgttttgttttctatttatcccttgtcttttccactcttttatttcctataggaatgggaaacattcttttgtttcctaattctgatttattatgtttttttctttttatttgagtatttcaattttattgatctattggcttttttactatatttctttgtacagtttttttgtttgttaagtgacaatgctctgaattaaaatatacctgtatattataagtatcccttatccaaaattcttgggaccacaatgctttggattttgaattttattagattttggaatattttcattatagttaacagttcagcatccctaatccaaaattccaaaatccaaactgctccaatgagtatttcccttaagcattatctcagtgctcaaaaagtttagattttggagaatttgggatttcaggttttcagattagaaatattcaacctatatatacatattttttccaagtttcttacccttaatattttatcacatcaagtgaaagataaaaccatatatgctcctttatcctcctttttttggtcttagttgtaatatggattacatctacatgcattgagaaccttatcagacaatgttacaaaatttttgcttctgagaatcatatgtattttaaagacttaagaaaaattattatattttctaagatatttaccgtttctgttgttcttcctttgttcctgatgttttcctttagtgtaattttcctttagtgtaatttcctttagtgttttcctttagtgtaatttccttctgcctgaaaaacatcctttaacatttttagaccaagtctcctagtttagagagacttgttttagagcaatgagttcctagtttcccttcacctgagaatctctttatttcacattcatttgtgaaatatatttccactggatatggaattttgaattgatagctcctttctttcaggcttttaaatttgtggttacactaccttctggttttcatggtttctgatgcaaaatctgaagatatgcaactttcaatgtttttgtctttatcttttattttgaccagtttgattatgatgatctaggtatgattttttttttggtttaaacatttgagttttacagaacttcttaaatctgtaaattttttccccccaaatgcggcatgttttggaccattatttcttcaaatagtatttcttcatcaatttttctcctctccttataaaattccaatgatacaaatgttaaacatatagttattgtcccacagatccccactatgttcatttatttttaattttttcacactgttgttcagattatataatttatatggatctaactttagttttcatgactctttatctgtcatctctactcttctattgagtccattcaatgatcttttttcaaatattgtattttttgagctccaagctttcagttggttctttttaataaattatactcattatttgagaactcctacctttctattcatttcaagagaggccgccttccttcactgagcatgattagggtagctgccttgaagtctttgtctacaaattccaacatttgcgttatcgaagggttgctgtctttgattctctttttccttaagaatttttgagatttttctaattctgtgtatatttggataaaacattttgtatctttgacactttgaatattatgtcttgagatctggatcctttattattgagataaaattcatataacaaaattaacaattaaccatttaaaagtatacaattctgtggtatttagtacattcacaatgatgtccaaccgtcatctctatccagtaccaagatattttatcactacttccaaaaaaattccatatccattaagtagcttttctacattgccccattcctcagcctctggaaaacactagtctcctatctgtctttaaggatttacctattctgaatatttcgtataaataaagtcatacaatatgtgatcttttgcatctggcttctttcacttagcatgatgctttcaaagttcaaccataatgtgccatgtatttgtaattcactctttttatggttgaataatactccattatctgaatatagtacattctgtttattcatctgtcagttgatagatatttgggttgtttcctccttttggctatagtgaaaagtaccactataaagagtcatgtcaaatacttgcttgagtatctataaatagaattgctaggtcatatggtaattccgtgtttggcttttaaaggaactaacaagctgttttccacagtgacggcaccgtttcactttatcaccaacaatgtatgaggtttccaattttttctccacatcctcaccaagacttgacatttctcattttgtttttggttttgtgtttacggtcaacctggtgggagtgaagtggtttctcatggtggttttcatttatatttctctaatgactaatgatgctgagcatattttcatatgcttgttggccatttgtatatctcatttggagaaatgtctattcaagttccttacccattttttatttgcaaatattttcttgcattctgtgggctgtttttacactcttctgatagcactctgatgcagaaaaaatttttaatttaatgatgtccaatttttctatcttttctgctaatgctactggtgtcatatctaagaaaccattgccaaatccaaggtcactaagatttacccctgtgtccttttctaagtgttttgtacctttggtttttatatctggatctttggaccattttgagttaaattttgtgtatgttgtgaggtgagggttcaacttcaatcttttgcacgtgatatctacatgcaattttcccagcattatttgttgaagggactgttgttttccattggaaggtattgtcacaagtgtaaaactcagctgactgcagataaataggtttatttctggcctctcaatcctattctattaatctatgtctatccttatacttgtaccacattgtttgattataatagctttccagtgaatcttgaaattgggaattctgagtcctaaaatttttttctccttttcaagattgttttggctattcgagatcccttaagattaaatatttattttaggattagcatttccatttctgccaacaaacacattagggttttgatagggattgcattaaatctgtaggtcactttgaaaagtattgccattttaacaatattaaatgttccaatccatgaacatggcctaactttcaaaattttagttgcctgcagagctcctggtgtatagtggtgttgccactatagatgggcaatttaatgatcgatgcttgcctccttttatgccaggatagaaaaagtgaagcaaagaaatctctctgttttatgcctgtcctcttgtcccctgggaagacagtatttttcttggaggtttctttctgcacatccactacacagtttgaagatttcgggccgtactaaaatctaagccaggaggtaagggaagtgggaagggaaaggaaaataattcttttattggtcattgtttaacttttattgtcttgcccaattagtctgctgttatttatttttcacatacctcagttacttgttttgggtatatgtgcacaggttttagttgtaatctataggagagataggatgaaatgtgcttacttcagttttgccagacctgaaagacttttaattggtaactttttatttttttatttatttattttttttagtttctttatattttattttattttttttaagagttaaagagataaactttattttatttttttatggagagtgctgttttttgttttttttattattatactttaagttttagtgtacatgtgcacattgtgcaggttagttacatatgtatacatgtgccatgctggtgcgctgcacccactaactcatcatctagcattaggtatatctcccaatgctatccctcccccctcccccccaccccacaacagtccccagagtgtgatattccccttcctgtgtccatgtgatctcattgttcaattcccacctatgagtgagaatatgcggtgtttggttttttgttctcgcgatagtttactgagaatgataatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttagagttctttgggtatatacccagtaatgggatggctgggtcaaatggtatttctagttctagatccctgaggaatcgccacactgacttccacaatggttgaactagtttacagtcccaccaacagtgtaaaagtgttcctatttctccacattctctccagcacctgttgtttcctgactttttaatgattgccattctaactggtgtgagatggtatctcctagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgttggagtttattgtagattctggatattagccctttgtcagatgagtaggttgcgaaaattttctcccattttgcaggttgcttgttcactctgatggtagtttcttttgctgtgcagaagctctttagtttaattagatcccatttgtcaattttggcttttgttgccattgcttttgatgttttagacatgaagtccttgcccatgcctatgtcctgaatggtaatgcctaggttttcttctagggtttttatggttttaggtctaacgtttaagtctttaatccatcttggattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttctttccaattctgtgaagaaaggcattggtagcttgatgggtatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttgtctctctgtttgtctgttgttggtgtataagaatgcttgtgatttttgtacattgattttgtatcctgagactttgctgaagttgcttatgaccttaaggagattttgggctgagacaatggggttttctagatatacaatcatgtcgtctgcaaacaggggcaatttgacttcctcttttcctaattgaataccctttatttctttctcctgcctaattgtcctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacaattattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcctttttggttgtgtctctacccggctttggtatcagaatgatgctggcctcataaaatgacttagggaggattccctctttttctattgattggaataatttcagaaggaatggtaccagttcctccttgtacctctggtagaattcgcctgtgaatccatctggtcctggactctttttggttggtaaactattgattattgccacaatttcagatcctgttattggtctgttcagagattcaacttcttcctggtttagtcttgtgagagtgtatgtgtcgaggaatttatccatttctgctagattttctagtttatttgcgtagaggtgtttgtagtattctctgatggtagtttgtatttcggtgggattagtggtgatatcccctttatcattttttattgtgtctatttgattcttctctctttttttctttattagtcttgctagcagtctatcaattttgttgatcctttcaaaaaaccagctcctggattcattaattttttgaagggttttttgtgtctctatttccttcagttctgctcttattttagttatctcttgccttctgctagcttttgaatgtgtttgctcttgcttttctagttctttcaattgtgatgttagggtgtcaattttggatctttcctgctttctcttgtgggcatttagtgctataagtttccctctacatactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgcagtgtggtctgagagatagtttattataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttgatgcaaggctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttaaattgatccctttaccattatgtaatggccttgtttgtctcttctgatctttgttgatttaaagtctgttttatcagagactaggattgcaacccctgcttttctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgggtattttgctcgttagttgatgcagtttcttcctagtctcgatggtctttacattttggcatgattttgcagcggctggtaccagttgttcctttccatgtttagcgcttccttcaggagctcttttagggcaggactggtggtgacaaaatctctcagcatttgcttgtctgtaaagtattttatttctccttcacttatgaagcttaatttggctggatatgaaattctgggttgaaaattcttttctttaagaatgttgaatattggccctcactctcttctggcttgtagggtttctgccgagagatccgctgttagtctgatgggcttccctttgaggataacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacaccaatcagacctagatttggtcttttcacatagtcccatatttcttggaggcttttttggtttccttttattcttttttctctaaacttcccttctcacttcatttcattcatttcatcttccattgctgataccctttcttccagttgatcgcatcggctcctgaggcttctgcattcttcaggtagttctcgagccttggttttcagttccatcagctcctttaagcacttccctgtattggttattctagttatacattcttctaaatttttttcaaagttttcaacttgtttgcctttggtctgaatgtcctcccgtagctcagagtaatttgatcgtctgaagccttcttctctcagctcatcaaagtcattctctatccagctttgttccattgctggtgaggaactgcgttccttttgaggaggagaggcgctctgctttttagagtttccagtttttctgttctgttttttccccatctttgtggttttatctacttttggtctttgatgatggtgatgtacagatgggtttttggtgtggatgtcctttctgtctgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgtgagaaccactgctctcttcaaagctgtcagacagggacatttaagtctgcagaggttactgctatctttttgtttgtctgtgccctgcccccggaggtggagcctacagaggcaggcaggcctccttgagctgtggtgggctccacccagttcgagcttcctggctgctttgtttacctaatcaagcctgggcaatggcgggcgcccctcccccagcctcgctgccgccttgcagtttgatctcagactgctgtgctagcaatcagcgagactccgtgggcgtaggaccctccaaaccaggtgcgggatataatctggtggtgcgccgttttttaagccggtcggaaaagcgcagtattcgggtgagagtgacccgattttccaggtgtgtctgtcacccctttctttgactcagaaagggaactccctgaccccttgcgcttcccaagtgaggcaatgcctcgccctgcttcggctcgtgcacggtgcgtgcacccactgacctgcgcccactgtctgttactccctagtgagatgaacccagtacctcagatggaaatgcagaaatcacccgtcttctgcatcgctcaggctgggagctgtagaccagagctgttcctattcggccatcttggctcctccccctcggtaactttttaaaacatgtcattttatcattgtatgttgttttatgaaaacaaaattgattgatttttttcagatattgactttatatacaacaacctttctaaactcgttaatgctcaacatttatctgtaaatttttttatgtacacaatcatgttttcatttttccttttaagtcctgaacatttttactttcataacacagtaataagtaactctagtacaatgcacaatggatgttgtgatggtagactttcttgtttttttccaacatttaattattaaatatttgagagacatactttagtttaagaaagttagaatcttagtttgctgaaatttattcaacttgaactacgttgagttatatttaaaaatgtgtgcctacattgacttactcacataattttctccttatttgtttactgtgatacatcttcaagctttattttcaaagttatactggcctcatgaagtatgttgggaaataatccccttatttattcaaagaatctgtgtatggttgatgttatttttttcttacatagttgatatcacaagtaaatacatttggatctacattgtgccatccaaagaatatagtatgatataatatctctttagatgtagatttatatttttccataagatttggtggttattttgttgttgctgtttaatctttctaattttaaattaagagagtacgtgtgcaggttttgtgattgtattttcatgtaggacctgtaattatcttgttaaagttttaataagatttttaatgaattttgtcactgttgcaaatagactattttccctttttctatctctggcacttgttcttggactagttaaacctctagattattttatatttatcttgtatccagccagactattatattctctcagtaaatccagcatagtttttagaagagtctcagattcgctagtcctacagtcaaaaaaaaaaaatcaccgataaacaagagatcattttataccttgttttccaaagttatacaagttagtttatactcttatcatagtgaaaattaataacataatgatgagtaatggggtaaactggcatcttgtccaatttctaaatttaatgtaattgaaatacatttattgtattgctatttataatatttgttgtaggttcttagtaagttatctttatcaaaattaagggcactgcctttatcccttcattattaaaattttaattaggaatggcttctgtatttaatcaaattactcttcaatatctattaaaagaccaaaaatttcttcacaaatgctaatatcagggattatattggtagatttcatgatgataaatcgcctttgcattcctggaagaactcttgttttttctgatgtgttattcttttggtacttttttgggctttatttgttaatattttattttgaactttgaatctataataatgaatgctattttctctagtctcctgttttagtgtttttcaagttttgctattgacactgtattgttttataaaatgtgttgaggaatttttaaactttcatggctattcatcttttcatatatgttaacttagagattgattataattttttgtttccaagtgctagctttgggattacttcacagttgtccccacattcccatacatcttaattaaattatcagaatactgaacttttattcttttctcaaaggcaaaaattgtctacattacttcatgaaaataaagtccttttgtattttctttgaacagaagagctgaaagattaatgtcttgtattcagtctttgcctttttttattattggtggggatacctgtgattgctggagtcattaaaaatcatgtaacatttgaatgaatgaacaaacatataaaaatgtcttatgaagcactatacacaattttttcccctgaaaataagatttcatttcactcaactatgaattggcctcccctatggaaagtgtgctatagcctcttggctattcaactcccttcaaaccttttacatattaattgtataaaatattgctggctcacataattccacacattgttctatgctctatggataatggaaaaataaacaataattactgacccaatggagcttatgttctaatggttatggcaacagaattctccacatagtgataatcaggatatacttgtgcatttgaagcacaattggaaacataatttctgcaagtgaaacatgtcaaggagaatacaaaaaccctccacatgatcaacttccatggtggatacaatctgagggagttataggaaaatgatgaacaataatgaacttttggttagaagaacttctcatgatgtatttcctttccttattgcactggttgaattctaataattggtagtttgatttctagtatggccatataagcacttctattgttaaccttttggcaaataaaagctactaacttggaacaaaacacaaagaacaactaccttaaggtattggacaggaatccaaaacagagatattggcaatcacaacacttggaaaaaagaaacaacagaggttgagtttccaactttcaagacttatagcttaagaggaagatgcaatttctgccagaagaggtggctaaaactccaataaaaaaatctttagtttttttggttgggtgtgggggcttatgcctgtaatcccagcactttgggaagccaagacaggtggatcacttgaggccaggagttagagacccacctgggcaacatggcaaaaccccatctctacaaaaaatacaaaaattagccaggcagggtggctggtgcctgtagtcccagctactcaggaggctgagataagacgattgtttgagtctgggaggtggagattgcagtgagctgaaatagtgtcacggcacaccagcctgggtgacagagccagatcctgtctcaaaaacaaaacaaaacaaaacaaaacaaaacaaaacaaaaagtcttcagtttttatggcctgaagaacctgaggaatttgcaactggaaggtgaaggagcacctaggaaaaggtaaagatagagagaaccacaaattcttctctgggaaactataaactctgcctaaatctctagatgacatttaaaccgtgcttgcctgggatatcctacaagcaacctaagaaatgataaatgaactgaattgacatttgagctgtagcccaaatgaaagagactgcagtttgagtccaaccaagctgattgctggaaaaacaaaaacaaaaacaaaaacaccaatactctttggagcaaaagaaccaaatccagcatctcaacgacatggcattcacaatgtttagtttacaatctaaaatattttactttaagaagaaacagggaaagacaactcattcacacacacactaacacacacacatatatacacacacacaacttttaagagacctatcctgagaatacccagatgttaaaattcaccgagaaagattttattgctgctattatatttatatcaataccatcaaagaaaatatgctcataattattgaaaatggaaaacctcagaagataaataaaaacaacaaaaataattgaatggcaatttgtgggctaaaaaataatatatgaaatataaaattatcctggatgagtttaacagtataatggagatgacagacaagaaaagccagtgcatttgaagatagatctatagaaatcgtccgaaattaagatcagagcgaaacacattgagaaaaaaaagaatggactctcaggaatctgtgaaacaatatcaaatgctctaacatgcatgtgatttgagacccagagaatgagagggaaaatgggaccaaaaactatttgcaaaaaaataaggactgaaaaattttcaaatttggtgaaagccgtaagtttatagactcatgaagctcagcaaataccaagcatcataagtataaattctgatgattaatctaagaaaattttactatccaaatatgtataaataattcatatagattgaagcagcaccatttataatggaaaaaacaaaaaatggcaattttactgcctttaatagacatctaagaacttgttatatactggtgaaggttgagcatgtcgccaacctaaacaagagtattataaaagaacaatgagttatacaagatctcttactaatggacaataatgttcacattaaaagtagaggggtttgatcgctgcttcattattatcaagaatgaagcaccagttcatcagtctgtatcttgacatatccttcagcccattctggaagaaaccaaaaatgtccaaaggaaggatgctggttaaccttccagaatatttcaacagccacatttcaccttacttttccttacttccccaagaaaacaagattctgaattgtttatttatcctgtaaggtagtcatgcctactaaggttgcataggagaagagcccagtatctaagataattctcactaacaactccagcagactagaatatgacacatcgtaaaacaattcaccaacagcagatttacaagttggttttttgcctgattcagttgctagattctagatgccaatgtcattacaaaaactttaaacttttaatgatgctccaatatggaaactttaacactactgaaaatagtttagatctcaagttttcaagtaagaacaccaatgttaaaaacaacttacttgcggctgggcgcagtggctcatgcttgtagtcccagcactttgggaagccgaggcaggccgatcatgaggtcaggagatcgagaccatcctggctaacaaggtgaaaccctgtctctactaaaaatacaaaaaattcgcctggagcgatggtgggcacctgtagtcccagctacttgggaggccgaggcaggagaatggcttgaacccggaaggcagagcttgcagtgaggggagattgcgccactgcactccagcctgggtgacagagtgagactccgtctcaaaaaaaaaaaaaaattttacttgaaatgttctgctaatttcggcaccagctcaaagtcagacttaatgccacaccagagactatcatgaaaatggcaacagtaattcatctggtaactgttaaaagtaaaaataacaagagtttctgccacttattaatctttacttctagtatctaacaaaatgtttggcatatagaaaacaaatagctaacatagggtaaattaaggaataaataagtaacgttaaagtaatttatatgaggaggaactttattgttctgtctctccaaaagagcaagaaaatgacctggaaatagttgtcagaatcaactattatgaaactcaaacatcaaatcaaaaatttaaaacaaacaaggtaatgctaaatgaagaagaaacccactgctttgcagtaagggagcactgtagggttttaagctgcctgctaccatatcccatttccagatatgcagctaatttgaggatgaaagcctgcactcctgatgcaagttgctagtgccaaagaaatacagatcttttcctcaaagaaatgtgcttgtctttttagacttctctgatggccccctgaaggactgggacagtaacttcctttgttttgcctgactcagagcatttccagggctcagatgatgttctggttggagtttgccaaaagtattaaaaggcacaagcattgtttgcaacagactaggacaagtaacactagaccacacaaacaagaaacaggctgaatggcctgggaagaaagaggttgggaatggagatacgttgggaaagaaaactttatttttaaggaactcaaatataacagagaatggaaaaagctacacatggcgtgcctaaggatgtcagaatgctcagaagaagcctggaaagacactattcttccacctgtgaccgggctgtccatcagcctctgagattctgctgaagtataaagttgaggctgaggcagagttataaacaacctcattaagcattgaaggaaggtcccaaacagacccaacctgcaaaaagtaagaaagcattcattccttttttttctttgcctaccggtatttaagaaacccctgtaaaagtgctaggtaaccaccaaactaacaggatgctgattttagctgccacagaagaccaagaaaaaagaaaacagactttataaaaatagttttgaaaaatcactaaacagtcaaacaaaatcagtccaaaacaagtagcaacaacttcaggaagggaagaaaatctgatttacagatctgccacattgtaatattaagatgtccaagttttaccaagattaaaaagcatgcaaataaactaggaaatatgacctattttcagaaaacaaaatagaatagaaactgatcatgaggaagcccaagcattggacttaatagacaaagactttacatcaactgtctcaaatgtactcaaagagctgaaggaaaccatggagtaagaattaaagcaaaccagaagaacaatgtctcaagggatagagaatataattaaagggataaaattgtaaacaaaaaacaatggaaatatggcagctaaaaattataataactgaaatgaaaaattcacatgagggaatcaataacagactttagcagacagaagaaagaatcagagaacatgaaaacaggtcaattgtgattatccagtccaaggagcataaagagaaaataataaataaaaatgaacaatgcctaagggacctttgagacactatcaagtttaccaatatatgcacaatgggatttccgggacatgagagattaaaaggatcagaaaaaaatatttaaagaaataatggccacaaactttccaactttgaataaagacatgactataaatccaggaagctcaatgaactctaagcaagaattactccaaaatatccaaaccaaggtgcagtataatcaaactcttgaaaggcaaagagagaatcttaaaagctgcaacagacaagcatctcatcaaatacaaagtatctttaacaagataaacagtgaatttctctacagagaccatggaggccggaagcagtgagatgacatatttaaagtgctgaaagaaaaattgtcaactaaatgctctaaatctggcaaagctatccttcaaaaatagagaaattaaaacactcctggtaaaagagcaaaaacaaaaacaaaaaatcagaaggagttaattactagtggacctaccctaaaaaaaaatgctaaagggagtccttcaggatgaaatgaaaggacgccaaaaagtaccttgaaggcatataaagaaataaaaaacaacaaaagtagctacaaagcaaatataaaatccagtggaattgtactatgggtttcttacacctgttttgactttctatttcctttaaaaggcaaatacataaaacaataattataaatctatattaatgagcaccaaatgtataaaaaatgtaatttatgaccaatagcaacataaaaaaggatgaagatgtaaagaagcaaaatctttgtatagtattgaaactgagtatctataattaaaacttgattgttatggaagaaagattataattgtaatccccaggttaaccaaagtaaacaattaaaataatacaaagagaaagagacaagaagagaatccctacaaaaaaatcagttaatcacaaaaaaatcacttaatcacaagtgaaggcagtgacagaaaaaaatgatagtatatgttatagataaaatggtgcaagtgtcttttctttactgtaattactttaaatgtgaaagaattaaattttccagttaaaaggcagacactagcaaaatggataaaaatacatgatccaattatatgctttcaataagagactcactttagacataaggacacatgtatgttgaaagtgaaaggatggaaaaagatattccatacaaacagtaaccaaaatagagttgaggtggctgaacttgtcagacaaaatagaacttacaaagatagttgttgtgaacaacatcaactaaaagaagaacatcatctattgatttcaagccatcaagaacatataacaattataaacatatatgtacctaacaacagagcccaacaattatacgaagtgaaaaataaaagaattaatgggagaaaaaggtagatctataataatatttggagatatcaatactccattttcaataatggacagaacaacaagacagaaaatcaatgaggaaaatagaggacttgaacaacactataaaacaactaattctaacagacagatacagaacattccatctaataacaacaataaatacattttttctcatgtgcacatggaacattctctgggatggaccataagttttaccacaaaacaaatgtcaatacatttaaaatattattattatttaaagtatcctaatacatttaaaatattattattcaaagtagaaatcagtaacagaaagaaaactaaaaaatttacaaatatgcaaaaattaaacaatattaaacaaccaataagtgaaagaagaaaatacaaatgaaattcaaaaatattttgagaatggcagaataaaaacttaatataccaaaaaattatgggatgcatcaaaagctgcgctcagagggaaatttatatctgtaaatggctacatttaaaaataaaatgaactcaattaatgacctaactttataccataagaaactagaaaagtagagcaagtttaacccaaactcacaaaataactgaaatgatgaagtttagtggaaatataaaaaataaagaataggaaaaatataaggacaattaataaaaccaaacgttttcctttttttgaaaagatcaaaaaagttgacaaatctttagatagacagactaaggaaaaaagagaagacacaaattacaaaaatcagaaatgaaagtgggggtattactactaaccttacagaaattaaaaggattggctggccaatcctcctggtgtggtatctcatgcctgtaatcctcgcaccttgggaggccaaggtgggaggattacttgagcctatgagttcaagagcagcctaggcaacatggtgaaaacccatctctacaaaaaaaaatttaaaaattagacaggtatggtgccacatgtttgtggccctagctactcaggaggcttagttaggaagattgcttgagcccaggaggttgagactgcagtgagccattattacaccactgcaaactagcccagacaacagagcaagatcctatctcaaaaaaaattaaaaggattataaaacaatacaatgaacaattatacaccagtaaattaaataacctggatgaaatgtaaaaatttctaaaaacacacatactaccaaaagtgactcaaggagaaataatctgaagagtcatataaaaagtaactacattgaatcagtgatcaaatacctctcaacaatgaaagctcaagacaagaagttttccttttgaatttcaccgaacatttcaaaaattaacaccaattcttctcaaactcttctaaaaaatagaagatgaagaaacattttgtaatatattctattagactggcattatcttaatatcaaagccagctaaagacattacaagaaaattatagattagtattgtttattaatataaatgcaaaagtcttcaataaaatactagcaaactaaattcagcaccatattatatacccattactaaatgggatttatctcagggatgcaagagggattcaacatacagaaactaatcaatgtaatgtatcacattaatagaatgaaggtatgcaaaccacatgattatgtcaattgatgcagaaaaagcatttgcaaaagtccatcacttttttatgataaaaaaatgttcaacaaactaggaataaaagaaaatgtccttgacaggcatttataaaaaacaaaaacaaaacccagtcaatagtgaaagactgattttcctctaagatcagggaaaaaaggcagaatgcccaacttcattagttctatttatcatggtactgaaaattccatgtagagaaattaggcaaagagaggaaataaaaggcagaggaaaattggaaaagaataaatcaaattatttctatttgcagaagacatgatcttatatatggaaaatcccaaagagtcaacacaaaacatagctctaataaatgaattcagcaaagttgcaggacatttgtagttctatacacagtgatgaacaatccatgaaagaatttaagaaaacaattctatttacaacagcttccaaaaaaacctcaattgataacagcatcagccacaaagaagaattaagtattgatacatgctacgaaatagataaacctcaaaaacattagctaggtgaaagaagccagacccaaaaagtcacaaattgtatgattctatttatatgaaatatccaaattagttaaatccatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtggggggaggggggaggggtagcattaggatatatacctaatgctaaatgacgagttaatgggtgcagcacaccagcatagcacatgtatacatatgtaactaacctgcacattgtgcacatgtaccctaaaacttaaagtataataataattaaaaaaaaaagataaaaagcaaattagagattgccaggagctggttgatgggagaatgggaagtaactgcttaacggtatgcagtttccttttggagtgatgaaatgtttctgaactagagacagatgctagttgcacaatattgtgaatgtactagatgccattggattgtacactttaaagagattaattttatgttgtgtaaattttacctcaataaaatatatgtcacgctgaaggtatcattatcatgatcaccatcatcatccctatagaaaataatgcttcctaaatttcactttctttaaaaggtttagattatgagaaaatataagcagactaaaatttgagactatagtcagtacaatttggatgacgtgttcttgtcttctctctgttctctttcagattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtaaataaaactttttggccataagaattgcagcggctatgctcaatactttcggattatgtactgtgaacaacgtacagacgtcgactggtaacatttgcgtttgatcgggttcttttatttagtaattattcttaacctatttatctgatatttaggttaacaataatgaaaggaatgtaatgtgtattaatatgtaaatataaagtttccatttatgctgctaaattattttatgcattagtatgccaatgaattctgcaacacagatacaaaatgtttgaaatatttaaaatgctttgaaaatgagaaagacataaagtctaattaaagtctaaattttaaaaatataacatttcaatcttatattgaaaagttacatgtatcccagaatattaaccttagtatttttattctaaattcctatccttttcagtagaaaaattaataatgcaatctaaatcatcatcaagtaaatatgtctaaatttttgttgctatgacacctaaaatgtactattttctctcagttttaattgtcttcttgaattctgggtatacaaaaagaaaaaaaaatttgtttctttaaagatttgtagcagtttaaagggaaagaaatgatcatttattgcttatatttgaggtattcataaatgccttaacagtgctaatattaaagccaagaaatttaaacaattggactttaggggttttactttcatgtttttttccttttccagttggtgtaaataatttttcttcatatttatgtttttgtaaagattgaggtaaagtgtgcaacaagatcaagacttctatttaatcttcactaatatcatctaaatattttgactctgggtttattgatcaaatacatttaagttttaagattgttctattgtagattgttctgcctgtgtatagcatagacacctttgaataaaaagtcgtgaagcttgtcccaaaagacaaaaatgaatttacgtaagtttgacttacaaattcaagagttcacagattttgccctagccatcacaaagagttcatctaaaaagatgccagcttttatggtgcttacaaaggaaatacacagacagaatattgttgcatcagcttctagtaatgaaagactgagtaatttgcaatgactcttgtgctaaaggcaaataaacacatggataaaacactaaaagccctaagaagctaatgaaatagaaattgctattggctaagatccagaaaaagacaaaaacccaagaaaaatgattatgacttctagttcacttttgccaatgatgcattataaacctgaagatatgactgacaggtggagacgatcatttcagactcgcaagcaatggaggactagagtaggaatacagagtctggcaagggccaaccaacctgaatttaattctgggatcacaaaaaaaccagacactaggaataaggatcgaccaggattaaatcaccatagacatggaattcagccctggttcaagtcatctatgtaaatgagagaaatcttgggccttaaaattggattaagatgatttcgtattattcaggtttccaattttggggcataaacaaacaaaaaaaaccccataatcctagatttcaacttatttctttcaataattttcaaatgctgtcactgaaatacaatgatatgcagatatatgaggagacaatacaacatgaatcaggtatgggacaataagagataacagaaataaacttacaaacacttcagataattgaattatcagacatacactttaaataatcatttggaatgtgcacatggaaattacatgctgatcttaaacacttcagcaagaaactgcaaactataacaaatgacattaagatttgagaaacacctagaaaatatggaacttaagcataatatgaaaaactaagggccaggcagtgtcttacacctgtaattccagcactttgggaggccgatgcaggcggatcacttgtggccaggagttcaagactagcctggacaacatgatgaaaccccatctctactaaaaatacaaaaattagccaggtatggtagcacacgcctgtaatcccagctacttgggaggctgtggtgggaggatcacttgaccctcagaggtcaagtctgcagtgagctgagatcatgccactgcgctccagcctgggcaacagagtgagactctgtcacacacacaaaaaaaattaattaattaaaaaatgaaaacctaagaactctgtggcagattagagatggcgaatttccaaatttacagaagattattataaaatattaaaaattagctgggtatggtggcatgtgcctgtagccctagctactcagaaggttgaggcaggagcatcacttgaactcaagtgtcttgaggttgcagtgagctatgatcgtgctatgacacttcagccttgatgagaaagcaacactttgtctctacaaataaaagataaaatgaaataataagataaatccaaaaggagtcaataaaagatagaaaaatataaaacgtatactgaatggcagaattaaaaccaaatatatccctaattatatgaattactaaggattctaagactgtcatataggctttcaaaaaaataagacaactatatgttacaagaggcatatataaagcataaagaaagtaaaaggataaaaacaaacaaaaaaattcctccatctaaacactatccaagagaaagactgtatagctatattaatatttgtcaaaatagacttttcggcaaaaaacaaatactccagtgaaagaagattacttactatgaaagatttaatacatctggaagacataaggtaataaatttgtatgtacataattatatgtagatacatatgtaatatacatagtatatacattataaagtaaaagaggacagaacttcagggacagatagacaagtctacaatcatcgcataagatcttagcacatccttctcagcgattgtatgaaaacaattaacaaacctgaactcactgacaagtgaagaatacatattcccatcattgcacaagaaatatttatcaaaactgaccataaagtaattcctcaacacattccaaagggttggaataaattgtttattctttgactgaaattcaaaagaaatagaaatgacttcaaaatagtagaaaaaccttcgtatatttggaaattaagaaattgtttcccaataaactttgacctaatggatttcaaatccattgatgattcttccctaagctatctattactaaggtgatacaatgataatttttctcattttattattcttcctgcctttatttgttggtattatactgtaaggaagtgttttccctccaagtctttgttatttattagttcatgttggtggagactcctggattcttttgtattcagtgtaatatatatgattcattattgcccttaattattttgatgctcaaattgtctcatatttttctaataagaactccttttcatatatcccatcagcttttgagcatttgccagactcaccttttactttccatgccccagttccgaaattagccatttcttacaagaaacccttttagtgggcaatggttttataaagcaggatgcagaagctcagtatgctcattgctaataggatatcattgctcctatatatcaatacctttaatcccaattcacgaacacaggactcttgctactttccaattctttatttttcctcatttttctcacagtgagtaactttgtccccaaaccattgatatatttattatttatattttctatatcctaccatacaagaaattaatttcagaatttctatacccataccactaccaataaatgaaatgcaatgtttaaaatttcattgcaattttatctttagaatgttttccaccaatggcatatagtcaaagcattgtcttcaaaatgctaggattagtttgaattttttttctctgtggttctgataccaattgttcacatttagggattttgttttgtttttgcatgtattccccaaccttgttgactttattttttaatatgtaaaactttaatatgatgctccaacagtcaaaactaggcaaataaaatactcagagaagagtcagttcctcttctattccgtggttaacccattcattagtttctagggcatacttcttgaatttatttttgcaaaaaaaaaaaagattatacacaaatacacgtattgttatttttccattcttaaattaaaagttaaaatgctacatacaaattaatactttgttttgctttgttcttttacttggaaatatgtcctggaaatcactctatcaatttgtaagatgatagatatgcacccaactttatcatgtaaatggcctaaatactccaattaaaagctaaattcattctattattttttacactcactaataatagattgtgttgatatactttatttaaccaatcttctgtgtataatcaggtaagttgtttccaacatttggaagttgccaataattctactaagaataattgtgtgtgtgtgtgtgtgtgtgtgtgtgtcctttgtgtgtgcgtgcgtgcatgtgtgtctgtcttgtgtgtttgtgtgcgcgcgcgcgtgcatgtgtgtgtttcatattattggaagtttaacttttaaataaattcttgctcaaatgtattcagaatttatcttctaaataaattcttagaggaggagttgattgatcaaagggtacatgtagttaggagttgaaccattttgcattcccaccagcaatgcaagaaagcctctgtttccccaaagccttgctaatgaagtttattttcaaactttttagattttgcaaatcccataagtgagaaatgttacctcagtgtaattttaatttgcatctattttatttggctgaagttcatatgattaaatgtatgaaaaccacttcagtgccattgctaaatcagttttaagtgtccttttgctcattttttctgattttttttcatttttatttcttaatttaatagctctttataagttatagacactaaccatttaacatgttataaatgaaaatattttctgtttgctatttgatatagctatggtattttgccatacaaaattattttattttcatgtagttcatcttgtcaatcagatttcctttttatgttgagagtaatggcaacaaattctttcccctaactcaggttggacaataaatcacacatatttttctcatttttacatttagacctctgatacatttggagtttattcttgtacgttgtgacatacacattcaattttagtctcttaaaactaattcttccattgtctcatgctatttatttaaaaagtccatctgtcctgtgatatgagatgccatctttatagtatattaaatattcttatatgcctggacatgtttctgaagttcacattttattccactacactgtctaatcaaatgccaatttcacacttttaattataaatgctattacataaatgttattatctgatatggttagtccctattcattaggcattttttagagcttgtgtagacattactgaaagtttaattttccatattaacgttaacattaacttgccttgttctattctaaaagcctggatattttgacagggatctccttaaatttataatttaatttaagaaaaaatgaacaactgaattttaaaaatgctttctctaatctgtatactaatttaggtggtggccactctgtcttccaaactttactgccaaacctatatgtcactctcatgtcttccttatcaacatttataatgtatctcataagaatcaattttttagctttaccacaaaccaaatctgtcttctatgcattcactagtgactacttaattgtttaatttatgaattttcaaactttttggtctagtgatctctgtatactcaaacattattaaggattccagagagtttgcctttatatgagctatatccatcagcatttaatgtctttgaaattaaaattgaaattttaaattatttttgtctacatttatttaaaataacaatagtaaatccattacatgttaacataaataattagctctattaaaaaaagctatattttccaaaacaaaatcaacaagaagagtgacattgttttagttttttctttttttgacttttataaatttagggggtacaagtgcagttttgatatatgaatatagagtatagtggtgaagcctgggcttttagtgtaaccatgactcggtaacgtacaatgtacccattaaataatttctcatccctctcaccatatacaaaaattaacacaaaatggatgaaatccttaaatgtaatatctgaaactacaaaaacactagaagaaaacctaggaaaaaactctgctggacaatggcctaggcaaaaattcgtgactaagaccttgaaagcacaaacaacgaaaacaataatagacaaatgggatttaaactaaaaaacttctatgcagaaaataaataatccacagagtgaacagataacctgcagaatgggaaaaaatatttgcaaactatacatccaacaagggactaaaatccagagtctataaggaactcaaacaactcaacaacaacaaaagacaaccccattaaaaactggggaacagacatgaccaaacatttttcaaaagaaggcatacaaatggctaacaagcatatgaagaaaatgttcgatgtcactaatcgttagagaaatgttttacagtttttcaaggtgctttaatcatctgacttaatagaagatagctagattctcatctctgtttttttcatccaatttattgcaacaatttgctgtggttcagataattgcggtcattcttatttgacagtgcactaaaactctgcaagtagtagtttcttaagttctgtggcaatgtacaatcagaaaccaaatcactgacttttttatatactgttacattaaaatccactaatgtatctagaaatggatatttcaaatgaatactttacttcagtacttcacatggatattttacccatgatttatattgtaacatcaggcataggtcattaagaaaatattggttcaccgagttacacatattttctcaatgttggtatatttcactatacaatgtcaaaaatcatatacgttgataatcttcatcaaccttaatggaaaaatcttaagatattgggaaagttcaatctcccagagatgaatagacattttccaaaaattacattattcacttgaaacctcagattttatcattggcagcaaatagcatctattttttgcttaacttgacaggctcaagtcatccattattgagaaagtagctgccaaatacccaagtctgaataactctagtgtgtctaacagtcaagtaaagatgttagtctatgaaaaaatacatggctagttaatcttgcaactctaacaattgcataggtactttttctcaaagcaaccatctttttttttttttttttttttttttttttttttttttttaccaaagctgtacatatattttaaacatgaagatattttggaaaatcaggtctaagttttctttctccaaacaggtatgtttaaattctttataatttttttccatacaagagaaactttttcatggtacaaaggatgaaggtaaattacagtcctgtaggcagtcctgttagagtgactgttctatacatattattgaacattttaaataaagggtattcaattaggaaaagaggaagtcaaattgtccctgtttgcagacgacatgattgtatatctagaaaaccccatcgtctcagcccaaaatctccttaagctgataagcaacttcagcaaagtccaggatacaaaatcaatgtacaaaaatcacaagcattcttatacaccaacaacacacaaacagagagacaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtatcaaagcaaccatcttatatcagtatgcagaagatgcgctcttcctgtacttctcattttcttacataggttgttaagaagatgtgtacccacatgttgagatttaataaaattaatattttttactacttcataaagtatattcttaagtaatagtggcttctttccccaaaagtacatagtgataaagaatacaataacttcttgtacagtttggtgtcatctgcttgattcatgccaaggcaccagcagtttcacccaccattacattggcattatcagtaaaattgtaaacacattgaaaatagcaaataacatattaatatttctatggaaatacttttgacttcatgaaactattgaaaaggtttcagagatacataaatgttcatggaacacactttaaaaactaagtttccggtgctagctccctttgtggtatttgatatagtcaatgatgttttgttcataattctccgattctttgctacctatgacacaattttcatttggtttccttttctcctatttctctgtctgctccaaatcattttcttcattttctgctttatccccgttcttccccaggattctgttccttccaattgcttatatacttttcctggcttgcatcatccacagaaataattaaaatctatctaccaatgactcttgaataattatttctattaatttctatctggattatatgcagatctatagcttgtagaaaaactcttagctcatgttccatataaaatagactacagaccagatttggccgatgaaccatagtttgccaaaccctggtcctaataattgtgttctggcaagtatatagtgacatctagtcctggtatttatctttaattccctactgactcataatgttgggcactttttgttatggtttttaagcatttcgacgtcctcttttgtgatgaatttttaacaccatttgcctattttcaattttttaattctagtgtttttttgtatagtctagataagagttctttgtcggatatgtatagtgaaaatattttttcccaatctgtgcatgaccttacactcgtttaaagttcaatttgtcagcgttttctttaatggccagtgattttttatccggtttatgaaaagttttctcatccagagttcaagaggatattcaagaggataacctcctctgtctttgtatttccttcctttcttaagtgtttgatcatcttagctttcacatttaggtccaggagccatcttaacttaatgtatacgtctgatgcgagctagagattgaattttttccctatgtgaatatccagttgactcagcatcatttattggaaagattattcttgcctaccgaattacaatggcgtcattctcataagtcaggttaccttatatatgttgtttctcctgggctataagttctgttctattgatctaatattctgtccttgtactagtattacaatgtcctaattactatagctttatactaagtcttctaatctagttgagtaagtctgtcagctgtgttcttcttcaaaattttctgggctagcctaaggccttttcattttcatataaaactaaaattagcttgtcaacccccaaaacaaaatatgctattgttttaaaattggtattgcattaaatctataagtcagctaagtgaggatttgtcttaacaatactatggcttccaatccatgtacgtatgcatatgtacatgtaaataatctactatttatttaggccttctttaatactctgttatgttttatttaatttagaggtcttgcacatctttgttagatttatcgttaggtacttgatttcctaggatgctattgtaaatatttctagttgcttgctgctagcatataaaaataaaatacatttgatatttttgcatttactctatacccagctatctaaattcacttaacatttcttggagtttgttaaaagattcattggaattttcagcgtacctagtggtgtcacttgtgaatgacgacagatgtatttctttttcttctatcttaaaaatttttttaattaattgttcttgcttgattgcactggtaggacttagaaaatagtgtttaatacaagtggaagtagtagacatcttttttttttagtggaaaactgctcagtatttcaacattaagaataatatttgtaagttttgtaaaatgtctttcatcaaattaaattcccttttattctatattttctgtgtcttttttatcataaatatgtgtaacttttccaaatccttttttctgaatccactgagatgattataggatttatttcttcctttattctgttagcatggtaaattgtatacatttttgaattatatcttgcattcttgaaataaatcccactttgtaatgggctttttttttctatatcattggattattttttatattttagttaggatgttttaatccattccaatgagagattttgccttgtcattttactttctttagtggtatccttgtctagttttggtagcagggtatgcaagcctcataaaatgagtttgaagctgtcccttttgacctaccttatatgtttgtgtaaagtttgcatctttttattttaaaatgtttggaagaattaatgaatgtagtcatttgatactgtcaccatctgagcctgcagggtggtatgtgtctgtgtgtgtgtgtgtgtgtgcgtgtgcatgcatgtgcacatatgtgtaaaggttcttaattatagattcaattgcttcaacatgaatggcaatattaatattttcttttgtgtgtgttagttttggtaaattgtaattgtcaaagaatttcttctaaggtttctaatttattggcatcaagtggtgtaattaccatccttttaatgtctatataatgtgtagtgacttcctgtttcgcccagagaatggttatctctgttttctctctttttgtgtttagtttactaagagtttataatttttttttaacttctccaagaattatcttttggagtcatcaattttctccattgtttgtccattttctatgtcattgacatctaattttacctccttctttctacttactttgggtttcattttctcttttttaacttcttaaggaagaaagttaagtcagtgactctgggccttacttgatttctaatatacacatttaaatccataaatttttctctaaattctactttagctgtatctcataactgttgatgtgtattttaatttcagctcaaaatatttactaattcccttttttaatccatggattatttggaaacttgtagtttaattttcagacttcaggaaattttcaaggtatctttcttattgagttgtaattaatgccacagtggccagggtatatacactttatgtttccatcatttgacttttattgtcattgccttttggccagcatatggtttacagtgataaatgttctatgtctacctcaaaagactatatatattatgatgttgatagacgtagtaacagaatgtgtgttttgtaacttttctatgtgtattttctagttactgcaagagttgtgttaaaatctctgacaatcatcatggatttgtctatctctccttttagtttttttaacatttgttctataaattttgaggttatgttatttggtttctttaataaataagattatatctttccataggattgacacttttatagttatgaaatattcctctttatctctcctaatactttttgccctaagaactaatttttatgatatatcagctttctttcagttagtgtttccatagcataacattttctatatttttaaaacaggctctgtctttatatttttaaataattcacttataaagagcatatagttatttcttaatataatctgaaagtatttcatttttagttgaagtttttaaaccacttaaacgatatactttagtttacatctattaatttttgttagttttttctttgtttctttattattctttcttttgtaaaaagattcatttaggtaaatttgatgtaagataacctgcactttttaaaatgtataatttgacaaatattacaatgtgcataaacccatgaaaacatcaccacactcaagatcataaagatagccatccccatcaagtttcctcatgcccacttgtaatacttccctccctcaatcatacttcactgtccctgaacaatcactgatctgctttctgtcactatgctctagcttgcattttctaaaatgcaatacgtatactttaaaaatatatatttaaggtatacaacaggatgttatgagatacatagagatagtaaaaaggttactatagtgaagcaaatgaatatattcatcatctcatatagttacctatttttgtgtgtatggcaagaacagctacaatccactcatttagcatgaatcccatacatagtataattttattacctatcgtccacatgttgtacattagatctctagacttgttcagcctacatatctactactttgtactctgacctgtgtctccccatcacccaactcccactgttttattctctatctctgtatatttcaatttttctttagtttccacatagaagtgagatcatacaaaatgcttctttctgtgtctggcttatttcatttagcatgtcttccaggctaatccatgttgtagcaaatggcatgatctcattctgttttagggctgaacagtattccattgtgtatacatatgtgccaccgcttatttatttattcattcattcatggattcttagattgtttccatatcttagctattgtgaataatgctgcaatgagcatgggagagcacatatctttacaatgtgacgatctcatttctatttctaatatttctaaaatattaattttgaagaacctccatactgttttccatgatggctgtactaatctacatccccacaagcagtgtacaagtgttgcctttcctccacgcatttgccaacacaggttatattttgattttttataatagctatcctaactggtatctcataacggttttgacttgcatccctgatgattaattgatgttgcgcacctctacatatacctgttggagatttttatgtcttccacagagaagtgtctattcttgtcttttttctaatttttaaacaggatatttgtttttccattattgtgtgaacaagttattgataaattttggatattaaccctttaacagatatatggtttgcaaatatttttttctcaattcataggaaccatttcatcttgtggattatttccttcactgtttagaagctttttaattcgatttaatcccatttatttatttttgcttttgtagcctgcacttttgacatgatatacaaaaattcatttccaagcctaatgtacaagagcttttcctttatgttctcttctaagagatttacagtgtctagtgttgtatgtaggccttttatacattttgagttgatttttgtgcatgatgtcagataagggtcaaatttcattcttttgcatatggaaatagagtttttacagcatcatttatttaagaaattatccttttcctattgggctttattgatgcccttgtcaaaaacaaattgacaatttgtgtttggatttatctctgggctctctattctgttttactggtctgtgtgtctgtatttctgcctggaccatacgatattgattactatagttttgtaatactatcttaaaaaaggaagtatgatgcctccaacttcatttgttctcagaattattttggctatttggggtcttttattattccatacaaattttattattgcttttgctatttctgataaggaaggcatcgggatttttaaaagggttgtgttgaatctctatattgctttgggcagtatgaacattttaacaatattaattctttatgtatatataatagttgtacatatttttctttatgtatatataatagttgtacatattttgtcacatacttgtgacattttgattcttgtgtagaatgtgtaatgagcaaatcagggtaactgggatatccaccacctcacatttatatttgttttggcgacgttacaattcttctcatctagctattttaaaatatacaataggttattgttaactatagtctcccaactgaactatcaaatactagaatgtattccatctatctaactgtatctttgaacttcttaaccaacttctcgtcatctccctcaactcccctacccttctaagcttctggtaacctgtcttactatgcctggcttatctcatttcacataattacctctaggtctactcatgctactgcaaatgacaggatttcattcttcttatggctgaataatattccaattgttgtatatatcacattttctttttccattcatctgttgatggacacttaggtagatttcatatgttggctattataaataatgctacaataaacatgagagtgcagatatctcttcaatatatattaattttcttactttgagatacgtacccagcaatgggaatgctggattatgtggtagttctatttttagttctttcaggaacctccatactgttttccatagtggcagtactatttcatctccccaccaacagtgtatgagcactcccctttgatatgttgtgtttctattgttgtttgactcaagatattttttagtttcccttttgacccattggttgttcagaagcatgttctttgcttttcacatgtttgtgcattttctaatattcctcctaatattgatttctcgtttcgtgttattgtaatctgaaatgacactagatatgattttagtcttcttaaatttgttaagacttattttgcagcctaacatatggtctatcctggagagtgctccatgtgtactggagaggaatgtgtattctgctgctgttggatgtaaagttctgtgtatgtttgttagatccatttggtcaaaagtgcaattgaaatccagtatttccttattatttgttatctggttgctttattcattgttataagtgggatattaaaatctcctactattattgtattgctatccattttgttcttttatgtccattaataatttttgtatgtatttatgtgctccaatgttgggtgcataaatatttacaatggttatgtcctcctgatgaactggctcttttaacattaaataatgtccttttttgtctcttgcaaaaatttttaacttgaagtctacgttaccagatataagtatagccacctgctccctcttttggtacatttgcatggaatatcgtcttccattccttcactttcagcctgtgtatgtctttaaagcataagtgagtttcttgtaggcaacatagttggctctttttttttttttccactcagccactctgttttttgataagagaatttaatccatttacattcaaggttattattgacagataaggacttgctactgccattttcttgtttgttttctggttattttgtagctattttgttcctttctttctcttttatagtttacctttatgaattgatacttttctgtagtgctaagatttgattgctttttctttagcattggtatatctgccatagatttttgttttgtggctaccgtgaggcttatataaaacatcatatagttataatctactattttaagctaacaacttaacttctgacacatacaaacactctaggcttttaccttccttcctcacaatttacatttttgatgtcacaacttttgtcttgttatattgtgagttccttaacaacttagtgtagcttccattatttttgaccattgtgactttcatcttcatactagcaatgcgtataatttatacagtattgaagtatcctggatttgactatttacctctaccagtgagttttgtatttacctctaccagtgagttttgtatttacctctactagtgagttttgtactttctttcatatgtattcatgatggtaattactgtccctttgtttccacttgaagaactcccttaagtatttcttgtaagtcaggtttcatggtaataaattccctcagcttttgcttgtctgtgaaagactttatttctacatttctgaaggacagcattgctgtatagagtatgcttggctgacagttttgtttgcttttttgttttgggggttattttttctttttctttttcttttttttttttttgctttcaacacattaaatatatcattccattctctcctcgcctgtaaggtttctgctgagaaatgcactgataatctaatggggattcccttatatggactcaggatcatgaaaacatccatccccatcaaaagtttcctcaagcacatttgtaatactcccctccctaatacttcactgtccctaggcaatagctgacttgtgttctgtcactatattctagtttgtatttaatgaaatataggatatactcttttgtaaatggcttctttcacttaacatgattatttgaggctaaccaatgttgtttgtatcaatagtttgtttttattgcagcatagtattccactcatggatatacaatttgtctaaaaattctactttttatagacgtggtttatttccagttgttggatgttatagaaatttatgtacaattctgtaggtgggcatatatttttatttctcttggataaatacttaagagtagaatggcagggcttgtacaataggtgtacatttagctttttaagaaactaccataattttccaaagtgattgtaacatttaatattcccactagcagtatgtaagagttacagattctccacaacctccccaattcttggtatagtcaggcttacaattcttgctattccagttggtgtatagagatcaccgtttgtggttttaatttgcattttcccagtgacttagggtattgagcatttttttatgagcatattgatctttatataatctagggtaaaagtgtctggttgattatttttctcatttttattagattgtttgacttcatattattgagttttaattgttatttgtatattcttggtaaaaattttatttgatgtgtttatttcttattttttattgtatttatttatttatttattttgagacagggtctccctctgttgcccaggctggaatgcagtggtacagtctcagcttactgcaacctccacctcccagattcaagcgattctcctgcctcagcctcctgagtagctaggattacaggcatgcaccacaacagcctggctaacttttgtgtttttagtagagacgggatttcaccatattgatcaggctggtctcgaactcctgacctcaggtgatctgccttcctcggcctcccaaagtgctgggattataggcgtgagccactgcgcctggccccagtgcgttttttaaaatattttcattgtcagtgacttaaccttaaatttcttaatagtctctatggaagaagaaagtttttaattgtcatgaaattcaaattattaagaatttttctcttatgcttcatgcttttgagtcatatttaagaaatatttgccaaacctatggtcactaagattttctcctatattttatcatagagttttatacttttagctgtaatatttgcttctaaggtttaattatatatatatatatttaatttttttaggtacacagtaggtacatgagatgctttgaaacaggcatgcgatgtgaaataagcacataatggggactgggatatctgtcttctcaagcatttatcctttgagttagaaacaatcaaattacaccctttaagttattttaaaatatgtaattattattgactatagtcaccctattgtgctatccaatagtaggccttattcattctttctatttttttttgtacccgttaaccatccccatctctccccccacaaccaccaactactcttcccaccctctggtaaccatctttctactctatgtccatgggttcaattgttttgatttttagatcccacagataagtgagaacatgtgatgtttgtctttctgtgcctggcttatttcgtttcacataatgatctccagttccatccatgttgttgcaaatgacaagatctcattctttttttgtggctgaataatactccattatgtatatataccacattttctttatccattcatctgttgatggacacttaggttgcttccaaatcttagatattgaaaacaatgctgcaaaaacatagaagtgaagatatctctttgatatattgatttcctttcttttgggtatgtacctggcagtgggattgctggatcatttggtaactcaatttttagttttttgaggaacctccaaactattctccatagtggttgtactaatttacattcccaccaacagtgttatgagggttcccttttctccacatccttagcagcatttgttattgcctgacttttggatataagccattttaactggagagaaatgacatctcattgtagttttcgatttccatttctctgatgagcaattacgttgagcacttttttgtatgcttgtttgtcatttgcttgtcttcttttggcaagtgtctattcaaatatttagcccattttttgattggattattagactttttcctatagagttgtttcagttccttatatattctgcttattaatgccttgtcagatgagtagtttgcaaatattttctcccattctgtgggttgtttcttcactttgttgattgtaccctttgttgtgcggaaggtttttaacttgatgtggtcctatttgtccatttttgctttggttgcttgtgcttgttgggcattgcttaagaaatctttgcccagaccaatgtcctggagattttccccaatgttttcttgcaatagtttcatattttgaggtcttacatttaagtctttaatcgatttgatttgatttttgaatatggtgatagacaggggtctagttctattattctgcatatggatatctagttttcccagcaccagttattgaagaaactgtcttttccccattgtacatccttggtatctttgtgaagaatgagttcactgtagctgtgtagattcgtttctggtctctgtattctgttcccttggtctgtatgtctgtttttatgctagtaccatgctgttttgtttaccttaggtctgtagtataatttgaagtcagacaatgtgattcctctagtttagttcttttgcttaggatagctttggctattccaggtctttttggttccatctaaattttagaattttttttttctatttctgtggaagaatgtcgttggtattttgatagagattgaattgaatctgtagattgcttttggtagtatggacatattaacaatattgatttttccaatccatgaacatggaatatttttccattttttggtgtccccttcagtttttttcttcagtgttttatagttttcattatagagatttttcacttctttggttaattcttagatattttatgtgtggctattttttaagaaaaacttatttattttaaataatttttagataataatttctttttttctttcttccttgccttcttctcctctccctcctcctttttgcttccagggtgactcatgtcaaaaacattgtggatgtccctttccagtttcctattgacttgtatattaccttacagcatttctccccattcagctgtccctagtagaaatccataggctaacctggtactgccgattcgttgtctttaatggctgaataataacccacagcaggaatgtgctaccatgattgatcctgccatctgcctactaaagggtgttcactttgtttccaggtttttgccactggaataactttgcattcaatgcctcatgcataaatatgcctttatctactggtgctgttatttcttcgggacagtccaaaatcttatgatacatgttaaaatgtatgtatattttggaaagttaaaatctctagccatagagctttccaaaaaggctgtgatacttgcattcccaccagcaatacatgagggcaccatttttcttggattgtcattcagcagatgttatcactttttgtattttttttttattatactttaaattctagggtacatgtgcacaatgtgcaggtttgatacataggtatacatgtgccatgttggtttgctgcacccatcaactcatcatttacattaggtgtttctcctaatgctatccctcccccagccccccaacccctgacaggccccagtgagtgatgttccccgccctctgtccaagtgatctcatcgttcaattcccacctatgaatgagaacatgcggtgtttggttttctgtccttgtgatagtttgctgagaatgatggtttccagcttcattcatgtccctgcaaaggacgtgaactcatccttttttatggctgcatagtattccatggtgtatatgtgccacattttcttaatccagtctatcattgatggacatttgggttggttccaagtctttgctcttgtgaatagtgccacaataaacatatgtgtgcatgtgtctttatagtagcatgatttataatcctttgggtatatacccagtaatggtattgctgggtcaaatggtaattctagttctagatctttgaggaatcgcctatgtgtggctattttaaatgagattactttttatttctttttcacattgttcactgttggcatatagaaatgctaccaatttttctatgttgattttatattctgcaactttactaaatttgtttatcagttctaatagttctcttgtggagtctttaggtttttccacgtatactataatatcatctgaaaacaagcataatttgacttatttctttccaatttggatgtcctttatatctttctcttgtctgattgctctagcatggactttcagtactaagttgaataacagtggtgacagtgggcatccttgttatgttccagaccttagaggaaagactttcagtttttccccattcagtatgatattagctgtgggtctgtcatatatggcttttattatgttgaggtatgttccttctatccccagtttttgagggtttttatcatgaagtgatgctgaattttatcaaatgctatttcaacatcaattcaaatgatcatattgtttttgttcttcattctgttgatgtgatgtatcacattgattgatttgcatatgttgaaccatccttgcatcctgggatgaatcccatttggtcatgatcaatgatctttctaatgtattgttgaattttgtttgctattgtcctgtagttttatttattattattattattttttttgagatggggtttaactcttgttgcccaggctgcaatgcaatggcatgatcttggctcattgcaacctctgcctcccaggtttaagtgattctcctgcctcagcctcctgagtagcttggactacaggcatgcaccaccacatctggctaatttttgtatcagagatgaggttttgccatgttggccaggctggtcttgaactcctgaccttaagggatctgcccacctcggcctccaaaaggactaggattacaggtgtgagccaccgcgcccagccagttttattgttttgatgtgtctgtctttttttggtatcaggataatattggccttgtagaatgagtatggcagtactccctcctctattttttggaatagtttgaataggattggcattagttctttaaatgtttggtagaatttatctgtgaagccatcaagtcctggggttttctttactgggagacttttttttatcatggctttgatcttgctatttttatgggtttgttcaggttttggatttcttcctggttcaatcttggtaggttgcatatgtctaagaatttgtccatttcttccagattttccaatttattggcaaatagttgctcatagtagccactaatgattctttgaaatgctgcattatcagttgtaatgtcttctttttcatgtttgattttatttatttggatcacctctctttgtttcttagtctggctaaaggtttgtcaattttgtctaacatttcaaaaaaactaccttttgtttcattgatcttactattttttaatttcaatttcatttatttctactctgatctttattatttcatttcttctgctaattttgggtttggtttggtttggtttcctcttgctttttttagttctttaagatgcattgttagattgtttatttgacgtttttcctcttttttgatgtaggtacttatagctataaagtgcctctttttgctgtttttgctgtatcccataggttttggtatgttgtatttccattatcatttgtttcaagaaatttttcaatttccttctaaatttttttattgacccactggtcattcaggagcatattgtttaattttcatgtacttgtatagtttccaaaattcttcttgttattaatttctagttttattctattgtggtcaaagatgcttgatattattttagttttttgaatgttttaagacttgttttgtaaactaaaatatgcactgtccttgagaatgagctatgtgctgaggaaaagaatgtgcattctgcagttcttggatgtaatgttctgtcaatatctattaggtccatttggtctgtagaacagattaagtcttatgtttctgtattgattttctgtctggaatacctatccaatgctgaaagtggagtgttgaagtctctaactcttattgtacttgggcctttctctctcattgattatttttgtgccagtaacaataaaagtactctgtctgtggcttacgatttttgtgacatcttcatctgtttttttttttgtatcaggataatattgatctcataaaatgagacaaggaatgttatcttcttttctgttttttgcaagaatgtttgaatgattgatgttaattcttctttagacattcgataaatttcaccaaaggtgccatctgaacttgggctttacttagtggaaagtttttttttttttttatgacaaactgaacctctttacttataggtattttcatattttgtttgtatttgtgaatcagtcttggtggcttgcatgtttctaggaatttttccatttcatatagatttccaaattatttggcatgcaattatttaaaatatccccttataatacagtttatttgtcatttcccctcttttttttccttaacttttattttaggttcattggtacatgtgaaggtttgttacataggtaaactcatgtcactagggcttgggtttgttgtacagattatttcattacccagatataaagcccagtacccaattgttatcttttctgctccccttcctcctcccatttattcacattattagtaattggtgacttcacactttattctagctaatctagttaaaggtatcaatgttaagatctttcaaaaaaccttttattgattgatttcctctattggttttctattctcaaatttattcactctgattaatttttgttatttctttctttttgcttactttggatttagtttgctcattttctagttttctttgaagggggagataaggttattcattaaagacctttcttctttttcaatataggcattacagctacaagtttttcttctaagcactgcttttactatatcccctaagttttcttctgcttgtggttttattttgtttttctcaaaatatttcaaaaatccctcgtgattcttctctgactcattaattattttgaattgtgttgcttaattctcacatattgcaaatttcccaaatttcctgttgttgatttctactatttttccattgtggttgcagaacatgctttgtataatttcatccttttaaaatcattgaggattgttttgacttaacatatggtctatgtggaaatgtttcaggtgcacttgagaaaaatgtatactctgctgtctagttggtttatagtattgttcaagtcttctatttctttgttacttttctgtctgtttgttaaatctgttcttgaaagctgggtattaaagcctccagctatcactgtggaactgtgtacttctcatttcaattatgttagttttgcttcatgtattttgtggttctcttattagtgaataaataatttctactatttggaaaagttgattttggcaatatttcccagtgttctcattgtttttacgaagaagagtattttccaatgtccttattccactattcccacttgtgtacctccagtgatatgatgttttactttaatctctttttgtcttcataatcaaagtgggtttcttatagagagaatataactgaatcttattcatttactcaatcttataatctctatcacccatatttatagcttttctatacaatgtgactattgatatggttgggtttaaaccgaatcttttgctatttgttttacacttgtcctatctgttttttgttttgttttcttttgatttttcttttattttaccagtttttcaagagtccatcattcctgggcctcctttattgagtttttcatcttctgatcagcagttgttgctttagggttttttcatatcttacagtttttaattgtatgcccagcattatggattttattttagaaaagcccttgattatgttatctttttctcatgagtactaaatattgttctaattaaaagttaatttatcagtacaacacctgaatactgtctcagactttgtttagaagaaagactattttagttttttcttacagatagaaaatattcctcactcttaaggcactgagtttctttttttattttctgtccagctttaagatgcaagcaacaaatttaaaaacttatatatttaaagtgtacactgtgatgatttgataaatgtatagatcatgaaatgattaccacaatcaagctacttaaaatgtctatcaccttacaaagttaccttttttgtatatgtgtgatgagaacacttaagatctactctcctagcaaatttcaagtatacaagtgttaactataattgccattctgtatgttagaccccagaatggatttatcttataacaaaaatttgtacattttgaccaatatttccccaacccccaaccccagccccagaaatacatcattctactctctgctcccgtgagttacactttcttagattccgcaaataagtgagattatacagtatttttcctatgtctgacctatttcatttaccataatatctctcaggtttatccatgttgtcacaaatgacagaattctcttctttttaatgactgaataattctcttgtgtgtgtgtgtgtgtgtgtcatattttctttatctcttcatccattgttggacacttaggttgattccataccttggttattgtaaatagtgcatcaataaacatgggagtgcaaatatctctttgacacattgattttattttctttgggtatatatcccgtagtgggattgctggatcatatggtagttctgtttttaagttttgaggaaccttcaaactgttgtcaataatggttacactaatttacattcctatcaaaagcgtgcaagtgtttccttttctccacatcctcaccaaaactttttatctttcatctttttaataataaccattctaacaggtatgaggtgacagctcaatatggttttgtattttttttttttgaggcgaagtctcgttctgttacccagacaggggtgcaatggcacgatctcggctcactgcaacctccatctccttgtttcaagcaaatcccctgccttagcctcccgagtagctgggattatagatgtgcaccaccatgcccggctaatttttgtatttttagtagagacagagtttcaacatgttggccaggctggtctcaaactcctgacctcaggtgattcgcccacctcggcctcccaaagtgctgggattacaggtgtgagccaccgcacccggcctcattatggttttgatttgcattttcctaatgattagaaaggtttagcactttttcatatacctgtctgccatttgtatgtcttctctggaaaaaaaatgtgagttgtatgaattccctctatattttggatattcatacctatatttgtgggttcaggctgctataacaaaacatcataaactggacagcatatagataagtaaaatttttttctcatagttctataagccaggaagtccaagatcaaagtacaggcagatttcagtgtctggtaagggcccactttctcatagtctgcaccctcttgcagtgtcctcacatggtagaagaggtaagggtttctctggggtcttttacgagggcattaatttcattcatgagggatctgccctcatggcctaatcatttcccaaaggctccatatcctaataccatcactttggaagttaggattccaacatgtgaatttgagtgggacacacattcagaatgtaacacctccttatcaaacatatggtttgcaaatatttttttccatgccataggttgccttttaattttgttgattgttttctttactgcacagaaacttctgtttgatatcatcccagttgtttatttttgcttatttatgttacctgtgcttttggtgttatatctaaaaaattattgccaagaccaatgtccaggagttttccctatgtttttttcaaaagttttacagtttcagtttttacatttaagtctttaattcattttgagttttgttaatatgataaggatacagtttcattcttctgcatttatatagccagttttcccaccaccgtttattgaagagagaaccctgtccccattatgtattttttatgcccctctcaaagactatttaactatatatatgtggactcatttctgggttttctgttctgttccattggcctatgtgtctgtttttacaatagtaccataatattttgattactataatatagtttgaaataaagacatatgatgcctccatcttgattcctcttgcttcttacttttttttttcacttaattctggctatttggggtcttttgtggctccatacaaattgtaggattagtttttttttttattttggtgaataatgtcactggaattttaatagggattgtattaaatttgtatattgctttgagtagtattgacactttaaaaatattaaatcttccaatttgtgaacacaggatcttttttcatttatttgtgactccaatgtcttttgtcaatgttttatagttttcagtgtacagttatttcacttcctcggttaaatttattcctaaatattttattcttttttattctaatttgaatgggattttttcttcacttattttttcagatagtttactgttgctgtatagaaatgcaactgatttttgtatgttgattttgtatcctgaaactttactgaatttattaattttaatagctttacagtagatactttagggttttacttatataaaatcatgtcatctgcaaacaaaaacaattttacttcttcctttccaatttggatgccggttatttctttctttctttctttctttttctttctttttttttttttttttgcctgcttacttggattaagacttccagttctatgttgaatagaagtggcacgagtgggcacccttgtcttgttcctcatcttagaggaaaaatttcacattttgtcattgagtatgatgttagctgtgggcttgacatatatagtctttattacattgaggtatattcctttgatacctaatttcttgagagttatcatcataaaagaatattgaattatgtcaaatgttatttttctgaatctattgagatcgatcatatttttatcattcattctgtcaatgtgatgtatcacatttattgatttgcatatgttgacccatcctttcatccaagggataaataacacttggtcatggtgtatgatacttttgatgagctgttgaattcagtatgctattttgtttgtttgtttgtttgagatttttgcacctatgctcatcaaagatattggcctgcaattttcttcttttgttttgttgttatctggctttgatatgagggtaatgctgactttgtaaaatgagcttagaagtgttctttcatcttgaattttgtgaacaagtttgagaaggtttggtgctagttcttcatgaaatgtttggcagaactcaccagtaacaccatgtagtcttgggcttctctttgttgggaggtttctgattactgtttaatctcctaactcattattggtatattcagatttcctatttctttaagattcagtcttgaaaggttgtatgtttttaaagaaatgtatccatttctactaggttatctactttgttggcatgtaattgttctagtagtcttttatgatcctttgtatatttgtggtgtcatttgcaatgtctgctctttcatttataattttatttatttgagttctttctctctctttctcttggttagtctaactaaaggtttgtccattttatttatcttttcaaaaatccaacactgtttcattgaccttttcaaccgtcttcccatctttatttcatttatttctgctctaatctttattatttcctttctttgactaactttgagcttagtttgttctttttgttctagttccttggtgtagagttatttatttgatgtctttatttttattaatgtggacatttatcactctctacttcctattagaactactattgctactattactactattgctgcatttcataagttttggtatgttgtgtttccatttttgtttatctgaatatttttttaaatttcttttttatttcttttttaacccattggttatttgggagtgtgtggtttaatttctatatatttgtaaatttttaaattttcctcccgttattaatttttagtttcataccattgtggtcagaaaatgtatttgatacaatttcaatcttcttaaattcattaagaattgtttttcaacctaacaaatgctctatcctggataatgttccatgtgcacttgagaagaatgtgtattctgttattgttggatgtaaagttctgtatctctctgttagatgcatttagtctctagtgtttttcaattccactgtttccttattgattttctattggttgatctatacactgttgaaagtagggtgctgatgtcttctatttaatactattattgtattcctatttctcccatcagttttggtaatacttgctttatatatttgtgcttcagagttgagagcatatatatttaccattgttataatcttttgatgaaattaaccctttatcattttataataatcttctttgtctcttgtgacagtttttaaagctaattttagacttacttagagttataaaatagtacagagtccctttatatctctcatccagcttcattaaatgttaacatattgtatacccgtagtataattatcaataataggaaatcaatattgtgaaacagtactataaagtataaattttgttcaaaatttacaaagtttttcattaatgtccactattagtttttatatcttatccagaatacgacattgtgtttggttgcattgagctgctttacaaccttccaataaatctgataaattatcttttgacttttatttaattccagataatttctaatttcccttgtgattgcctctttgacccataagtcactgaaaagtgtgtcatttaaactcctaatacatgggagtttcccaagtatcttgtgttaatgtctcatttaaatactttttgtctgcaacacactgtattttttcaatccttttaactttattaatactttaaatatctaaaccaaagatatttcttgaagaatgttccaattgcacttgaaaatatgggggctatttccagaatcttttgttattaatttccgacataattccacagttataagggaacagatggtatatgatttcaatcccttttagaacataattttttagaattgttttgcatcccagcatatgttccagtgtttcctgattaaaatgccatcgacacttgaatagaattgtatcttgctattgtataaaatgtataaatgttaactacgttcaatttgttcatagtactatttaggtttattatatattttttacttttctgtcttcattctattaatttcttagagtttagtattgaaaactccaattatatatattaatttatctattttttccatcaattctgtcagtttttgcttcatgtattttggggctctgttagtaggtgcaaatatacatttttaattactataccattctgcttttgacccatttatggttaaaaatatctctgtctttaataatattcatattattaaataaatgttgtctgaaattaatatacatactataatattttatgcatatgatttccatgtaatatatattttaattttttatttttagctataggttttttgtaattaaaatatattgtatgtgaggagcttagaattgggattctcttatgaaaactttttatctaatctgacagtacatttttcattttttaaattttttatttccataggtttttggaaacaggtggtatttggttacatgagtaagttctttagtggtaatttgtgagattttggtgcacccatcacccaaacagtatacactgaacccaatttgtagtcttttattcctcacccgcctcctatcctttcccctgagtctccaaagcccattgtatcattcttattcctttgcatcctgatagcttcgctcatacaatgtttggttttccattttttagttacttcacttaggaaaatagtctgcagttccatccagttcgctgcaaatgccattaatttgttcctttttatggctgagtagtattccatcatacatatatacaccacaatttctttatccactagttgattaatgggaatttgggctggttccatatttttgcaattgcgaattgtgctactataaacaagcaatatcttttcattagagtagttagttaacttacacttaatgtggttgatttgcttattttaggtgttcaattttgatactcattttctacttattttatatctttattgttcctctgttcttcctttcctgccttcgttttttgtattgtaatataattcatatatcataaagctcattattataaagtgtataattagtagtgtttagtatatttacaaaattatacaactgtcaacactatctcattacagaacattttcatgacactgaaaaatttaaaaatatatttattaggaaccattctccattttcccctctccccagctcctagcaacttctttatttctatagatttgccaattctggacatttcttataaatgaaatcatacaatatgtggccttttttatctgccttgttttaaatactataatgttttcaattttcctgtattgtagcatttactagtattgaattcgctttttcctttttctttatttttcattgtttagtgagatacaagtcacataactatacaactcacccattagagtgtaaaatttaatgatttttaatatattaatagatgaatgcaaatatgaccatcatcaattctaaaacattttcatcactgcaagacaaacattataccctttagctatcaccaccctacttacccagaacaccatgcctaagcaagaacgaattgactatctgtctctgtagatttgcctactctggcaatagctggaatttcatacagttgcaatcatgtaatatgtagtcttacgtgattggcatattcagttagtataatgttttcaaggtttattcatgttagaatctgtatctataattatttttatatgatgaatgaatactctgttgtaagaatatatcagaattttttttcattctgctgattgacctttggctcgtagccaatactttttatcacaaataatgctgctatgaacactaatcaaagattttgtttaaatacttgttttaattctcttgggtatataactagagaatttctgggtcacgtggtaactgccaaattgttttccaaatgcagggggattccaacttctttacatccttgtcaatacttgttattgtctataattatgactatgttcatcgtactgtgtgtaaagtggtatctcattgtggttttggtgtgcacttccctaatagctaatgatgttgagcatattttcacatacatataggccatctgcatatcttctttggagaaatgtgttttcagatcctttgcccaattttaattgggttatttatctcttactactgaattgtcaggattgtaacaaatattctggatgaaagacacataatgatttgaaattattgtctcccattattttagttgtccttgatggcatcatttgcagtgtaaaattttttaatttcgataaagtctttattttaccttgttgtttgtgcttttagtgtcatattcaagaaaacattgtcatagctggagtcatgaagatttagtcctatgttttcatctaaaagttgtacagtcttaccccttacttttaggtctttgaactattttgagggtttttttttttctgtgaatggtgcaagataagggtatgattttattgtttagcatgttggtattcagttatcctagcaccatttgttgaaaagactattatttccttcactgaattgtcttgacactctgttgaaaatcagttacatagaaaccatgtgtttacttgtagcctctcaattctattccatttatctatatgtctatatatatgtcagtaccacctggtcttgaataccactgctttgtagttggtttgaaaatcaggtagtgcgagtcctcgtactttgctcttttatctcaagattactattactctggctactctgagtcctttgcaatttcatatgaattttataataggcttgacaatttctacaaagaagtcatctgggatgctgatagtaattttgttgagtttttaggtaactttgggaagtattgtcatcttaagtatttcaaatctaatccatgagcatgaggatttatgtccatttacttaaattctttattttctttcaacaatgttttatagatttaaatatattaacacaagttttgcatttctttggttaaaattatccctaagtacttttattttttcaattatattataaactgaattactttattaatttaatttttggattgttcattgcaagtgtacagaaatataattaaattatgtatacttattttatatcatgcaaactttctgagttcatttattagttctaatactttttaagtggattccttagaatttctatatacaagacatgtcatcttctaacaaagatagttttaaattcttcctttccaatctagatgcattttctttttgttgcttaatttccctctgtagaacctctagtacaatgataaatgaaaggggccagactgaatattcttgacttgctccttatcttacgaggaaagtattgagtctttcatcattaagatgtctgctgtgggtttttcataaacgccctttaccaagttgatgagtttccttctatttctatgttgaggagtgacttttatcataaaagggaagtagatatgtttaaaatgttttttctgtatctattgagatgatcatgtgttttttacttctattgatatggtatattactttaattggctttcagatgctaaaccaaccttgcatacctaggacaaagcccacatgatcatggtgcataattttttatatgttgctggattcagtgtactagtgttctggttggtgtttttgtgtccatattcctaagaaatatttatccgtagttttcttgtgttgtcttcatctcattttggtatcagggtaattctgacctcataatatgagttaagaactgtttctttctctacaatattttggaaaagtttgggaagaactggtattatttcttctttaaactttttatatatttatataacttctaatatctttaaatttttatcactggtaaagtcatctttatggccataagttatgaacttttcattgtgcatagttttgggttagtggtcagtgtgtttacttggtatacgtccagtcacattgtctttttttgagtcatttttggtaggttgcacctttctaaaaatttgaccattttatctgagttatctcatttattgccatataatggttaataatattcctataatccatatttctgaaagatcagcaataatgtccctgctttcatttttgatcctaataatttaagcatctatctatctgtctgtcatctatctacctatctatccatccatccatctatctatctgtttatctatcatctgtcatctcttggtcaatctaaccaaaagattgtcaatcttgttgagcttttcaagagtcagctttattttcattaattttctgtattgttttaatattctctatttcattaatttctgctctaatctttacaagtttcttccttcagcttgctttatgtttattttgctgttcttcaagtgtcttagatggaagctcaggttattgacttgagactttttttttcttaatacaggcatttaaaatgataaacttctaagccctgtgtagttgcatccagtaagtttgggtatgctgtgtatttatgtttattcacctaaaagtattttctcttgtttttcttttttaattgaccaataagtatatatattaattatgtacatcatgtttttaaaatatgtatatgttgtataattactaaatcgagctaatggaaatatgcattacctcacatacatatcctttttgtggtgagaacacttaaaatctactctcttagaaattttcaagtatacgatacattgctattaactatagtcaccatgttatcaatagattcctagaacctatttccccttttttttaactgaaattttgtatccttgaaccagcatctattcaaaccatcctaacctctggcacgactattatactctctgcttctatgagttagactgtaattatagagttcacatataaatgagataatgcggtatttgtttttctgtgcttggcttaattcatgtagcataatggcctccagattcattcatgttgtcacaaatgacaggatttccttctcttttaaggctgagtaatatttcattgtgtatatattccacagtttatttattcatttattcactgatgaagatttagtttgattccatatcttggctactgtgaataatgctgcaatgaacatgggagtgcaggtgtctcttcaacatattgatttcatttccttaggatatatatgcagtagtaggattgctggattatatattagtcctatttttaattttttaaaaacctccatactgtttctcataatgaacctatggaatgggagaaaatgtttgtaaaccatacatctgataatacgttaatattcaaaatatgtaaggaactcaaacaattcaatggtaaggaaacaaataatccaaataaaaatgggcaaatgatctaaatagacatttctcaaaagaagacatacaaatggccggcacatataaaaaaaatgctcaacatcactaatcatcagggaaatgcaaattaaaaccacaatgagatgacatctgatacctgttcaaatggctattaccaaaaatacaaaagataacaagtattgctgaggatgtggagaaaaggcaacccttgcacacttttggtgggaatgtaaattagtacagctactatggaaaccagtatgaaggtttgtctaaaagtattttctaatttctcctttgatttattatttgttccattagatatttggagcatgtgatttaatttccacgtatttgtgattttctcagatctcattctattattgatctgtacttccatttttttatgttcagagaacatgcttcatattctttatcctttaaagtttgtcgaggtttgttttatgatatagcatataatccagcctggagaatgtgcgaggtgcactttagaagaatgtaacagacactgggccctaaccagaggagggagggtgggagaagggagaagatcaggaaaaataactaatgggtactaagcttaatacctgggtgacaaaataatgtgtacaacaaacactcatgacatgagtttacctatataacaaacctgcacatgtaccccaaacttaaaagtaaaatatgtatatacataaatataataaaaattatgtaaaataaatagtcatgaactatataattgtatttttactgttccttttctatgtttagatacacaaatattcaccattgtgttacaattgcctacagtattcagtacagtcacatgctatacaggagtccaggtgtgtagtagactataccatctagatctgtgtaagtacactctgtgacattcacacagtaacaaaatcacctaacaacacatttctcagaagatgtggccatcattaagccacacgcaactgtaattagattttttaaaatccaaatttaaatttttggctttatataaaaaagtttgatttaaaaatggatattcatttttgacattggtatcttgcactttaattttaatttttaatattttaaaagaaagaatttttcaaaactatatggaaataatgttaacttttaaattgtatgcttgttttaatgtatacttttataaatatattttcattttactcatttaggttattactgtcaattgaacaccaattatgtaaaaatctttatgaaatccatataattagcaatgtagctaaaaagaatgcaagaaaaataaattttatgtgacaaatatatttttaaaaagaatacatattctgttgttgagtagattgatctacagatgtcttttaggtctaattgatttatagagttgttcaaatcatctatttcctggtcgattgtttgactacttgttctttaaaatcataaaatgtagtattgatgtgttcaactattgttgaattgtctaattatcacttcatttctttccattttcacttcatgcattttggtgttctgttattggtacatatatgtgtataattgttatacctttctcatggattgaccctttaccattataaaatttttgtctttagtaaatttttgtttggaaatctattttgttagatattaattagtatatcctctttagctctcttgtggttgctctttgcatgattcattttccatcttttaatttcaatatatttgtatatagagttgtatatacattgtgcctcctgtgtacagcattagttggatcatgattttattcaatcttactatctcttcattttgattacatttttagtctaatcacatttaatgttattggtgatatagtttgatttaggtctgccatgttacattttgtttctatatgtctcatgtcttttttccttatatttttcttttactgcttgcttttacagtaagtggatattttctaatgtagcattttaatttatttaattatttctttctagttatttctttagtggcaactctagggcttaccatatatatcttatcagaatcagcttcatatatgtactaacttaattccattaagatttagaaacattactcctatgtaactctattcctttttcccctttctgaagtattatttatcatatattacatatgatacatatcacatcaatacattttacaagcacaataatatatcattataattattactttatgtaattttatgtcttttaaataatttcatagaggaaaggagcaaattcatatttatgtcttttgttatattaatcttatttcagattttttcctatgggttcaagttaccatgtagaatcatttatttagcccattatagctttgcccccacctacatctttttagctgtcattggcaaatgtgtttacatttctataaggtatatagtcaagcatatattatgtcaacttaaataacaaaccaagagaagctctctaaaagaaaagatgtttatttggggatacagcattgcaatgggaatatgcatgccatagtaaaaaatgtgcatatttaattagatgaacaaagacaaagtcttttaaaggaaaaaatcagacggattacataattgttttgaaatagttattcttgtctacaaagattaataacaagaatgatgccagtctgaggttagacaggtagttgctgggtagatgacgctgtagaggtatttttttgtgtgaagttgtaatgctttctgcagacttttgtgatagttgtgttatcagatataccaacatgagaacgctctcttcacggcctttcctggctctatttgtcagggtttcattaatattaatgaatccattttgattatggcaactttcacaattgtacacttttttatacaattgcttttaaaatcagccaagaaaggagaaatgtatgcatttatactgtcttctataattaaaaatttctttatagatattctttgtatttttatattggtattattgcctggggtcacttgccttcagctcaagaacttcatttagtattttttggaaggcaggtctgctagcaaaattctctcagggaatgtgcttatgttgcttttgtttttaaaaatagctttgctggatataggatccttggttgacattttgtttttcttcattaggcatttttgaatatgctatcccatcactttccaccctccattgtttctgattaaaagccagctgttggccgggcgcggtgcctcatgcctgtaatcccagcactttgggaggccgaggtgggcaaatcacgatgtcaggagttcgagaccagcctggtcaacgtggtgaaaccctgggtctactaaaaaaattagctgggtgtactggcgggcgccagtaatcccagctacttgggaggctgaggcaggagaattgcttgaacccaggaggcagaggttgcagtgagccaaggtcacaccactgcactccagcctgggcgacagagtgagactctaaaaaataaataaataaataaataaaagccagctgtttatttcattgtggttctattgtaagtgatgggccctttacccttgttgctcccaaatttttctccatgtatttggctttcagtattttgactagtttatctgtggatctctttgtatttttccaacttttagttaattgactttcctagatatgtagatgtgtaatggtgttcttctctctgagtagtagtcccaatctagaatttgagtgctaagtgaaagggctaggccgtagccataggtctttaggcttgcttctcttgacatgaacccctgtcttatcaggtgggaaaatggcaattcgggacccagtattttcagcagcaccatacccaagctggagcttctactgtatgagtagagatcaagtagaaaagtagagtgcccgcttctcagctacacttacccagatattatcctcagcagcaggtagctggtagtaggatgaaaaatgctgatgctgtgtctctcctaggaatataaatccttgactgggaactggggataaggggaaccttgtgcattagctctaccaatctgagtgaagtttccatcttcctgcattgggaatggggaggaacagaatgggttatggttcaaacaccatagactctcactgttcttactgagctctactagatttccttgaacaaatgtttcttcatattttgcatgtctccaggaccattttcagaaagtttaaattattgttcttctataatttccactagttttcgtggaaagtaaatctgtggagttcttcacgtggtcatgccaaaagtggacctcacttcatctttttttatgtcttcataatattcaattctatggatataccacatatttaccttcagttcattgaacgtattttaaatcacttatttaaagtctttttccagtaagccaaatatctacgttttcacagagacagtttctactgattacttcttttcctatgtaagagccatacattcatatttctttgaaattctcatatatttttattgcaacttggacaatttaaatattataatgtagtaactctggaaattagattctcatcattcctcaggattggctgttttcactatttattgtggtagttattgtttactgactttcctgaagtaactctgcagagtgtatattctttatcaatgaagtctcagctccattagcttagaggccagctgataattggacagagattaccttaattgcctggaacaaataaatctctcagttgttgctaaggagttctgtgttgctgttgggacacatcttcaacattcagccaatcagtataccattttgccatgggcttcccttacttgcacagagcctcaaggtcagacagaagtgagagcttaaggccctctcaggtctttcctaagcaatccgactgtttggggaatgcatacaatcctacacatgcaggtgtccttttagattatgaagaatcatgttggagcttttcaaagcccttctggacattttatttctcactttttccttttattcattttgcttagtctattgttttccccaactgtaaataatttcctcaggcagctggaatgttaaaacatttgccagtaaatgttttccagaaatgctcctcagggagaagtttttagcactggttgaactccaagtcagatgaaaggaaataagccttttgtgttggttcttccaggacaccactagaaaagtcaaataatgacaattttttaggtgcatggctttcagagatctccaactccattttgctactctcagtgccaggagggtcagctgttattttttaggactgacactgatctggagagcacgggatgggaaaggaacggttcttagtgatattgagacaattatcttgaatgaatgtttcccatgttgctgcaagttttgggttagtttttatagttctgatgatgttgaatctatttttccaatttttctgttgcttttatagagaggcaaatttttgaagggacttactctaacattttcacagatgccactctctgctttttcttgttttaaataaatttcttagtatgcaatttcaattccactattggcattttagatatatttgaattatttttaaattattgagctagaaaatatggtatgcttctataacttatcctattatactaaatgttcatctctacttacttcttagaacaagaaatataggaactttgaaaacgtatagttgcatttacctcttcccatcatttgtggattgttgtcaaatatattacatgtgtctacattataaagccacttacagaatgttgtaatttttgcagtaaatagcatctttgtaaaataaaaagagttttaccttgtattatacttaaccacatattcacttaccatttcttgttcccttcattatttctggttttcatgagttactatctcatgtcatttcctttcagcctgaaggacttccactaacatttctcatagtgcatatctgcaatcaataattcattttttgctatctacaaatattttcatttcaccttcaattttgagggatagtcttactggatatagaattgtttgttgactgttattttgtttcagcacttttaatttgatatttgagtgtgtcctgtccttcatagtttcttgagataagctgataattatataattgtttcctcatatgaaatatgtctcttcctacttctgctttttaaatattcttactctcttttaaattcagcagactgtgatgtttgtaggtgtgatttctcctgtttattctatttggaattcattcatctttatgaaaatgtgggttaaactttttcacaaatttgtgaagttattggccactatttcttcaaacatttattctgcttctttcctttctgtctggggcccaaattatacctatattaagccacttagtattatctcataagtctcaggcttaattcatattttgtatcattttattccctactcactgattcttctagccttcgaaattgcaattgtcccatcaagtgaattttttttttgctattttgataatttaattttacgaacattataattttcacttggtctttttataggtgtcatttcgttattgatattgttgtctttcctgtcattaataccatatttgcctcgaacttattgaacatattttaaaatacctgttttcacatttggatctttaaatcaaacatctgtgaccaagcatggtctatttatattaaattccccttttacagtttatgtttcccactttctgtttctttgtcaacttttgattgaaaactggatattgttatacattgacactctggagcttgtttcttattgtgaagattattgttttttatatctagtaggtatttaactttctggactcaaactataaaacctgtgtcccccacattgtgcaacagctgacatttcttttcagttttcttgacttctagttgcttctttttagtgtgttcctcccatctttcccttgtgcctatggagtttaaagatcagcctaggattgaggcaaaatttgtaatgagatttaggataggttggagaatgcattcaatcaaagacacaaattgaaaattagtaagggaactcaggaagaaagcgaaccacagagagatcgttaaatctaaatataaattcatgctgtatgtcctgatcataggaagagatccttcaatgtatcataatttagtctggcaatagctgtttttttttataagaatatatctttttatcaactggggaagtatctttgttcctagttttcagagaatttttatcgggaatagatattgacttttgataaatgatgttttaaattctattgagaggatctaatagtatacttttttctcttatttatcctattaatgtggataatttctttgactggtatacattcttgaaacatccttgcattcttgggaacaatctagagattaaacccccatctgatcatgatatactttttatatattgatggatttcaattcctaatatattactgaggatctgtacatctatgtacataaatgattttgttcaataaattacttatcttgcaaagtccttatcagcttttcgtatcagttatgctgaaatcataaaattggttagaaatatatcctccttttccattatctgacactgttcacataaaattggtaatatttctctcttaaatgtttgaccgaattcaccaatgaaggcatttgcatctgaattctttttctggagggggtttcaaatgtcatttagttaccttagtagatgaagagcaatttcaattttctgtttctttccattttgtttcactttaattcataggcaatacagtaaggcaaaaaattaaataaggaaaagtaaagaagactggaaagaaaacacaacttttttacctgaagataaaataattgtctatgtgaaacttaaggaatctacaaaaatgaaaaatttactaatatcaataagtaatttagcaagctttctgagtaacagatcgtataacacacaaacatagatggtatttccatatactcacaacaagtaattgaaaaattaaataatctgtatctatagtatcataaaaaatatagtacccttagaaaatatatgagaaccctctatacatataaacatagcttagagaaattaaagtggaataaataaatggaatgatattacatgtttttgaattgaaaatctaaaaattaaaatataatatattaatatatctaaattaatctatagattcatattaatccaaaaataatcacatcaggctagtttcagaaactgacaaactgattttattatttatttttatttttatttttattttttttttgagatggagtctcactctgttgcccaggctggaatgcagtggcatgatcttggttcactgcaacttccgactcccgggttccagcgattctcctgcctcagcctcccaagtagctgggattacaggcgcccgccaccacacccagctactttttttgtatttttagtagagacggggtttcaccatgttggccaggctggtcttgatctcctgacctcaggtgatccacccgcctcagcctcccaacgtgtgggattacaagtgtgagccactgtgcccagcctgattttaaaatttataaggaaaagtaatggacctaggagagttaaaataattttgaaaaaaaatctaggagcatttatctgatctcaagacatacaatatagctaaagtaatcaagagagtggttattggcacaagaataaagaaataaatcaatgcaatttttaaaaaatagtccagaaatatactcacacataaactatcagttttccaaaaaaagtgccaagataattaaataagaaaaatgtttttttcaataaatgttctgaggcttatgtacaaattggtataaaagaattaaccttgacttcaacctcatagtatatacaaaattaccttaagccagatcatcaatctaaatataaaatctaaaagcaaaattattatagataaaatataaaagaatatcttcataaccttgccataggccaatatgctttgaataggaaacaaaacacataaattaagaaattaaaagttgacaaatcaaacttcaaaattaaaaactgctctttgaaagacgacaatattaaggaaataaaaaagacaagccaaagactcagagaaaatataggcaagatatatctgacaaaagacgtgtatgcaaaatatataaagagctcttaaaaataagtcaaacaactcaactgaaaatgggaaaaatcttgaacactttataacagagtatatccaaatggcagtaagtatatgagacattgttcagtgtcatagactgtgatgataatgcaactttaaaaccacaatgagaactggcttcacaccactagaatggctaaaattgaaaagactaacactaccaaggggtgtcaaaaattagtggcaactgaaactttcattgcggatgggactgcaaaatggtactttgtcagtttcttagaaagttaaacatgcatccaccctatcatccagcaattccactgcttacatttacccaaatgatacgaaactatatgtctacacacaaaaaaaatcttatcacgacttttaaaactactttattcataataatcccaaactgaaaatatatcaaacgtttatcaacaggtgaaaggataagcaacaattccttcaaaggaataatatttacaatagaaagaaaaactagtgacacaaccaaaaatatgggtgaagtgataaccattatgatgagcaaaagcatccagatatttaagtgtagatcttatatgattccatttatgtaaagtcctaaaacaggtaaacctatactgataagtatctaaagagtcattttttggggtggggaaaatttactagataagaagataagaaaactttctgcaggcttgaaaatgtcctatgtttcaactgggatggtgatttcacagatatatacatttgtaaaacctcatgtaaatttatacttgaaatctgtgtgtttttatgtgcttgtaaattatatttcaataaggtatttatatttcaataaatctaccttatttatttatttatccatttatttatctaccttatttatttattcatttgagacagagtgttgctctgtcacccaggctggagtgcagtatcatgatctcggctcactgcaacctctgcctcctgggttcaagcgattctcatgcctcagcctcgagtacttggtattccaggcacacaccaccatgctcggctaatttttgtatttttatttgagacggggtttcaccgtgttggccaggctggactcgaactcctgacctcaagtggtccactcgcctcaggctcccaaagtgctgggattacaggtgtgagtcactgtgcccagccagatttattttttaaataaacaaaacatcaacaatctgtgagacactgacaagtgctctaatatgcattgatctcagaaagggaggaaagacacactgaggacataaaatgtttgaagcatatagaaagtgtacatcccttcttatattttttaaagtctagtaataacaagtgaaaaaaattataacaaagtgttgtggagttatgccatatttagaaataaatcatatgaaaacaatgacatatgttgggggtgtaaatgaacttatgctgttatattattcttacattatacatgaggtagtagatcatgcaacttatcataattgatcatagtatttctttttaaaaatatctgtaggttatgtagtgatgtactctcttttatcttgatactggtaatttgtgttctttctccttcctttttcttgatgtgtcttggtagagattgatccattttattaaactttgcaaagaaccaactttaggtttgtgaggtttctttatcatgtatctgttttctcttttgttgatttttactcctcatttatctgttttcttctttgtatgtaggatgtaatttcctcttctttttttcaagtttcttactgcagaaacttagattactaattttaaccattctttcttctttttgaatattgacatttagtgttaaaatttcttccaggctgggtgtggtggctcacgcctgtaatcccagcactttgggaggctgaggcgggcggatcacatgaggtcaggatttcgagaccagcttggccaacatggtgaaaccttatctctactaaaaatacaaaaattagccaggagtggtggcgggtgcctctaatcccagcaacttgggatgccgaggcagggagaatcgcttgaacctgggaggtggaggttgcagtgtgccaagatcatgccattgcactccagcctgggcaacagagtgagactctgtctcaaaaaaaaaaaaaaatcctctaaattttgcttttgccctacccacaaattttgtatgctgtgtgttcaacaaattattctcaaacgtttttccaatttttcttgtgatttcttttttggcacatgagctatttagatggttgtaatttgattttccagttatttagatgagatgtgggaaatgagtgatcaatatcttatttgtcattaatttcttatttaattctgttgctaagaacatactatataagattgcagtctttagaaattattgagagatattttatgcttcaacatatgacttatcttgataagcattccatgtgaacattttaaagaaggtatattcagaagcattcagtgtagtgttctgtaaatgtcaatcacatctaattgacagtgtttatattttatatatcattactttctttttcaaacagttactgagaaaggaatgttaaaaatgccaatgatgattgtggatgtattcatttcttccttagttctgtagattttgctttaaatattttgaagctgtgtcactgggggaaacacatttaggatttgtatgccttttgaatttgtccttttattattgtgaatacccactttcatctctgctaatattgcttgtcttgaaatacactttgtctgacaataatatagccatgctacctttcttgtaataactactcatacaatatataattttccataatttctaactttgtacttacatatgtcttcatatttaaagtttgtctcttttaagacaactgatcatctttctcttttatcttaatctgaaaatctctgcctcgtaactaaacgatttggatcaattacattttatgtaatcatcaatatgactaggtttaagtctgatatcttactattcattttctttttgcttcatttaatttttgttctcctgtttctcttttcctgccttctcttctgcttaccaaatacctttagcattgcattttagttcctttattgactttttatctatatatttttaagtatttttatttgacctaggtggatttaaggattgccatcggatatcttatctcataagcatccttaattttaataatgtactaattttccactttagactttagacatgtaagaaacttaaaatgtataatttgatttttcaagcctgttctttttgttaatattgtcatgtatgctcttgctacatatgtcatagacacaactttaaaatcaactcatttgtgcctcaaaacctcacttaccttttaagaaattaggaaaaaataaaaagtagtctgtttacttacatgtttaccattttgggtgctcctctttcctccagtagttgtgagtttccacctggtatcattttcaacagcctgaagaacttcctttagcaatctttttttttttccaaattttattttaagttcagggatacacgtgcaggatgtgcaggtttcttacataggtaaatgtgtcccatggtggtttgctacacagatcatcccatcacttaggtattaagctcagcatccattagctattcttcctaatgccctccgtcctcaccggctggcaggccccagtgtgtattgttcctcgctatgtgtccatgtgttctcatgattcagctgccacttctaagtgagaagacaaggtatttgcttttctgttcctgtgttagtttgctgaagataatggcttccagctccattcatattcctgcaaaggacgtaatctcattcctttttatggctgcatagtattccgtggtttatatgtaccacattttctttatccaatctatcattgatgggcatttgggttggttccaagtctttgctattgtgaatagtgctgcaatgaacatatacatgcatgtatctttataacagaataatttacattcctttgggtatatacccagtaatgggattgctgtgttgagtggtatttctgcctctgggtctttaaggaatcaccacactgtcttccacagtggttaaactaatttacactgccaccaacagtgtaaaagtgttgctttttctccacaacctcaccaccctctgttgtttctggactttttaatagtcgccattctggctgacatgagatgatatctcattgtggttttgatttgcatttctctaataatcagcgatgttgagcttgttttcatgtatttcttggccacatgagtagcttctttgaagaagtgtctgttcatgtcctttgcccactttttaatggagttgtttttttcttgtaaatttgtttaagttccttgtacactctggatattagacctttgtcaggttgcaaagattttctcccattttataggttgtctgctcattcttatgacagtttattttgctctgcagaagctctttagtttaactagaacccatttgtcaatttttgcttttgttccaactgcttttggtgtcctcatcttaaaatctttgcccatgtctatattcagaatggtattgcctaggttttcttctgagatttttagtttggggttttacatttaagtctttaatccatcttgagttgattattgtatatggtataagaaaggggtccagtttcagttttctgcatatggctagccagttctccaagcacaatttattaaataggaaatcctttccccattgcttgtatttgtcaagtttgtcaaatatcagatagttgtaggtgtgcagtcttatttctgagatctctattctgttccattggtctatgtgtctgtttttgtaccagtaccatgctgttttggttactgtggccgaatagtatagtttgaagttgagtaacgtgatgcctccagctttgttctttttgcttaggattgccttggctatttgggctcttttttggtttcatatgaatttttaaagtttcttctaattctttgaagaatttcaatgatagtttaatgggaatagcatagaatctataactttgggcagttatgagcattttaattgcatcgattctttctatccatgagcatggaatgtttttccatttgtttatgtcatctctgattactttgagcagtggtttgtagttctccttaaagaggtccttcacttcccttattagctatattcctaagtattttattccttttgtggcacttgtgaatgggagttcattcattctttggctctcagcttgcctgttgtttctgtataggaatgcgctatctcaggcaggctccaccctgttgctggtggctggctggaattccaaaccagtgggtcttatcttgtgagatgccatggaagtggggcccgcaggacaatgctgcttgacttcccggattcagcccccttcctagtggtatgtacggacctcccgccttgcctgagttgcagacacctttgttggggatcctggggtcagagtatgtaaagctcctgggtctctgtgtgtgcctgagcagctgctttgctgtgactccacacagctctgtgttggacccaaggccctggtggcataggttcacaaggggatctcctgatctgtgggttgcaaagatccgtgggaggagcatggtttcccacggtcgcacaagcactcaccgcttcccttgactggacgtgagggttcccttggctctgtgttgctcccaggtgggccgttgccccgcctggcttttctttgttctccatcggttgagttgtttccctgatcagtcccaaagtgagtacctggatatttcagttgaagatactgtattcactcacgccttttgttcctctctgtgagtgccgtggactgtagctgcttctaatcaaccatcttggtccccttagcattcttttaatgaagttctgttggcaacaaattctctcagctttagttgacatgaaaaagtcttaattttaccttcatttatgaagtatatgatcactgaacataaaattctgggttgacagatgtgcgtttgttgctgtagtttttactttattctttttaaagatgattttatcttctgtcctccatggtatctgatatgacacccttggatatttctttctttttcttgcattaagctttattttaatgggtttcaaaattctgtaacagatttttggtcagggcgtttccattaaaaagtgttgattttaaaaactaaaaacttaaaactgccacatgcaaaaaaaaggggatccagaaaacattctctttttcttctgaaggttttacaatgcattgtcatcattaatcagttttactattaaacttaaaaggctaattgaaacaaacagttctgagaccattcttccaccactgattaaaactggggtggcaggtattagggataatattcatctaaaacttctgagatttctggtcaaacttggtgaccttgccagctccaacagccttcttgtcccttgctttgatgacacataatcaagatatgatgtctatctcatatcataaagagcaaaatgactcagaggaggatagtctgagatactgtcaacacacatgggtttgccaggagccatatgaatgacaatgactgcagcatcaccagacttcaagaactcctgtcagcctgaaatagtatggttttctaggtatccttgaaaaaaaatttcctctccatgcaaaataacccatggaaacagataaccctgcaggttaacaataatttccctatgttttcattttgatgtttatcaagctgttctaggaaacgtattctctaatctcttttgtatcactatttattattcatctcttggcagtctgtttcctgtcttcactataattgttctctctataatcaccaatgacctcttcattttcaaagatagagaaaatgtttcaaattctagatctctctgtggcatttgaaactgttgcggatgtcttcttcagaacactccttccctttgttcgtaatgacataacttttcacttacactgaattgttgtcatgtagctgacactcattttgcaaattttgctgctggtagttttgatctttccagaagatgtcaaaagaagttattcagaccagtttcacacatgtactgacaatgacaactatctaatgactagtttctggccaacaatgattgtaagacactatgggttgtatgaagcatcacaatttcaaagatgttaaaatctgaaagaaatgtgcctcttagaatcattggcatatgaccttatggtttggagagaactgatctgtgttgcttgaattcaaggttttaagaaataatgtaaacatatttatacatcctctgaacttacctcttttgcagtaaaataacttcatcaactaatgggcttttaagaggctgaaatgagataatgcatgtaaagtatgtaatgcagacaaagtatcagagtcagtaagcactcataataaacacttaatgaatgatagtagtagtagttgtaacagcagtagtagttataatagcagtagtagttataatagtggtaacgttatattttgaataaaatagtggtagaagtaacatatgatattttcagtaaagctttaacttaacaatgttaatgaatttaatattctaaaatgctaagtaagactcttatatgtttactgaaggcactcttcctctcagagtttaagtaaccttaataaataataaccacttttcagagatttgcaacaactgaattagataatgcatgtgaaatatatttgacagtttattagttgaagaagtacctaaggtttgcagcacaacatgaattataacttacctttgttggttctaaaattctaaggaagatgatacagagttattgaagttaatctcagaaaggttaagtgattccacctaataatttatttttttttgtctggattgaataaaatatatataaaagtatataacaattgtgaaatatgtggcttagtgcatgacaaataagccctcagtaaaaggtagttattattattggaattattgttagtgacacctgatattttcaatggtagttcatatctagttttcctctttggccaaatcaggaatttcaaaaatattgaagattgcctcatgatatttgctaaacttacttaatttttctgaagttaacttcatcaaataacatgtgccttgcggaatttttataaaaatgaatgatgaatttaaagtgttttgttgccagtattgctgttatttatatttaccagacatgataatatcgcatgaattactattggttgaaataaaaatgctaagacaaacttaacacatttgctgaacttaactctctagcacttaaataacttaatgcattaacatagaacagcagttctcaagctctttggtgtcaggacccctttatactcttcaaaataatcgaggactccaaaagagtttttgcttatgcggcttatatttattgatatttatggtattagaaattaaaactgagaaatatttaaaatatttaggaataattttattttcaataataataataaacccatctaaggttaacataaaaacatatttttgaaaactataatctccaaaacaaatcagagagaaaacaggcattgttttacagttttgaaaatttattgtatttatttatttatttatttattttagatggaattttgttctgtcacccaggctggagtgcagtggcgggatctcggctcactgcaacctctgcctcctgggttcaagcgattctccttcctcagcctcccgagtacctgggattacaagcatgtgccatcatccctggctaatttttgtatttttagtagagactgggttgcaccatgttggccaggctggtcttgaactcctgacttcaggtgacctgcccacctcggccttccaaagtactgtgattacaggcgtgagccactgcacccggcccacagttttgaaaatctcttttaatatcttgtttgacagaaagaaagctagattctcatatatgtatccacattcaaacagttgtgatatgttgttttggttgaaatttatgaagaaaatgcagttttaaagacagttaggaaaggaaaacctagcaagctttctaacagtctcagacacccccctagggtccttgaatcacactttgagaactgctgacacttaccttttatttttttttaaagtattgaataagacagtgtacaacatatattgttattaatgctgcttttgttgttgctttttataatttcctcatatgtttgaaataacttgaatttcttcttgttttgttgattgcattcatggtttctaaaaacaaaagaaaattaatgacagtgcagatttggtaaactggttaagctactttgccaaataatacctgtcttataaagtttttaaccaaattgagataatacattctacatctgtaatgtcagtaatatacatggctcagtgcctggcacataggatacactcaataaatggcagctattagaatcaccctttcctcaatgcacaaaaaataatacaaatagatgccagggataaaattggcctcatctacccaataacagcttcagcttatctacagtgactttgctaccctctcttgctgtcccttgacaaggcctactttaggctcaagaatcccttagacaagtgaataaatcatttaacagaagcgagctaacattactctggagttggtctctaagtgatacaaacttccaccaatctcatggcctgtgtgtgaggccttccccagaaacgtccaagtgtgtctatgaatacttagaatatatgcagcatttcctgtgggaaattgaaggtacatgcctcagtcatgatgcctccagggtgaaagcaaattccccagattgagtctctagccccacgctgtagtatctaaggtgctgggtggttggcaaggtaggagattgaagagggaaacaccactcctgcatcctttattgcttttgctgtaaggaacctggaaaggtataacagagtttcctatcaacacattgtcagaaaatggccttcttccctacagttttatcaaacaggtggttgaatgtttctatttagggatccaaatgtttttttgctctggaaggaatcacttccaagattagcagtggccaatcagttttggagactttttaaaatctgaggcttaacagtgatgttactctgtttcagaaaggacctctatgtcttcttttctctttttttaaattgaaaaaaattattaaactttctgtttcatagttgactttcaaagattacaaaggtagaattataaaataaagcccatgaactcatcatccagctccaagatttatcagcctgtggactgtcttgtttcatccatactttcatccacttctccctcccgtattattttgaaataactccaaacatcataatacttcatctgtaagtgttttagtatgtatatcaaaaaataaaagagctgtctttttatataaccacaatatcaatacctcacctaaaaattaatgaacaataattatttaatatcatccaaaggccagtcattgttcagatttttaattgtgtcatgaaaatttttaacatgtttttgttttcatcaagatcccaagaagatccacatattataattacttgatagatcttttaagtatctcttaatatataagttccccctctaacattttctcttgtaaatttttttaaagaaactctttcttcttttaaaaatcttatattaactttctgcagactaatccgtcactaaaatatgttattaaggttaagccaacactgatgtctttagggcatgtttgatctgtgctgtctagagattaccttacgtttatgatttttcacataaagatttaaacaacacagtctggcagctttcttaactgcttttttttttttttaactcttaagaaatatattctgtgtggttctgctgtactctatattcccaaattcctgttgaaatttcccaggcatttcatcaaacttggtgaaaaatcactttctcttttctccttctaataattgtcattccaccccatctaggtgcaaaggtctctgctttaggatctggccatgcactacttgaggtgacttactgtttgcagtgcctcctcattttcagtctttcctactttcttgaatggtgtgcctaggttcagagctataggtaggcatggaccaatacccagggaagtcttgtcatatctgttgtggcttcctcaccctgttacttggcttcctactctaggaaaaggccagtcattttagaaattccatgtctgaggaagaagacttaaagatcactttcaaaacactctcttctttctatcttcccagagattaaacatccgtcaacattctcagcaagctctagcaaagaagcattgactcattgttttttttccctcttgatcatccagccagacactctatacctgactaggcatgttaaagcaactagtaaggactttctgtttcaggtttgtcacagttgcttgtgtgttctctaaggtcagcaaggatctctgagaatgcatttctgtctcctctcacagttcatgatgtagacacctaccagcccaggattcctaataatctctaatggaaccccacaaatacaatctgaacttcccaggcttcgacttcctgtggacacaagacaggacagcaatctctatctgttatctatttatctctatgtattgatgcaggacctcttgaagacctactgtggttatttctgaaagcttccagatatcttacttatgctcaggcacaagatcaccttctgctcccacctcctcattgatatttcctaactatgggcctatttattgaaggaagtgcttccctagagtactacctctcagtattcttaaaacaaaaatgctcaaaattccacacagaaactggaggactgcatatctcccaactctacattttaccctctcttgactttgaaacattgctcatgcccagagactcaaaataaaacaaacaaacaaaaacccttgctaaaaagagaatcttttcagtctctgcttattgactatttctgcatagtagttagactcagcccagccatccctaataggctattattactattacaggtggtatttgtctcatttttattgaatttggaaaatgatatgctaaagaaagaatgattggctttattaatgtcatcaagtacagatgtgaatttattcattgattcaacaaatatttatcgagtgccttctctgagccaggacgattcttggaactggaaatccaacaaatctgacacaatccaccctttgacacaaccgtgtctctaatatagttaatatcaataagggtaattccatgccttctacagaatttagggagaaggcattcctaacatgaaaaacgccatcattttctgatgccatactgctagtgtttcatgtgactatcgattatgccgtgaatagctttcaacaaatatcaggtctgaatttccttccgtaaaatgcaaattaatgtatgccgttgaatacatctgttcagtccttcaagatgctataacaacccccttcctttttcttcctttaggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaagtaattaaaaagacacttttaccgaactcgggattacagaaacacggagtttccatttggattttaaacaaaatttatgtcattttcagatccttccaaactctctagtgcaggaaaaggctgcagctaatttgtgaaagtggcaagctcttcattgcactgcagttatttaccagaagtttaaatctttgttaaaatatagtgttgtgttacaataagtgttggccatcatttcattcgtgggcctgctgctctctaagaattcagtagcattttaatagtttctaaaccatgaaaagttttcaagcattgctaaagtcaggccattcagtctatgctgtgtgcagagtatacaagtgtttctagtaacagtatttccatacgtgcccatttcacacaactgtggataaattttggaagaattcatgatgctagttcttacgcttgacagttacttacacacctgagaatgtgcctctcagtatcttaaaattggttaatgaaaaatctgaatttctaaaacccttggtctgtgttctcaacacacagtatagataaatccaatagtctgccacaagggcagtggaagagctgctgtatttgaggaaactcatacagtctctatttgatttgcaacactgccaaacatcagtcaattgcttgagcatgcccaaatataacatgaaagtcaagtctacctgccttgcctgttaggtctgttgaagtgcatgttaaaataattatatgaagcagaatgagatgatttaattcttaccgaaatgaaaatggctgaagaaacacagcatgcatttagcatgagttctgcacatacagatggtgtcctgcatgtatgccatgtatgttgcatgaatccatcgatttgtattaatgtagggcagaatagctgatagaagaaggactgaagaaaatccttcagcaatccttaaaaagaccatgcattcagatctgaagtagtgtgagtgttagaaaaaactggaaacatctgatttctgaactatcagggcaagctcatagcacatgttttacaaagaaacaaaatataaatcacagatttccaaaagtactagcaataagttgaatgataatagctcacagcacatttgttaatgattcttgtgtcatcaagtagtagtacttaatagtacccaacctggtaattatcctcaagttgtgtgctattcgtaagttctgtgcagtttggtatgaaacaaatatactcatttggatataaatcttacccttcaatgttaaatctacaaacttttataaatgttttaaagaagtccatgtgataattgtaaaggtgatgaatttaccatcaaacaaatcattttgatgtattattatatatgtatatctgtgtaagacacgtgcaacagactgccttatattattttctgtaattcttctcctttgtcaaatggtattttttgtgaatggttgcaaagtgttgtcttattcctaattcctgtatgttatccactacaggttttatgagacttcctattaatttattaaatttattaaatgttg

SEQ ID NO: 4936 - DNA, 326073 bp, human
cccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtggtaagttggagccccgggcggcattgctagccgagaccccaacgatttaggcgggggatggggtggggagcggggacaggtcccggatggctgcagcctgcaggaccgcactggccctagcggaggttggggggagggactctgaacgcgcaaatcgcgaggagactgagtctctggaagaagagaggagcttaggttccacggaaggagcatagaagtctctaaggggattgggagcgggggctcgagatgaagacgctgggcggaggcgggggtctagagaacctggcgcgggggaagccgagacagaaacggaaggcgggggtggggtctcaagaagtgaggagtgggaggagagaaaggagggaaactgaacgcaatgtcgctgagtagagggtcgggctgcggaagatgcaactgagttgcaggaccgactacaattttaagaaatccgacagcaggcaagtgggagggggcgcaaggtttgggacagtgtgtgcagagggggaaccaaggatcctttattatgttctcattgaaaagcgaccctaatttttctggcgggtctcagcgaacatccgtaactctggggagataacacactgcggatctgtgtttggtctaacagctgttagctgaatttgaacagcgctgctggtgatcacgtaagcttaagaggagaggataaaggcatccagtgaacctttttttaaataattaattagcttatctaagtcatttggttactgttctatattttgaaaaggattgcgaaaaagtctccagcgctgcctcttattcctgtactcagttttacctgacaagcagtctttacagcgttcctcggaattgctaaacatgagaacaggttgccgttcctgatgtcacataaagttcgtcattgcaaaacgtgtctgtgtgtctgtttcttttctgcgccatgccctttgccttttgcttcctgttgggtagtatgcgacttgaggtgacaaacacttgcattgtgtttgagaaccctgtattttaagcaacagagctccccaactcataattcagcgagtgacattcggcagttaaaagatttggtctggaatcactgccagtaccgcgcagcttcttcattaatattaccagtataagtcccatccaaggaagcctctgattgctgagccactaagtgcatatgccccttacctcataccttttaggcaggctaaccgagggacgttcatatatggttgagctaagatgatttggggggcggggggtgaggaaatgcggcgcactgagtaacctctgagctccccagtttgcagacaattgcgacctcacatacacggtaatgaaaaaagatatctgggctccagagtttaaatttttcatgaagaagtttacgtacatatcagccattctgacaatcaaaatatgagtgcaatagaaacaaggtgttactgtgtagttggctacatatgtgtagagacaatgacaaaggccaactgacatgccccacagaaaatgatatctaccgtgatcattgcatctcttttgcagtactgaaatcatactgaatattgtctgttctgaagagtataatctccttagcacctggctgtttgggaatcatctacaatgcccccccattccaccccacaggtggggggaaataaataattttgtccatattttggggaggtaggttatagaatatttaattatatttttcattccttaaataaattctcctgatcctcctggggagggaagaaaatatttgtttcatcaacatgatttctttcctaatagcgtctatcatctacagcaacaagcccaacgcaagtcctgaaattcggaagatggataaggcttgttgattgcaatgtcaaggtaggatttggggtgctttagcaaaaatgacggtgtttttctatctgcattatctagagagggttattaaccctttctatgctttcttgaggggtttatctccatctagaggtgtcatggatgacagtgatgactttttcagataatgtaacaggcttttgtgcagtatgaattcatcagaaaagaggtgagaactgatatttctgggaacctcctggatgccagacgtggatccaggactattacatatatatacataaaatatatattatttcatatagtcttcatagcaagtctatgaatgacggagatattattatcctccattttattggtgccattagatttttcccctcaatttttcaaggtattctcaaaagttaatttaaggcaagagaataagaaatatttatttgtgcttccaagtctacttgggaagagcaataaaagtaaaatctaaaaagcctaacattctaatagattcgtccaacattataattgagtcaagcctcaataattttactgttccatgtatttccttcaaggaaacgtcatccctctccagctaagggaaacacaaaaattaaaacaaaatttgggggagagattatagtaaccaacattaaatatcctcagctattcttattaaattgttcaaggcctgagattgaaggaggttgcagtttgctgagcctgctgaaagataaattaattcccaggttttaatggctcctgaagctccagactatttgtccagtattattaaggagcatcttaccacctcactttcatagcaatggaatacctcacaaaaggatgatgtacgtgtactgagattattttagtaaagcatctgatacagcttagtattgtctagtggaagaactgctaaattatgttcctctagctgcctggtagccatgagcaaactaggaaaacttcatcataaattgaagttaataatatattattgtgatattttatgtcagtatcatatataaccccacctgattgttgtgaaacagatgggtattaagcactttgaaaattttaaattattgcactaagcaacatttattatttatttgttagcattctaggctacctatgtcatttcatctacatattgtactgttgaacctcaaaaagaaatcatcaatctccagtctaatgtgtgctcaagttatggatctctccaacactgccattcttcaagacattttaagaaggctttttcatatactgagaacattgctgcaagacagtctagtcatctccattctagacaaacaacattgaaaacaaccaagtggttaagctgcatcatcatttggcaagtcattagcagatttaatactaatgctcacctgcaacaactctttgctaatcacttctgacattttaatgcacaaacgacatagtgaaatcaggatttcaaataagatatacacaagatggaattttaattctgtttttgtctcctacctggcatctctacttcaacctcgctattcattcctcttctcagctgtggctaagacagtgtcatctgcagtttcctaaaatagttgcgtattatagcattgtacatatagctggcatttgaaacagtcattcttcttaattatggttaaccttatgcatagatgaccacttacatggtctaatttgagaagcactcgaaaggccttctggtccctaaattagtagccttcatggttttccatataacttgaaattctacattcaggaatttccctctttcatcttagtcactgtctcctttaaatacaagtacacctttgggtaacatactgttattattacctattaagaactatgcataaatttattgaaagctattagaaagcctttagaactgcatcgtccagtgcaacagccaccatatatgggtatttaaattcagagttgaattagcgttaatggcaaggtgtggggttgagctcaatgtaaaaataaaaagtgaaaactgaacaccactgaaaccaaagataatgtcaactaatatctagacaaggatagcaatgaatgaattggctaggatttcctttactttttcataaaacatgatgtcttctttaatcagtaaacgcttacgaataaatgtcagtgttcaaatcttttgcaagtgtattttaaacttacgtatctcccattttatctcagtaatcaagactcactgaatactcttcaattatagcttcctgtaatcaaagtagtaagacttgcccaaattagcaagtaattattcttaagaggagaggtataaaagatggtaacagtggccactatttattgacatttaccatgcactacacagttctaagaggtttacaggtatataaccatacaagcctgatgactaccccatgagaaggtactactattatccagtttgcagttagggaaactgaggcatacaaagaggttaatctgttcaaactgaatgaacaaaaccaagcttgaaaccaggcagttttattccagaggccgtggtgttaaacaacaaactattgcctctgtttagaaattggctaatttttctttcatactgtaacaactagtcttttaacagaacaaatttgcatgtaaatgtgaggatattaatggacaatgtccattaatcctcgatatgctgcttggcaaggcaatgagacagacatgcaacatttcatctagagattcacctaccaataaagaagtagagcaaatgagaatgtactgttaatgctgagagactgagggacaagaagctgagtgaagctcaggggagttacagagataatacaaagacagaaatgaagtcagggaaataatgctattgtatgtagagatgactggacaggcagatgttactactgtgagttggacccacaggtttctactacatgtaacaccacaacaaaggccattcatatttgtcatttatataatattgcctacttgaaattcaagcagtaaaatagaagctctgaaggtctaagaccgactgacagaaggatcagtaaaaatcgtttatctctttccgtaccgatagtgctcccgaaaacatggtgaatgttcctaaaactcacaagacttaaagaagtgtggctagcaccaaccccacaaaacgacacagtacaagaagggcaaagattctctgtatgcccagggaaagcagcattatgacaggcagcgcagtgaatatggtgggcagactaagccaatttttcggaaaaaagctaaaactacaaagaatattgtgctaaggcttgagtgcactgatcccaactgcaaatctaagagaatgctgccattaaaagatgcaagcattttgaactgggaagagataagaagagaaaggtccaagtgatccatttctaagtgtcatcttttgttttattatgaagacaataaaatcttgagtttgtgttaaaaattatttatcatatatcaggaaggtttcaagtcttgtctgatcccatttgccatgtatttccttttcatactagagtcaggaaaagtaatttgatagctatgacttggaaaataggtgctataaaaagtaactgccagttttttagtttactgatctgagcccaggtagaaaaaccatatctgagtacaatacttagactaaagttatttcagggtagaaagaccatacttgaaaaaattctaaatatgattaaagtctttttaaaagtaggtttttaaaaattcaaaaaccaaaccaattacttccatttcttacttccattttaaattgacaaaaaacctgatccgtgattaaaaaagaatttattgctagaaagattggagaagtccagtactgtggtatgtagctttctctcccaaatgtatctatattctgtctgatcttcaaggtccgtttcaagccccacctcttgcaggaagcttttgttgactagcccacatatatgataagtgccttgcccatagtaggtaatcagttaacatatcttgattgattgtattgtattccaatggttaaagtaaaggtgaaagaagatgaaggaagagctaaaatagaatttttagcacatctgcacaataatattcaagaattcaaggcatctaacagaataacagtttcccctgaaatgatttcaggtaatttctctgaacatattttagggcaataaaaatattataaatcttcttaaattagtttagctaaagcttagccctaccacactgttttattttccatttcacagtgaaatacaccattatatatacatatatgagagagagaccatttcattgaccacatgcatggctatagaattctctttttattagcaaactgagttctgcacccattttgcggtatgggttgatggctcagaaagaagcgcaagttttctttttaaaatagcaattcctaaatgcctttgcagcaaataaacttgtaaataagagctttatttccttcctttttatactgttaaaggaaatcagacattagtattaatgaattgctctgagtgatcacgtcatgaatctattagttttttttatcttaattaaacagttaatttaatgctttgtggcttgtgggtagattgttctagcatttttggttggtcaatgactcccagaggtctaataggcctgtatcttttagttttaaatgtaatgttagtctaaaatagattcagaaagaagttgattacttcattcttgaaggaagtaaaacaaggaagatctggtgtctctccaacaaatattttttgaaacttcattttgaaaaagcagaaatgagctggtttctcaatagatttatttatttagtcatttcatcatacctctatatctatttttaaaatcactatgtaaatggaaaagaacttgtatggtagaattatgcgcccaaatgactattcattgatacaatgacttgctctccaaagtattatttaagttagcaagggcagattctttagtttggaggattattacccacctctcactgggtaactgtctgtgtcaaattttcctgcttctactaccaaacctcagccaatttcctaaatttcacgtaagtaaatctataaaattcactgtccatatttatctgccaaattagtgaactgtaagatgaagatgaataaagaaaagcctgtaagaattatggaatttcagcaatggcttagttgaaattcagcaagagaatttcagttgagggcttaatgtacatttaacactttgttggatgctaatgaggtgaaaaacatattctacaatacttccctaaggaaacaaataagtactgttagacagtaaaggcaattcaatgtaataatgtagttttgcaatttatggtataggcaacattgatttctctctttcctactctctcactcaggatgaatgaagaaaaaaatggtccagtcatttgcttaactcaggcctcagtttccacaactccaaaatgagagccttatactaggtaatctttctgtaaggatccttcaaactaacctctttgttataaacagatacagaatacagaaaccactgaggttatatgactgacttccctaaggttacaaatatagagtcacaaattgtataatatataaaatggggaagagaacatggagaaaactcccacaaattttattaggttggttcaaaagtaattgtagttttcaccattgtggttttcaccgcaattacttttgcaccaacctaattcagaatttaaaagtgaaaaacatttgaatgctgagaagataatacattgttataaagtaatttgaatttttaccatagatttatactttactttgggtaagtgccattttcagaaaggcagccaaatttgtacaaacatagtggatattctgagtctcttgattgagaatgaagcaacaagatcaaataaaagttcatttgtttctctagtataatacagaatacatttatcacaacacttatagagtgagaaattattaaaaaaacactctatcccttctcccagatttctttaatttcttatgataattgaaataatgcttgtccttcctaccttggattcattcgtggataacttttcttaattattccccatttcagtccattaatacagcttcagaattatttctgaaaaatgttgttcaaatgtgccaccttttaaattccattgtgattatagactcttagggttagtaattgaaagctcatttcagacaactccctatctcatgtttgaactctgcacatctcccactctctttacaatggcaccaaataatgctacccaattcctgggcagagcatagataaggctaaaagttgtcagctaccaaagtagctgctgaatatcagaatgaaacccagggactctaaagtgggttatgaagtgatgagcttcagctaacagggaacattaggaaatgactgcagacaaatcctcatgcttaattcagagaaagatgtacggtttgattggagggggtgaggaagaaggatatcatacagactataaagccaagaagcaatgcttagaatgcaaatgtgttataattttgtgtgtgcagtgtaaaaagactactggccatattttaaaaagtcatctaggttacactcacatacttaagaacaccagaatttccattttaaattttaagaaaatagacataattgtttgcacctcttacatggcacttagcacattgtattacattgttttttccttagatatggagtcttgctatgttgccaaagctgaccttgaactcctgggctcaagcgaacctactgcctcagcctcctgattagctgggaccacaggtgcatgccactgcacctggcttctatcgcattttatttttattacttggtttttaacttatactttagaggcaggcctggtgttaaaggttttacatgcatcacgtcacttttaaatttgagtcttatctttcctactggattataaattcacatggaacaaagattataatttattcatgtttatactccccagctaccgtttgcatatatcattacatattgtggcttctctcaacatatatttgctgaataattaatatacaaaaagacacaagcactgtgggaaaggtatttatagtgcaaatttggagttaaatgacctaagttctagtctgttataagcctctatgtcctcctccgccaaaagagaaaatcagactggatggttactgagataatttcaaatgctacaactttaagaaaatatcaacagtttctaattctgaaaatccacttcaaataataatactcaggtagttgattttatgccccagaagattaatggttatgactcttcagctacttaagtaattcttataaaatctcaagtcaatattcacttcaggtctctaacttgtcattttccattcactccagtgccctacatttgaaatgattcatgtcttaaagatttctgagtgattgaagacatgtcttctttttgtcttttgttatttaaagtaaatttaagatatctttggctattaataataagtaacattcattttaggtgatttataataaattaaactgtgcagctacaaactctacacaaaagaagttacttaactatttgataggacagataacactctcctgcattttcagaaacgattaagccatatcttatagttaatctaatatataaaaaaatgaacttccttaggatttagaaatgttactaaaaataattagcattgtttttttctcaatagggtttctagaagatttctagacatcttgaacggtgaatcataccataatagatattttacttttggggagaagagagatgggtgtaaaacagttttcaatattaaaatgtttaatacatatatagaaattaaaaaggaagtaaaggttaaatggatcaaaatgctttggcaaaaggcattttgacatgtaagcaattcacaaatgtaaacaattccagttattcatattgtcaacctttgaacatagataattcttttacccatagtaaagaacattggagatacttatactttctagttcaaaagttttcattattttaattcctatagctctaaaggcttcagaaagagagattacaaataacatgtagacaactccaaatttcttgatcttactacagattcgctaatgcagatatgtttttttgagattcatcccaatatctactttccattctctcttaactctttttatattttctatcaagtatttttaaaattttcttcatttcctattgtaaattttttcagcctaagagcaattcttatattctgtttcctgttttctcctccctaattttttatcttattttctaacgaaggcaacatatagctgaaagggtttaataatacagtcacagaatatccttattattaatatatctactttttacaccataatacaaattttctttgtagatattttagagattgtatatatttttctcatatatcccttcatttgattttcaacataacttcgacttagttagggccagtattactacattgattacacaaatgagaaaacgaagggtaagaaaggttaaattacttatgtaaagtcacacaattaattctacagccagattcaaacaaacccatgagttcttattcagaattccattctttttatttttttgagacagggtctcactctgtcactcaggctggagtgcagtcatgcgatcatagctcactgcaaccccgaactcctgggctcaagcgattctctcacctcagcctctcgagtagctggaactgtaggtgtgtgtcaccgtgcccaggttgttgttgttgttgttgttttgtagaaatgagggtcttgttatgttgcccaggctggtctcgcactcctggtctcaatcatcccgcctctgcctcccaaagtgctgggattgcaagcacgaaacaccatgctcggccctaaaatttcattctatttccagtactttcccctctcttcgtgtcatggatatttagttccagagaacttcagatgcttagaaataaatgatacaattaggaagttatagatatagatatgtgtatgtatatttgtatatatatagagagagagtcatgttactcccagatgtttaaaaagcatgataaatacttggttttctacaaagaatcagacattcatttgcatgtggtcaagatttaaataacaatagactgactaatgagcaatatgacagattaaaacacaaaaaaaaatcccaaatcattttctgcagaatatattggaagtctagctatctggttgcactttagccaaacaaagtttccttaaaataaatcaagccttgattgagttctgcttcaaatttttcaaaagagtgcttcaacttattatgacttctctcttactttcatgactattagccctatccctttcacatttcctgtaatagccagaacccagataacagagggtaccttctgcatttaaaaataatcattttccaatacttgtatttaaagaaaacatttctaccttacccacacacatggcatatttttaaaatacagaagcactgataaacaatttaacattgcataccctggatttaaacatttaaaatatactgtgcatgtggataaggtagcaatgtttgctttaaatacaagtattagaaaaacaatttttaagagaaaattttaattagtataaaaattgatgaaataattgaataatattatcccaaagttagctttcagtggagaattttaaatgggagttcattaatatcttgctgaatatcaataacgtaaatgctgagtttatggtttagcttcatgattagaaattgtcttattcctttattatatttttagattgaattggatataggctattaccttataaagggttacaaaagaaaacaaattctggacaaacattcatctagatgcctttaattatatttcatatgatcattttgcccctgtactagaacatttattttttgaggagtattcagtttcctctatttgtattcagaactcctttgagtctttggggggtgatcccaaatggcaggaagaagaaaaagaaaagttatttatagcttgttcatgacttttatcagtgttccattttgatttccaattactttcccctggaaaatatatctagataccttatcactatctttaatgaatctaaagctgtacaatttgtgttgctataaaataatttcaaaagaattattcaaacttttgtcctcagtcagatcttaacttgtggtactccagcctgctcttgatctgtctgagtaatcgtgtagatttctatcacatcatcatcatcatttaagaaatattttttgtgtcggccatggtggctcactcctgtaattccagcactttgggaggccaaggtgggcagatcacatgaggccaggagttcgagaccagcctggcctacatggcgaaaccccatctttactaaaaatacaaaaattatcccggcgtggttgtgtgtgcctgtaatcccagctatttgggaggctgaggcaggagaatcacttgaacccagaaggcagaggttgcagtgagccgagatcgtgccattgcactccagcctgggtgacagagcaagatttcatctccaaaaaaaaaaaaaaaaaaaaagcaaagcaatattttttgaagctaaattatacccgacattgtaaaaaacacatgttagagaatataacacttgttcttagagtcacaaaactgtcaagggaggatttagcaaacattttacggttcctaccattgagaaatttatcttctatttgggaagataaactgtattggcatgcaacaaaaatgaagacattatgtagtgaaggactaaattgtgtaccacataaaaatgaaggaaaagaaacaactaaaggaattttattggcatagagaggaaatgaattggagcttgaggacaagtagggtttgaattgacacagaaggacaatattccaaagggccataggatattcatgtttcacggtatgagaagaggtaaattaggaactagttagtgggggtgagagtcacctctaatctgaatatgtttaaaacagtggtgagacatgcaccatcagatgttctctggagaaatgaaaatgtgatactggatctctggagatagaatttcgaacaatccatgctacactagtttagctaaatttcaaaattgtacaaaaaagagaaggttgtagagagaaaagaaaagaatggaagtccaaaaataaagcatttattatttaaagttttgggtaatatttaagattgatatttacctgggaatattaatgatgaaaattttctcaggttttccccaactttagacattgttacattcaataattgttaagattctgctctgggcaagacatttgactgagtacttcagggcttcccagaagaggaaacaatacttaattctgatctttagtagtttgaagtctagtcagtagctggagatcaaatatatgagctctacacaaaggatttggcagcaaaggttactgttaaattcagagaagattgtaagagcacagtagatagaaaagagattgcatgggatgaaaatattgatacaaaaacctctttaccccaaagcccagagaggaagtgtaaatttggatcaacccttttgggtgccattttcactatcacctaaacatagagtggccaaacctctttttgactgactcacagagattttcggatggataagacttttgtttaacaacagaaaaagcctccatgagtctggagtcattcatattcagtcctgttgcttttattcccttaacttaataaaaataagtaaatcagcaaacaggagttgagtgccttttgtgtgtttagcaatgtattagattatttgaatgatgccaatagaaatatgtaaggtcccttatatagttaggagtcatatgaattacttgctatcagcaagcccttagaaacctgaattataccttggtttaagttacaagtaagtaatgagctgtagatagactttcagttaaaattaatagtccaaataccatatgactgttagttctcaatgccaaaaagtcatccattttatgagattatttttaggaataccagcaaagtactttataattcctaaatgcatggataacgttatgaaaataataacacattaaatactgagcactctaataaagcaagtagaactaaagcatactgatcacatttgtaagtgactcaatattgcctgttattattaaatgattatatattattaaagatgaacaaattaagacttagagagggttcttgatttgcttcaggtcatacagctaattattggcaaaactgcagagaacttaaatttcctaactctgaaatcaggttcttttccaccatggttcactgcctcttgaagcctatgtagcatattaaatgaaagcctttaaaaatttgactacatcatactgtccttgagaatcatgtcatgcttaataaattcaaaatgaacaggaagtacatttgcatttttggcttcaaaaattagaaagttaatacaagtatgtgaatactttcaaaattatgacttttgttcttactaacatataggtagaagatgtatatgtgtgtgtgttatataatatccgtatgtttcacaatgagagagaaacatgtaaagacaaataagagtattttttgaagtttaaattagatgactgaccagttaacaggccatgtgctcttatttatgatagcctttatttcttaatttatttgagcaatcgaagtctgaaagagctcaagactggatgcttcctttctataaattacatctcttaaaatgtacaaatgcaagcatgagtcactagctacagaattccagctttaatacattatgtcatttttataaggaaaccagtgaccttcatgtggtttttaaggacaatgtctctgtgaactacagactatgtgaaagatgaaatcataacatgaacaatcaaacaagctcaatggcatgatctaaaagataaaaataacatgcatttcatagattgaaatctgcttacctctgtgattatttttccatgattcatttgcatgtgtgccttgcatatattgtattgatttgaaattaaattgaaacattcacatatgttacaatcacattttaaatagttaactttcactgaggtgtgcacaaaggaatggtgatgagaaggaaagtacatagcccacagcaatcctgaatgtatattttgataggtagtttgaattttctatttactcaaacttatgtcagtaatgtttaaactatagtattactgaagttgttatttatatataccattccatctagtaaatatagagcagaatctcggagataggaggaagtccaagaaagaaatcacggacacttctaatgaaaaggaaagagaaagggaaaggaatcaacaaatattgagccctaaccatatcctactcagtgcgtgttgcaaagtacatatattatctcatgtcattctcacaacaactgtaagaaaaaggaaatggaaacagagacaggttaagtcatgtgcccaaacacacagctaataaggcgttgagccaagattcaaacccatatctgtctaattacaaaggttgtgtgctctttttccatagtaccttgattaacagccttaaggtttaaaaatatgccaaatactcatgcacaacaacatgctctcagtataacatttacttaatcatttttcatttacaatgttttcaaggaactaaatggaagacaagtcaggagacatcaatcatatatcgccttctacaaatcaggaatgtgtgtattttcaaatatctcagtttgtttttagaggtgaaggatagctatttactaatagtaataaagatggaaaaagtatgcaaaatgctatctaataataataattggtaatgaaataggaaaataaaaggtgaatcacaatatttaaaaaatattaaaaatattttaaaatatcaccttaagaatcacatttactgggaaataaaaggcagttataataacacaggaaacattttgactgcatattccatgaaattactactgtctttatacttttgtagcataataagtgattctattttaatctaatttcatatataatagtaatatattttcataatttaacgagttcaaatctaaacatggcacttgcattttaaatgcaaagtatatgtaagatccaattttaaagatccattttatgtattctttaaaatgttttcttccatcatacaacttcagatcgacaatatattttgtattgaattgttttctttaatttttacagtgaaacttgtcatttcaagtttagtaaatattatgacttgattttcaaataaaaataaagcataccaaacacatctacctgctatctaagagtattttaagaatcagtttccaaatactattcagagcaaaacctatagaatatccagaaactgtcactagttttttactcatttctgaattcattagcttttaaactctttctttttttttaggaaaatcaccagtggtctatatgctggtacaatttaagcaagaagacagttgagaggaagagataggcttgcaaatcaaggtacagaattgccccagataacttttttcatgtgcgtccctgtgaagagaccaccaaacaggctttgtgtgagcaacatggctgtttatatcacctgggtgcaggtgggctgagtccaaaaagagagtcagtgaagggagatgagggtggggctgttttataggatttgggtaggtaaaggaaaattacagtcaaagggggtttgttctctggcgggcaggagtgggggttgcaaggtgctcagtgggggtgctttttgagccaggatgagccaggaaaaggactttcacaaggtaatgtcatcacttaaggcaaggaccggccgtttacacttcttttgtggtggaatgtcatcagttaaggtggggtagggcattttcacttcttttgtgattcttcagttacttcaggccatctggatgtatacatgcaagtcacaggggatgcgatggcttggcttgggctcagaggcctgacattcctgccttcttatattaataagaaaaataaaacaaaatagtgttgaagtgttggggcggcgaaaattttgggggggtggtatggagagagagaatgggcgatgtttctcagggctgcttcaagcgggattaggggcggtgtgggaacctagagtgggagagattaagctgaagggaggtcttgtggtaaggggtgatattgtggggatgttagaagaaacatttgtcgtatagaatgattggtgatggcctggatatggttttggatgaattgaaaaactaaatggaataacagaaggagaaaaacaggtataaaaggtctaagaattgggacaactcaggatatctgattagagagtgcttaaggagattcagcatagtcctgccagcaaagattatttatttacttcaagagttaagagtggcagtttggggatagcaccaggagatatcagctgtgatggcttggaaaaacagtgtaaactggcagtgtaaacaagagcagggcatgtatgagtagttgagaacggtgaataggagtatgactagacagaagatagtagggatgacaagttttttgggggcacagtctaagttggtctggtgtctggaatgagactggggcctaataaaaaggagcgtctatacaggagcttaaatgggctgtaccctgtagcattccgaggacaggcctgaattctgagaagggaaagtggtaaaagtattgtccagtcctttttaagttggtggctgagcttggtgaggtgtgtttttaaaagacctttagtcaattctacttttcttgaagacggaggaccataagggatataaaggtttcactgaatactaagagcctgaaaaactgcttggctgatttgactaataaaggctcatctgttatcagactgtattgaggtgggaaagctaaactgaggaattatgtctgacagaagggaaaaaatgactgtggtggccttcccagaccctgtaggaaaggcctctacctatccagtgaaagtatctacctagactaagaggtattttagttatctgactcagggcttgttgagtaaagctaatttgccagtcctgggtggggcaaatcctcgagcttgatgtgtagggaaggcagggggcctgaataatccctgaggagtagtagaatagcagatggaacactgagaagttatttccttgaggatagatttcctcgatggaaaggaaatgagaggttctaagaggcgggctagtggcttgtactatagcataacctgcctttgctggtgtgtggcgattaggcctggtggaaccgccatcaataaatcaagcatgatcagggtgaggaacaggaaagaaggaaatttggggaaatggggtgaatgtcaggtggatcagagagatacagtcatgggggtcaggtgtggtatcaggaataatgtgggaggccggattgaagtctgggccaggaacaatggtaattgtgggagactcaacaaagagtgagtatagctgaaggagccgggaagcagaaagtatatgcgtcaggtatgaggaagaaaatagattttggaagttatgagaactgtagagagagatttgacatagtttgtgattttgagggcctctaaaagtattaaagcagcagcagcagccgctgcatgcagacatgagggctaggctaaaacagtaaggtcaagttgtttggacagaaaggctacagggtgtggtcctggctcttgtgtaagaattctgaccactcgaaccatgcctaggaaggaaaggagttgttgttttgtagaaggtgctggggtttgagagatcattcggacacgattggcagggggagcacgtgtgtttttatgagaattatgccgagataggtaacagatgaggaagaaatttgggcttgattgaagtaatggggctgtctgtgaagctttgcagcagtacagcctaggtaatttgctgagcttgatgggtgtcagggtcagtccaagtgaaagcgaagagaggctgggattaggggtgcaaaggaatagtaaagaaagcacgtttgagatctagaacagaataatgggttgtagaggcaggtattgaagataggagagtatatgggtttggcaccaaggggtggataggcaaaacaatttggttgataaggcgcagatcctgaactaacttgtaaggcttgtctggttttaggacaggtaaaatgggggaattgtaaggagagtttataggctttaaaaggccatgctgtagcaggcgagtgataacaggctttaatctttttaaggagtgctgcgggatgggatattggcgttgagtggggtaagagtgattaggttttaatgagatggtaaggggtgcatgatcggtcgccaaggagggagtagaggtatcttatacttgtgggttaaggtggggggatacaagaggaggacgcaaaggaggctttggattgggaagaagggcggcaatgagatttagctgtagtccaggaatagtcagggaagcaggtaatttagttaaagtgtctcagcctaataagggaactgggcaggtggggataactaaaaaggagtgtttaaaagggtattgtctaagttggcaccagagttggggagttttaagaggtttagaagcctggccgtcaatacccacaacagttatggaggcaagggaaacaggcccttgaaaagaaggtaatgtggagtgggtagcctccgtattgattaagaaggtaatcacttaccttccactgtgagagttacccgaagctcggcatctgtgatggtctagggggcttccgaggcgatcgggcagcgtcagtcttcagccgctaatccgagaagatctgggaaggagtcagtcagagagccttgggccagagttccaggggctctgggaatggctgccaggtgagttaaacagtccgattttcagtggggtcccacacagatgggacacggcttaggaggaatcctgggctgcaggcattccttggcctggtggtcagatttctggcacgtgtagcaagctcctgtgggaggaggttctggaggaatgcctggccgctgcggttcaggcgtttggaagttcttgtgtgctggagatgtggctggggtttgtctcagagtggaggcaaggaattgcaacttttttctattattgtacaccttgaaggcgaggttaattaaatcctgttgtggggtttgagggccggaatttaatttttggagttttatttaatgtcaggagcagattgggtaataaaatgtactttgagaataagatggccttttgaccttttagggtctagggctgtaaagcatctcagggttgctgccaaacaagtcatgaactgggctggatttttatatttgatgaaaaagagcctaaacgctatctgatttgggataaagaaaaaggagcattaaccttgactatgcctttagctccagccacctttttaagagtaaattgctgggcaggagtgggagggctagtcatggaacgaaactgtaagccggaccaggtgtgaggaggggaggtgataaaaagattatagggtggaggagcagaggctgaggaagaattgggacctagctcggcctggcgaggagcagcctggggaggaagggagaggtcagatgggtctgtagaaaaggaagattagacagactcagcaatgcttggggttggtactgaggggacaggcgggagggaaagaaggaagatttgggacgagttgcactgggcacagagactaggaagggactgacgtgtaaaagaatgcctggacgtcaggcacctcagaccatttgcctattttatgacaagaattatttagattttgcaggatggaaaaattcaaagtgccattttctggctatttggaactactgtcgagttggtattggggtgaagcggcattgcagaagaaaataaggcatttaggttttaggtcaggtgtgagttgaagaggttttaagtttttgagaacacaggccaagggagtagaaggaggaatggagggtggaaggttgcccatagtgaaggaagcaagcctagagaaaagagagtagagaaatggaggaaaggggttcaggggttcttaccttccagaaaagtgggaaaaggggttggggcacagagataagaggttggggggcagaaataagggattggggcgcagagatataagaggttggggcacggaaataagggactggggcacagagatacgaggttggggtgcagaaataagggattggggcacagtgataagaggtcagggtgcagaaataagggattggggcacagagataagaggttggggcacagaaataagggattggggtgcagagataagaggttggggcatggaagtaagggattgggggttcttgccccatagaaaagcgggacttgccactaagggtgaaggagaaggggttggggtacttaaccctctcccagaaaagcgggacttgccgctaagggtgaaggagaagggcttgaggggtacttgcccctctcccagaaaagcagagaaggggtagagacaaggagagaaggggttgagctacttgccccttccccagaaaagcgggacttgccgcttaaggtgaaggatcaaggcaggcgtccctgcgtggtctgacacccttgaaacgtgggtgtataatcagagaggcgtccctgcaacgattaaacaccaagggaaggctgccttcccagtccgtgaccggcgccggagttttgggtccacggataaaacatgtctcctttgtctctcccagaaaatgaaaggaattgaaattaagagaagggagagattgaagagtggaaaggagaaagtggttgatggacagtgagagaggttggagaagagagtaagaagaggccgtttacctgatttaaaattggtgagatgttccttgggctggtcggtctgaggacatgaggtcataggtggatctttctcacggagcaaagagcaggaggacaggggattgatctcccaagggaggtaccccgatccaagtcacagcaccaaatttcatgtgtgtccgtgtgaagagaccactaaacaggcttcgtgtgagcaacatggctgttatttcacctgggtgcaagtgggctgagtccgaaaagagagtcagggaagggagataagggtggggccgttttataggatttgggtaggtaaaggaaaattacagtcaaagggggtttgttctctggcgggcaggagtgggggtcgcaaggtgctcagtgggggtgcttttgagccaggatgatccaggaaaaggactttcacaaggtaatgttatcacttaaggcaaggaccggccatttacacttcttttgtggtggaatgtcatcagttaaggtggggcagggcatattcacttcttttgtgattcttcagttacttcaggccatctgggcatatacgtgcaagtcacaggggatgcaatggcttggcttgggctcagaggcctgacaacttttaattaatatcaactgtgagtagagaagttaaaatgaaatatcaaacacaatgtttgaccatgataaagaaggtgtggagtttcttcttcttggccatttattggatacttaaagacttgacattttcctcaccaaagaagtcactaggacctatggtacaacgttaagatcaatgatgaaaaagagtcatcctcaatggaagagtatgcatcattctgattatacacaagcattgattatttgctgatgtgagaaagggtcaagataaaaattgatctttgaatgtatcttattcaattttttaatatttcatagtgcttcagttgtttggcacatttgtcatatctttaattttttttgatgtcctgctccacccttccatatcactataaaatgttaatacatttttcatacacatgcagaacatcaggttttaggattatttttaaattaaaatctgaggccaggtgcagtggctcacatctataatcccagccctttgggaggccaaggtgggtggatcacctgagatcaggagttcaagaccagcctggccaacttggtgaaaccccatttctactaaaaataaattagctgggcatggtggtgcgtgcctgtaatcccagctactcaggaggctgaggcaggagaattgctggaaccgggaggtggaggctgcaatgagccaagatgataccactgcactccaacctgggcaacagaaagaaactccacctcaaaaaaaacaaaatctagcctttcatgaatcttacatgtataaaatgtttacacttttattatgtaaaagtaatgtattcccccaatggattttataacaatacagtcagtccctcttgcaaaggggactttttcataactcccctactgtttcattaaaattgaggtttaatttgattctgtgttctcacatttaaaaatctatatttttaagatctgctttttccttcgaagtaatggctttaactccgaatcacttttaacagttttattgacctgtaattcacatactatccaatttgcctattttaatgtgtagaattcagtggtttttaatatactcagagttgtataatcatcatcacaatttagaatatttccatcaccccccaaagtaatcctatacccatttacaatcactccacatacttcttcaacccccagcactaggcaaccagtaatcctctttttatctctgtagatttgcttattctgagaacctgcaaacttttaacggatgtacttgctgggaatgtcagagaagttgtttgagattaagaagggttggcaaacaaaataaaatttgttgttagatttaggcaatagggtcttgatttatttggctaagttcttaattttttcacacttctgaaatgaaagtaataaaattttgtctctgagcttctgtcatccttacttttgctattcaattttattttagtatggcaaaataaataaaaaggaagtcatcctccaagtactcctcttaacaataaattgattcagaaaaaccaagtttcaaactcaggaaggttaaatttctagtccatttctttcattttttttccattctgtccaatcaagatttgtcaaacaaaactatcctttccagagaagaggcatttacctcaaaaaaacttttgtgtacgtggtatttgcagttgaatgtcataagaagcaattgattgaagtgtgccatctgtttcttttctaaatctctaatatgcaagacacgtctttaaaattacacttattcagaggatttttatgaaataaaattgcctgtcattctaattagctctgaatacttctcttgcaacagtggtgtggcataacacattagtaggaactttggttggtatgtattttggccactaacatcactaataaaaaaacagtaaataaaatcggaatatagaaactggggctttctacataaaatctgatttttttattagtatttattatgcttcccattaaaacaataaatctgatatgtattatttaatatacttcccattaaacaatacatttcataatacctaataaaataagaaaatagatcctattaattacatcctcaaatacatattttaatatttttctgaaatatatatgctctttacacactagaatataatcgttttcgttatctgcattgtgctaaatgtgaagtgatgggcgatgcaccattttgtatttaaaagatttctcctatggtttttttctgttgtaattactcttttggttgaccacgttcggttggacttctgaccattgttccaagcatccactccattactctatttgacatgacacagtgagtttaaaggacagtatcgtgttagacaaagattgaagttttaaataatacatgataacttgaagggaaagttaagaaaatttaaataaataaagaggatgaggcaaggggatatgtatgtatgctttaaatagtctataaataagactcagtgaaagatgaaaatatcgttttgaacaaagaaagggtggaagatatagaaaacgagcagagcatactgtatggttccatttacataaacttccagaactggcaaaaataatctacagtgatagaagtcaaaaagtagttgcctggagcttggaaggtggtgactacaaagaagcaggaggatggaattgttttatgttttcatcacagtggcaattacacgggtgtaaacattcatcaaaagtggtcaaactctacatttaaaatatgcacatattagtatatgtaaattacactcattaaggtggattccttaaaaagtcaaagtaggcagtaaagggtaccattcagtccctctgtggtcctgctttaatactgaatggaagacaacctccttctttttaaatgagcatgaatatccatgaatatcgaaaagagagcattaagctctttgtaatgactgcatttcctcatcctgctcaggattgactactggcattttaatgcacggtaatgtgggcatttctttgatagacattccactttaaatgcctactttttccatattatttcaactgaaggagaaataaggcagcaaccttatctattaaatcttcacagggttcttatgacttttaaagcatcattttgaattgaagctactattttatattatcttttctcagggtgggctgaaaacaaaatagcaataatttttgtaggaaaagtaggttaaagtctgtcttgaataatcacaaaatcacacttaatgtcacctcataaatcagttataaatagtgtcagaggtaatagaattgcacatgcgaaatttaaaaatattctgtgcacaatttttgtagaatggaatggcatggtgtttggattaatatgtacggcaaggttatggtcaggcacatctatgttttctatctagagtcactcgcctacaaagggaaaaaaatcagtcactgtggaaatttaaaaaataatactttggtaggatggagagaaacttgaaatgacagagcgttaatcataaaatgtatctcaaatttatgtataattagctgagaggaaaaaaattggaaaggagagtgtatgatagatgcaaaatgttaatataaagaatgtcgtgatcaggaggaagggaagaagcaagtgagcctcaagagaaaaaaatttgacttcactcaaagtacttcatatttttgcaaaattaattaaaattttagaaatcgacactaaaacgttagagacctcagaaaacactctcagttgataggtcttggagaaatttttttaaagaatatctgattggataatttttaatgacggagcagtaatgttttagtgttaaatatctcaatcttcccctaagggggaaaaaaaacgcaaaaataaattcttcgtgaataaatggcataattacaatcatagcacacattgttctgactgcaatagtcacaattcgccactagggggctgtaattctgttcttagcagttcttggtccacaacattttcattccctcccagggtacttgaacagttaggtgaagttaagtgggagcttcgacgggcataacaggtcattaatgtgtattgagatgatctcatgcgtttctgcgatgcgatgtataattcttgttgtatagaataataacttggccaccagcttcttcaccaagcatggagtctcatcattgctccaagattgctattaattttgtacgtattacgtagaatcattttatcttcctttttcccaggaaattatttttatttactataagtctcctactttttcatgaaaattgaaggttaatgtgatcatgtgttcttgcatagtcatttcaataaatctgtgctgtaaaagagacaaaaaatgttggttcaaatttataaatactaaatgtattttctgaagtgtagattaaaacagcaaagttgtgggtttttttattttttttctttttttgagacggagtctcgctctgtcgcccaggctggagtgcagtggcgcgatctcggctcactgcaaactccgcctcccgggttcacgtcattctcctgcctcagcctcccgagtagctgagactataggcgcccgccaccacgcccggctatttttttgtatttttagtagagactgggttttaccgtgttagccaggatggtctcgatctcctgacctcgtgatcctcccgccttggcctcccaaagtgctgggattacaggtgtgagccaccgtgcctggcccaaagttttaatccaagttatttttcactcatttgaagttagaactattttttactttcataaggaatgaaaaatataatttgttggtgtagtacattgtatcttgcatgatgtaaggggtagtcacattaaattatttaaatgcggctataacatttattgaatattttatattatacttcaaatatgttaatttatgttgataaatttatgagctaacaaaagatcttgtcctcaatataataattaacatttcctatgtatttctcataactttgatgatctttacatcactcaattttacttactaggctgagtgcaagagttagctttatatttttaaaaataatccctgcatttaaaactttttttgatcatgctttatgtgtttggggaaatttttgatgtttaaaacatgtcaaatattaacgtccttgcaccaaatttatttgtcctactgcaaaaatatagctggctaatatttatttcagtcttgtttttgcattccagaataaatattggcaactgatgctcttacaataattgatacagaaatggtgattttcaaatgttgtttcctcttccagcgtctaatattgttttagtatctgtggatgaaatactatttactcttgctctgtaattgttctatgtgaaatgtttcaacttgacatttgacttagaattttgctgattcatttagaattcttaactaatatttaatttcctctttagcagaaggacgaacactgacttacctgctataggaatggggtccggatccagaccccaagagagggttcttggatcttgcacaagaaataattcagggcaagtctgtaaagtgaaagcaaggttatcaggaaagtaaaggaataaaagaatggctacttcatagagcagccctgagggctgctgattgttttttattttattttattttattttattttttttttgagacagagtcttgctctgtcacccaggctggagtgcagcggccgatctcggctcactgcaacttccgcctcccgggttcaagcaattctccctgcctcagcctcctgagcagctggaattacaggtgcccaccatcatgccaggctaatttttgtattttttagtagagacggggtttgatcatgttggccaggctcgtcttgaacccctgacctcaagtgatccgcccacctcggcctcccaaagtgctgggattacaggcatgagccactgcgccctgccctggttgcccatttttatggttatttactgatgatatgtaaaacaaggggtggattattcatgcttcccctttttagaccatgtaaggttacttcctgatgttgccatggcatttgtaaactgtcatggcgctggtgagagtgtagcagtgaggacgaccagaggtcactctcatggccatcttggttttggtgggttttagctgggttctgtactgcaacctgttttattaacaaggtcttcatgatctgtatcttgtgctgacctcctatctcatcctgtgacttagaatgcctcaactgtctgggaatgcagcccaataggtctcagcctcattttacccagcctctattcacgatggagttgctctggttcaaacgcctcttacatacctgctgtactaatattttgctgttttaaattcattttatataaatgagacttctttcttctgaagcttataggtatcagccttactacttttcagccattcattatatgtgaatggtatacctactctgtgtggcaccttacttatggagttcttactgcatttttctcaatgtttgcttttagggttatcagctaacacccgcgagcatctataacataggccaactgacgccatccttcaaaaacaactgtaagtatacacataagcgtgcctcaagactcttattttgaaataatattcaactattatatcaaggtgattcctattattttgctagtgtagacctacccctgaactagtaaaacatatgccattaagggcctaacatgtttgaaaaagaatattatgtaattggtaaacagcattttaatgcaacctgaaaaaaaaaaactcggcttattttattactaagtaatgtgtgatgcagaccccttaccgaactgttaaccaccaccgcagatttatagtaaataagtataaagtatgatagtataaattgggacaattaggttagcgaagttcaattttcttcttcaatgacaaactcttgttttttttttgtttttttgttttgttttgttttcttgagatggagtctcattctgttgcccaggctggagtgcagtggtgcaatcttggctcactgcaacctccgcctcctggggtcaagtgattctcctgcctcagcctctgggtagctaggattacaggtgcatgccaccacaccaggctaatttttgtatttttagtagagacagggtttcaccatgttggccaagctggtctcgaactcctgacctcaggtgatccgcccacctcgacctcccaaagtgctgggattacaggcgtgaaccacctagcccagcctgctttcagtaacaaactcttatatccatgattggggtgtaggaaatctagctgttgttttctatgataaattttagaaaacatagctagctcttcaaaatactctcaatggatgcacttaaaaatctcagcaggagaggcagggagaggagaattttgtttctcaaaagggagtatcatttataaatgctgaaaaacgcagatccagataatggaacactctacattctatagatgtctagagcatgattatttgattgggtaaatatattacaagttaaacaaggtgaatttaaattggattccttattttcgactccagactgcatggggaattctcaattaaatttctgattgttctcataatcatacaaatatttaataccacaaaatgtttttagaatgatagttttggaggaagaactgatacgatggtatagactaaatcatttttgacagtaaaattttaacagaaatttttagtataacattaatatatacgcattagattaaagaagtgaaaagtcgaagtctatcaaaattcgaaagaggatagggatggaataaggttgggaatgtctgctgcacatgttaataatgatcaaaaataaaagaaataagaaaacagtgatttgacatcaagacagttgcatcaaaatggctgcattaaaatgtaccctttttcagaatagccaattgttctgttttattcaactactcaccatttaagatgatggcaaaggtaactttctttaatacatattgaaaagagttcttgatgctatcaacagctttccagaggggaaaaaataaaaaaaaatttcataagggacgttcaaaaagtataaaatgtaaaattttgaagaacccccacagcagtcctgaaagcacacaggaaatcactcattctgtttgtgaagattcaagtttgcttgcagatgttttcaatgcgttggtgaaataggttaacctggacatgcaggtaagtttctactctcaggcttcaaacaatgttcacacaagactatctcacatatatcattggcatggtaagcctcgcctggtagtaaagaccaaggtcagccttactagaatgtgaagttcgccaatttcatctttactgtcttcctttcaatgctattctgtccttaccatgttgtttttcgacctctatgtgccaaatattcacaactccatagtgagtactccttgcttctctcccaggcctgtgcacccctctttgtacacacacctgttgacactttgctcttatctaggtattaattagagaagatttgatatacaaattcatcataatgtggcaatatcttacaagtcctaccccatctagagggaggcatggtttaacatgtggttcctataactgaatcccttgatgagctgaaggggaaaatatgcctcaaatctcatcatgtaggtatgtaaggcctttgcctacttcacttctctgtaaggctgcctttgtcagggtatatcagtgacatgaaaaagatatgtacaatatatttattatagaaggttggagcttgattatttatggtaaataatgttggtgttgttaaatatattaattcttactgtaaatagaagagtaccaagagttttattgtaatgtgtatacatctacagcctgatattctttgggttgttttttttttaatctctgggtccttggtgatttctatggctattttatttttatttttatttatttattcatttttgagatgaagtctcgctctgttgcccaggctggagtgcagtggcatgatcttgactcactgcaacctctgcctgccgggttcaagcaattctcctgcctcagcctcttgggtagctgggattacaggtgcccaccaccacacccacctaatttttgtatttttagtagagacagggtttcaccatgttggtcaggctggtcttgatctcctgacctcaagtgatccaacagcctcggcctcccaaattgttggaattacaggcataagccaccgcgcccagcattttaagctatataattcaataaatcttaaaaagaaatttgtctccactatcatttgaacttagtaataccttccgtaaagccttacttatgctacctattctactgtgctatagatgtatgtatatatttatatcacagtcaaagtaacaatttaggtaatgtattcaatgtctcctgtgaaaataatcagttggacaactgtgctcctcctgagttgtataaggtttgtgatatcagtaagtatcaaaggtaaacattatttttttctgtaaaaccgcatcaacatttcaagttattcacagaaaaggttaatgtaatgaggaaatagtatgcatacattggttctacattgtcaaaacatgatttataatcgtcactctcttgacacttatattaacaatttaggaatttttatctttcaattatgtggtcttgtgttactataaataaatgcaagttcaattaacagaatctgttttcaatatgagttctctgatacagaactgagttatctattgcaaagttctttactctaggttaccaaattacttcaagaaaaacataaataggctgggcatggtggctcatgcctgtaatcccagcagtttgaaaagtcaaggtgagaggatcacttgagcccaggagttcatgaccagtctgggcaatatagtgagactcccatctctacaaaaaatttaaaaattagccaggcatgatggtgcaaacctgtagttctagctattcaggaggctgaagtgggagaattgcttgagcccaggaagtcaaggctgcagtgagctgtgatcacaccactacattccaccttgggtgacaaagcaagatcctgtctcaaaaagaaaaaaaagaaagaaaaacagaaatacagaaatagaccataacaaatagcaaatgttgcttacattgatagacaattccatcatttcactttgcagtttgttgtagttatctgttttattcacaaatattttaatttcacatctttgatttaaaaatgaaatatattttactactcactagctcttcatttgattgatgtaaataatatataatcaaatgcctgtatcaacaagtcaaacatattctgtaaatatatacacctgctatgtacccacaaaaactaaaaattaaaaaataatttatgaaaggagcagagaattgagtgtgttaagtaacaataatttgttctatatatagcacatgtattttatatcacttacaggaactaacatgaagtcttgcacataatatacattcaataatatattcaataattagtttaataataactatcaatattatgacaaaataacagcatttctagaagagaggtactcaatcaggaatgcattttagtaaatgaacatacacatttaaagcacaggaaaacctgaactttataagatatttccacattctgtgcagtttttgcttttgttaatcaaaaatttaaatgatcctttataattatcagttgaagtcaaaacacatggaattaactaagtacttaaagaactgattatcgtaattaataatctaacttagccaactgataactgttaaaactatctgccacacatatttttcactcaatagtctgtgccaaaattcaacaagactaacaacatagtttagcatgcatcctttctaagatactgcaacttttgtgaaataagtgaaagttacctcgttttggaaaggaaagtagccaaatggttatcaaggtggtttcaaagttacatgttcatccatattagataataacagtaaaataattttatatgtatgttttctggttttcaacatatgtctttcaaaaatcggattgactttttaaattatacattttcaaaacattaatatcttcttaaatataaaatataggtataacttaagtaactgtaccaagtaaattaatacatgtcttataagaggatattatgcttaaagagtttatgacacaagaatattgatttttatttcgctatttgaaaatgtgtattagtcttagcctttagtacatatgactctaaacgtaacatagctctttcaaataaaatacagacattttaattgtgtggaagcttttatatgctgtgtgaagtgactatttgcatattacatcatgtttcaattgcattttgcttttatttaaaaatgattttttcctccagcaaattaaacatatggcccagacaagtagtacattgtgcacataaaatttctaacaattcctttcagagattgccactgtgtagatctaagtacagttgtccacttagttctctcataacaagcctttagagatgctaataaactaatactaaagtaataatgaagatactattaaaatatgaaaaccaaatcatatatgtgtggtatatccattagatgtatacataaattaatctctatatatttatttttgcttccataaagtattctcagtgacttcctagggttttaattgtgtaagaaaatactctcaatgtgttgcaagtttcttagcatcacggggaattgcactgttattcagataactggattaacaagaaactgcgtcatccttgaatggcttactctcccttatcccccgtaatgaatttattactaactccagtcaactccagtcggttttaattcctaaatatcttcactccatttctacaaacatcataccagtttggatttccatcatctctttagtactagaataaccttctaactagttctcccaattacgcatttgcactcccaaatccgttctcccaattcttattgctcctaggaaaataccaaaatctttatcatggtttataaaagacaacctgatctggttcctcttcagcatcatatattccctcacccccctcatgaatagttgggccccactgatctactttcagttccttgagcacatgctctctctgatcacagggccttgccagaaattgtgccttctgttgtgaatactaccttgcattccccatctctcctaatacttacatcaccagtacaccatttaactcctatataagccatcaaaacacgagcttaaaggcatttttttttctgggatcagggaagacttcctgcccaccataccccctaacacaaggtgagaattctgttatataccctaatagataacatcatgtaccttcatcatagcaattattacagttgataattatacatttgtttttgtgattccttgaggattcctgtctcctccactagatgttaattaactccatgagatcaggaacagtatttgctttcgctcaatattgtattcttagcatctaacacactgctaaggatataccaatgatttaataaatatttgttgactggataactgaataaacaaataggtattatttatgaaaaagtcatttatataatttttggtgatggttggtctgtgactgttcgattgcagaggatatttttctaccttcccccaagtggcagctgtaaatattgcagcctggtgaaaaatgagaagtctcagtaactaagacctcaacaaagggttgtatatgtgagctgtcaactcataactgacagcagtaaaagtactgctatgattttaaatgtaatgttatctatacaagcaggtgaaacttatatatgcctaacaccatatttgcattattgaacagtccagcaaaaattttgaataagtttcacttgccctgtttcatgcagcacgaggttcacattcacattttaagatagcagataatcaaatcatatcactgctatgctttattaaataagcaaactcaaatgtatgtcaaatgagttatagcataatttataaagttttaagattattgccaatacggcttacatttcacactatatatttatgcatacatgtaatacagtatgaatatattgcctgaatatatgactatatggaatatatatattgaatatatatgaagataattgaaatatggtgttactaaatgaataccttgctaagtgatataatgcttagttcatatactttcctggctaagctttcttatttctgctgtaatattacattatactttatatgtattacacggaattgcactcggctattttgcaatgacccaaatttgcattaaattccatatatctaccataattcatacattttattatcctggtcatgtttcctgtttttcatctgctaaaagattgatgattttaagacagcatgatgagtgctagactagtgcagtcagtctggggaggaatctgagttctgcattttttttttctttttttggcagaggagtcttgctctgtagcccaggttggagtgcagtggcacgatcttggcctcactgcaaactctgtctcccgggttcaggtgattctcctgcctcaacctcccatgtagctgggactacaggcgtgcgccaccatgcctggctaatttttgtatttttagtagagacgaggtttcaccatgttggcaaggatggtctcaaactccggacctcaagtgttccacctgtctcagccttccaaagtgttggaattacaggcatgagctatggcacccggcctgagagtctgcatttctaaccagctcccagatttccatggactacacttggagtcacaaggtaatgaatcaggggatgagaaacttttgaaaagagctagatgataaatattttggatatgggaaccatgtaggctctgttgcaactactcagctctgccattgtagcttgaagtcagccacagacaacatatgaatgagtgagtggggctgggttccaatgaaattttatgaacactgaaatttgaatttcctacaattttcccatatcatgacatattatttatctttttgtattttttcaatcgtataaaaacaaatacatcattcttagcttgtaggccatacaaaaacagtctgttgttgccaaccaccctgctatggtataagatgccgatcgataactgttgtagaggctggaggggaggtagagtgtgacaggataggctttgtagaaaggattacagttgagctaggacttgaagaaggaaggcttttcctggacagacaagtaggagaaagtgaaagacaaagatgtaagccagcaacagcattagtatgttctctgaactgaaagcaatggattgtggcctgagaagaacaagcccgtctaggttgagaaggctcaatgaaaggggggtcccttaaatgcatgtctaaatagttttaaaccttaatgagtagtgatgtcaggtgagcatccagaatgagcagtgggggatgctattaagttctacatcttagaacttcaagtcaagagagaactggactactgggagggagaaagtatagaaatgactgaggaaaccaggaaaaactgcacttgaaaggccaaggctctttgaaagtgactacaaaatgttctcaaatgaaagctttgtggatgctttatacaaatgatcagggcttgcaaatttattgatgaaatgggaaatatgtatcacatagccggacagagcaagcctgtcaagccatttttccattgctacagagcacacagcagattaaaaagggaagctaagaactgaggattgaagatttgaaaaatggtctccccagatgcctcagtgtctgactgactttgctgataagctacagagtaggaatacacgctgaggggtaaaatgagcatatgggttttataaaagatgtttctattagttctctggaggtggcagtgaagtgagataatgaaatactacaaaaaaaaaccagagctggaaattatgaaaaatgggatatcaagtagaaaattaacaaaatccagtgcttttggaaactctcttctcccaattatttttctatttcccatctcgttctcacccatttccccacaggatgctgtccagttgttttggaggtatgtttcattggaatagtggagttaagatttgctgagtaactactctacaaaaagcatgactaataaaaaatctcatcatccaataaatgctgaattttactaccatttaacagatgaggaaagagaggcttggaagcctactttatttatccagatctcctccaaaataggcaatacatctgccagtagatgtggcttacctataacccctggtaaaaagtgggaagcagagcaaagggagaatttccgcttttccacaataagggaatgctagttaatcttccatcttccagacgtacaggaaagatttgtctttggctttgttcaaatcagaaacaattacctacaagttttggtcacagcattttaggtaatttttaaatactggctaaccatgagaggaaaggcagtaaggttttattaatagaagttagaaagggtagcaaatatagacatagtaaacttaatagggtttaaaaaaaaattcaaaggacctgtgatcaggtttcccaccaaacaagagagatattaaatatggttataaactatcatgtattgagcatctgctccatgccaggcactattggacagtgtacaaactatgtcctttaattttcacaacattccaatgactggttattattacctatatttaacatatgaggcctaggggcttaagcgagttatccacagtcccctgagtcctataggtttctattgtgtcaatctggtaatattaagtacctaacacataccagatgttaaacaaatgttaactattgttttcttgctagtattgtcattattataactgacgtttacttaactcctccaagccttacttaccttaaccataacatgaaagtcaacacaaaataagtttgccagaatgattaaatgaaacagcccacttaaagtttctggcatacagaagccacttagtcaatgttaaaaccgtataaattttctcttgaaggatgttttttatttttagatgaggctatataagacagtgtatattgatgctttcagctatttagtggcatgcccctggataatgaacttgatgtttatcttcagaaaacaatgtttgactagaaaatgacttttttcaagtgcctgtgatcaggaggttaagagagtttatggctgaaatattcagcatacacatcaaagtttcttagttttttctatttcatatgctatttccttttcctctcttcctataatttgtctccctaagaacttaaatagatattttatactgtttgtgtatttagcaaaatagtattatttataatgcaattgaaatagtctaaaccattggtgtcttagtctacaagttgtctctttttttggtggtggttttttttttttttttttttgagacagagtcttgctctgttgcccaggctggagtacagtggcatgatctcaggtcactgcaacctctgcctcccaggttcaagcgattctcgtgcctcagcctcctgagtagctgggatgacaagcatgcaccaccacacctggctaagttttttgtattttcagtagagacagggtaggctggtcttgaactcctggactcatgtgatccgcccgcctcagcctcccaaagtgctaggattatgggcgtgacctaccccacccagccccaaaagttgtcttttaatagttgaagcaatgtttactggtagagcataagcgctcaataaatgtgttaaataaatatcagatgaaagagtaaatgaacaactctttccattattacttattatttttatatctttagatttccacaaagaatgcttccctaaaattggatatgtacttatctctgcaaattcattttgacaaaacacatcatattctcctagatataaaagcacaaatgaattaatctttattacactttacaagttaaaattatatttgaaattgattttgctacttgatgtgctaacatttaaatgcagctcagcttccttatattgtttccttcataatgcttctcttcatttaaaattcattttgatgatttctggcactccttgtgcctttaaagcataagataaaatttcagtttacaacctgatctttatgttattgactaacagcaacctctgattccaaaaggaaaaaaaaatgaccaagcatctctagcatgttaagaaagaactcctgatagtttagagtcttctccaaatttgtcaaataaaggcacagctagaatgtatattattaaaaagagtaattctttgggaaaatgtttatttgagagcttataattgaaaagctagctcggggaaagaaagccctgatgtcaaattaggggaaaaaaaatgaagaaagggcaagattagcatgcattgtaatggagggtgctaaataaggctctataaaacagtgcatattgataatttcagctatttagtggcatgcccctggatatttaaaaagatatttggatatagtttacataaaacctccaaatttcaatagttggtgccaccttcaccataataaatgagttcctgctctgttaatttccatgacagctggttgttcaaaagagcctgtcacctccctccccgcaccttctcttttgcacaaaccagctccccttagtattctgccatgattggaagcaccctgaggccctcaccagaagcagatgctggcactatgcttcttgtacagcctgggcttttctaaaatattctctacttatagtttgggtgtttgaccctccaaatctcatgttgaaatttaatccccaatgttgagaatggggcctaatgggaggagttgggtcatgaggtaaaatccctcatgaatggcttggtgctgtcttcatggtaatgagtgagctcttgctctgttagacaccatgagagctggttattaaaaagatcctggcatctttctccctctctcttttgcttcctctctcaccatgtgatctttgcacatgccagctccccttcaccttccaccatgagtggaagcagcccgaggccttcaccagatacagatgctggcaccatgcttcttatacagcctgcagaactgtaagccaaatgaacccctttttaaaataaatcacccagcctcagatattcctttataacaacacaaatggattaagacagaaagtgagaagtggcttttgagctcaacattgaagacagaatagaatttagaatttgaagggggaaagagaaagagtatctcaaagtgtgtgttggagtaggggagtttcatgaaaagcttggaaaccaatgagtgttgaatgaggcagggctgatggtctgtggccttactgggttgtactcagtaataggagatcagctggaataggtaagtgacagcaacttccagcagctctaccttcattaaatgttatgatatcatgaaccagagaacataaagttctaagtttattttgggggaatgttatgtaaatccaagatcattatttttgattcttcatattaataggcattaagtgtgcattagaaccaaaaatggataaccaaggatatggtaagaggcagatgccgatttggtggttttgatatttacggtagctcttctaaagagaaactcctgttaagtgcttagacatatgggactggccagcctaggcaacatgtcaaaaccccatctctgcaaaaaaaaaaaataataataaaaaattagccaggcatggtggcacatgtctgtagtcccagctactcaggtggctgaggtgggaggattgcttgagcccaggaggttgaggctgcagtgggttgtgattgggccactgtactctagcctgggcaacagaaggagaccctgtcacaaaaaaaaaaaaaagaaaaagaaaaagaaagaaatatggaactggaactctcatctttgtctcatagttttgatgctttgtgctaattattatacctgtaacaaacatcccttgccaccaggtggctacagagttatgccatgttttcaagagcttaagactccaatgtagtgaaagcttttccaactcacaactttaaaaactgataatctatttaatgttctatctactatctagacaaccttttaggaaaagttgacttgagttcatcccttctcaatattcataggtttagagaattgatttatattcctaaagggggcactaaagcaaatgaaatagaaggaattcatatgatttgttttcagtttctagtgaattctgtcatttaaaaataatttttattcgtgttccataattcactgattgagattccttatggcagagttatagctgtgagaagagatgttcactgaattagagcaagagaaggatagcaagcctctataaagccttaagtggaaggtcagaggcaatttgaatagtagtagttggcagaatacagattcagtgtctctgacttcattaaacgttatgatatcatggcctacagaacataacgttctaaatttattttttgggaaaattatataaatccaagatttttttttgactcttcatattaataggtaatgcattaagtgggcattagaaccaaaaaagatgtaagctagtttttaaaaggcaaaacacttcaattaacatatcaaaatactcttgtcacaaggaaagaatgttgttcattgccctaaattattcataagttttcacataatttgctgtaaaccatagactgatagaagagtccagaactagtagttgatgttgatacaatgaatttcatctttttccccttcttctacttgtgcctatgagggttataataaagaatgagtggactaaggtatctggaaaatatattcttaaatattagattaattaactaaggtaatgatggagaactattatgtgatcagcactatgccaggaattactggggttgcagaaaagtattggccaagatatctgaccttcacttaaaatcttattggtgcgataagattaattaacataaaataaagaaaaagaacagtgtgctctaagcaataaggtttatacatgtacaaagaggtgaggaattaatgaagcctgcatttcagcagaagatccttaaggaagtgctcttatcaactgggatgaattgtataatcattttctgtcattatctctttcatatcattgcacagtctcctttttatgccccatgcaggcccttgcacatggtaggtgctccataaatatttgctgctggatcaaataattttttcacaaggatatagtaaaagcaagcaaaagagagacattttgtttttctgttgaatagttatcttgagaaaaaaatctgcattgaccatgatagagtaccttatcattagatcataggatcagaaagtaaagcttataaatctgctttctaaagagtgcagtgcccagtagctcatcctcacaggcttgaagaatgaagaccaaaactggaatgcctagtggatcctgaaaacaattttagttcactagtctgaatcaattagacatgacctataatatcaagattgcatgtagctagtagttaacttttcagcagaaatgtttctctaatgcttggtatatgtaaaatttgatggaaatatttaagtaatgtgaatttgctctcttttttaaaagcagtatttaaatagtatctattttatgcctaacaaaggcaggagtcttttatcttgatatctgtatctatctatctatcttttaattgagatggagtctcactctgtcgcccaggctggagtgcagtggcacgatcttggctcactgcaacttctgccgcccgggttcaagtgattcttgtgcctcaggctcccgagtagctgggactacaggcgtgcaccaccatgccaggctaatttttttttttttttttttttttttttgcatttttggtagagacagggtttcgccatgttggccaggctggtcttgaactcctgacctcaggtgatctgcccacctcagcctcccaaagtgctgggattacaggcgtgagccaccgcgcctggccaatatccttatattaaggaactcttatttgtttagaaatgctcctcttaaatttcagtcctccaaataaacaaacacattgaccagtatttgttgcaactagtagttggcaagtacgtaattttattggaacatggttaggcataattagaacagtagcacatcaccaaaggtagtgatagaataacagccaccaataaaataaaaactttggcggaatttctgtaggtgaattatctgtactacaaagatgcattttgacgtgtatgcacactgagagcaatataagaatttaggattaaggctgttgatatcatacttacatataaaacaattattttgggtactacaactgcttttcaaaactgtcaaataatgaacatgtatttttcggaatgatgaattagatggaaccacaccttcataagtgaatggcccaatgtaaactattaaaacccacaattaataaacaactagtcacatgttatttttccatctttttatatttatatctgtgaaatgatctgtgcatttaagagagtatctatactctggttacccaacagtttagaaacgggtctccattggaaaaacagaaacgggttaatttgtatctttcccttcaatttgctattattctagaattttaggggagaaaatatgcccatttatgagtcacagaaaagcctgtgccctttaatatctggagtacactttcttccccgactcctaaagtgggtaatgcttacttttaaattgttttcctcctcttcattttttaaaagccgttagccaagaagggactaggatatcacttgtagttctcattttgctgagaagtttctggtatttgattccattctacttcaaatgtctgagaaaagttccaaacctcaactttgtacatgaaacttccccatacagggaggacaggcaagaaagtaatgggacattttatacctattgtaagaaccaagcatttgtgggaacgtgaaccaactggatctcttacacattgctagcagaaatataaatttgtaaaattacttggaaaaagttggcattatctcttaaaatcgaacattcacaatctgtatatgatgttttgttttaatttttaattaattaattatatctatagagccatatgtggagacatgacaatggtgattcatacaccaagggttataattaatccagttctgtgcactagaggccagattattcctagaattcaaggatggctgagcacctaagcagcatcatttggtaaggcagcataccaggctaggacaaaagtcaagggggtatagagaaaggcacttgttttggtgggaacactattaattagagtagtgcttggttcataaaattttatctatgaatatttgctgacttaatgaagcaaacaatgaagaaaaaggtaacgattatttgccaatggctgcttgaggtggcagattttcagcgataaccaagagaaaaaaaaaagaggtacatcaaatggatagttttctgttttgtacatttgagagaatgtgagttccttccagaggcacaggaaagatgtatcattgtccttcaaacaattcaaggatagtgatctacaaatttgttgtcaggaaatattaggcaatttaaaatagtcattcaacatatatgccaacataaaatagttggatctaaagcaacttttcttttgtaaggggaaattataagaagaatagaaaattgtagaattattaactaaaaaaaattccaacatttttttaccagatcccgcacaaatggtaatttgaaaaaataaaaaagagagttggtattggtgagtggggagatttttagttatgacaatagctattaattattaaatgtttaacaactaatgtcaggtagtggactagactctttgcaagttatttcttccaattctcacagcagtcaatgaagtagttattactgattccatttaatatatatgaaaacagaggctacaagaacttgagtgagtttaccaaagtcccacagctagtcagtgacagtgctgggattctgagcccagatctgcctgattctaaactcacattttcttcactggaagttgacctacgtttgcagtcaccatgttgagtgaatgaagcaatgggttctgagatgtttctggtcacctacccactccctcctttaagcttgttcttctatacagagcatggggccccaaccccagctctgctgtctacagcactgccaagtgacccattgggctccatcttgaccaactgggcatcaagcggtgcaaaagcaaatccctctcaaagctgggagagtcacaccgtgggctactcctgcatgcagctgggtacatatctcctgggtcctatgacctgcctaaaaaaagtgagagagtggagagacagatccaggcagctcagtaactgctattactagaaaagcgtgactatgtctggccgggcgcggtggctcactcctgtaatcccagcactttgggaggccgaggcaggcagatcacaaggtcaagagatcaaggccatgctggccaacgtggcgaaacccgtctctactaaaaatacaaaaaaaatcagctgggcatggtggcgcacacatgtagtcccagctactcgggaggctgaggccagagaatcccttgaacctgggaggtggaggttgcagtgagccgagatcgcgccactgctccagcctggtgacagagcgagactccgtctcaaagaaaaaaaaaaaaaaagtgactatgtccgtaccaggttaatagaagatactcagtaaatattatcctcgctattacattatcataatcattactagctgtgaagcttttagcaatttacattaacccctcttagactcagtgtcctagtccataaaataaggttgacactactggaatgatctacgattgtcatggtgattacatgacaagataaatccatttaaatttctgggcaatttgctcattaagtgttagtaagacagagagataagtggttttctccttttgatgtgatgaaaatgagattataattatcttatagatgatggcacccatgtatttgccccacatttctactagcttcctgacaagctaggcttccccagcctcttcattctctgtatataaacagtcagcttagacctagtgctgatagaattccctttccagttctttcttataagttagaactacattcaaggctcattcctggccccctttttttccatcatgacaccttcaaatactcaagtccccactaatctctctctctctaccacataatttgacgatgatcaatttttcatttattctgttcattcaccttgttagcttattaactaattggtaaaccctttgaaaggtctatcttctcataaatcttagtacttactgcagcacctatcccagtgcctttcataaagtagaagctaaataaataactattgctggataaattaatgtaagttatctatgaagtcagccatcaatttttgtaaccaaaactggaggcaagctttagaagattgaatgtcatagttttagcactgtataaaacaaggtactgttttacgtgataaaatacaggatgaaaactcatttaaaatttagaaaagattagtttgaatccaggataaggtaagtaaaaaataattattttgaaggaagacctcacctcatactattcttgtgttaaaattatggatggtaaacttgccttcctaggaaatgtattgaggggggactcccacaaaaaggacatggccctcattaacccaaggtcatatttatgttctgatcataaatcagatcagatcaggtagcaaaagaatgtacacaatctgcatttcatttacaatcttactattttcagacaattgagacaaaatgtatcagttaaaaatatatatctcaataaatacttactgattgatatgtaaaacccagtaaaaaagatgacacatctttcctgacaattggcaaggattaatataatgagttctttatgccatagtttggtatatattttaaacattataattctttcaactataatctttatcaatgctattgaaccaagaataaaaggaatgtgaacatcaagtatgtgggtgatatggaatgggagtagaaattggcccgtgcctttatataaacctccttgtcttgatgttccagagactggcctccttagaggaggcctccttagaatttattaaattctaataaatattattatttagaaaaataaataccttctttcttagaaacatgtcaaggtagggtgctcacgtgacctaataaccttgcaaatgaatgtctataatgatagttttattattttctctttattattttaacacagaatgaatgctatttcaatatatcttcatcccttacccataaacacaaatatcccactgataataagatgtgagaaggaagtcttttaaattgatttttaaaacttaatttcttcaaataatatagtcttggggctcatcttagaggtccatgtggataggtcagaatctgtcaacattatgtctttttctcagcatttttcctaagggaagcatgctattttgtttcccttgtaattatttttgcttctttttcctgctagtgtactttaattttatttggaaatttgaggatggaaaattatgattatttagattttctaataatataaaacactttttgtgataaagactatgaattctctttgacacaaacatctgcctgtagttgaatgaagtattatttaggatagaatgtagtattcaacaggaaaagcaatttgtctaaaaaatgcttctttccttgctgcatttaccctcttgccagcttgatgtatctgcactgcctatttgttctttgttactgtcaagatagcaaatttctatctggagcagatggtgtaactgccattgttcaaatgcttcaaattcattctgctgctgggtatttttatcattaaacctctaatttagcaatattaataaattgtatctatggactattctgtctgggatgtctgaacatttgttaaatatctgaacataaaaatatatattcttttgatatcatgaaaattgtatcaaaatttatttgattatttcttaacagaaatcaatgtaaagatgtgttttattaatatgttcaaaggcatcattctctctctctatatatatatacacatatatgtgtgaatgtacacatatatatgtgtgtgtgtgtgcatgtatgtattctaagcagataaaactattgttttaaacacctagtgatcttacattttggagaggtagtaaaaaagtacgttaaatatatatgcatgtgtatatatatatatatatatagagagagagagagagagagagagatggtaggtaaatgctataaaattttagctattagtcattagttctataaatttattagttgtgtatgaatctataatagaaggtacttgtttcccttactacttcctccattacttatctcaatagaaatttaaataatcttgatgtgtgtcttcatactcttaaatagagagtttaaatttaaatctacttttaaattacaaatgtgggcctttttatctatacgttctaacagcatgcccccctcaccccatgtagaaagccatcatacttcatattttaccatcaggaaggaattagaaacaaggctaatttttttactctccaccatattttcaatactaaaatgattaaaactggagcaacaaacatttttcagttaactttatccttacagctttaaaaaacaagacaataagtgaaaatttgcagaaatattaataacttttaaacaaattatacttacatataagaattcagtaaatagaattctgcaacttatcatgatttttcagtgattattactttagaaattatttcattcactgtggtctgtaaattgtggccagccatggtggcttacacctgtaatcccagcacttcaggaggccgaggtgggcagatcacttgagctcaggagtttgagaccagcctgggcaatatggcaaaaccttgtctctaccaaaactacaaaaaattagaagggcacggtggcacatgcctgttgtcccaactactagggaggctgaggtgggaggatcccttgagcccgatgaggtagaggttgcggtgagccgagatcacattactgcattccagcctgagtgacagagtgagaccccatcttaaaaaaaaaatcagtaactaaatagaattctgcaacttatcattatttttcagtgattactgctttagaaataatttcattcagtgtaatctgtaaattgaaacaatatcccatagttggacaactgtacaatcagcaatgatcaattctaatttaacaaatgttgaacaaatcaacaactattagggtgactatatattctacttttcctaggacagtcacagtttatgcttattgcacatgtattaaatataatttttaactctcaaaagtgtccaatctggatgctaaattatatactcattctgatgcaccaaggtaaacctgtgttacatgctgatatatataaagaactataaacaaatgtcccttacctgaagaagcatacaaaacttattaatgatgcaagatatatacataaaattcttgccaaatgtgttttttattaaaagcttcaatttttggtatagccagtaaacactaaaaattcagagaagagatataaggatatggattagaatggttaaggctagtttaatggagttgctgtactaaaagacattgtgggcatgaagtcacatagttatggggatgaagacgaatatggtctacagcggatcaatcaacagtggaaatgactgaatataaagaagagtatgttaataagaataataggtaaggactcagaaattctggtctcttgtcctgctcttccactggctaactttgtatcattgagaaaattacttcttcattttgactttagtttcttgatttgtaaaatgagggattgaactggattcatccattcatcagtttttttatgatgagattactttgtgcaagacactccactaaggactatgtaaatgatttttcaagttcctttcctgctttaatttttatggtaatcacttttgtcaccaatacctccaatgatattgttgtagccagtttagaatcacgtgcttctctgtcaaagaagaatatttcttgcaggtaaatgttcccaaaccaacaaatatttgttgcattaagttgaattgaaacttttttcttgcaagtaccctttgtttcctaattggattagaaccatgttttcattccctgtgatggtaatgcaaccctagagtgataagtgactgccaggaaaagctggctttgtgtattttcagactgtgaatatagctgttatgttaacaggtaactgaggctgcagccaactcagctgggaagcatgaatgctgtgcaatggtttttttttttttttttgtccctgcttgcaaatgaaaccagtttcccatttgccctacctccccgatctaaagaatcttgctcttattcccagtgctaatcacctaacaggaaaggtcatgctccctggagtggagttatggtactgaacagcaaggaactctagcaactcaaagaagctgagttgtcttctgtgaatccagctgattcaaggctacaggcccacttcccagtgcaggttttcctattttgaagggagttggaaaagtaaccctaaaacatcagtatggattatacatcacttttgataatacacactgatgctcccttccactaactggataagttgaggatagatctagcctaaaaggaatctgatgagcaagagaaaattatttttacttctcaaatattcattctgtacttgaaaattgtggcatgataaatgtagctgtatatttatccataattaactctggagccttcttaatatatagtatatgcaaaatacaagatcaaatgcagatcatgtttaagttgatagctcattcttttatctttgtcacttgtcagaagtcagagacagatattgtgtgtgcctctacaggatatagttaaagccaggtggagtctacctctgactaatgtatgattttcacattgatattgatggtcatgaagctagcagtagggaattaaatggagagaactcaagactttatcaagacaagttgaatgaaaactaaaagtaggaaaaaataggagttataataaatgtttgatcataaatgagtgctacaaggaaagcaaataatcgtgagggtatttattttctccagattgcacttttacacacagaacacgttgtaaacgttgttaccaggggtttcctctcacttttggtgtggttagggattggcagggaaactgaagtcctttcaggaaaatattcatagtcagtaccgtttactaattttttaaaaaaataagtgaattttaagtgttaagaaatttctactagctttccacatagatctgttgacattttttaagtgtatttttttttcagaaatacataatcttgtaggtttaagcctgtaaatatacagaggcacttttaaaagtgttaaatcagagatatgaacaactgaaaactaaccaataggagctggaaatagagttgtaagcaaatggttgggaatctgtcttttcaaatatactgcatgagaaatataaatcagtctttgttttattctgccagtcatattagaatattctacaccctcaatctataaagcactcaaaactttgaaaacttctgactaaacaaggagaagtaggaagaggaaaagaaaaaagcatatggaattgcttgacaatgtgctgaaatattaagctgcagacatctctgactaagtgtatgtgtaaaataaagaccaaatttgaaagtagattatttattttgaaaatgagctcaattatttcagggtctagaagcaaacacaacgtaaacctctactcatcgtgtatgtgtgtcggtatgtgttagtgtttaattaccactgtggcaaaataagagcatgatccaaattctgtgcctcatcccagaactttcagagattattgacaccttacagagtcattgtaaaggatcaggtgcaggaaggaaaattaaaatgcaaactcacactgacgtgcagagtgagtaaccagtcttagaaaacctgaaaagccatgacattgagcaaggcaaactgggttttaaacaggcaatgggaaggcttcgttttttgcaattgaaaaaaaagcaaaattcgctaagggagagtgagtgtaaacctaaaagaaaggaagcttaattgagacctacaagatggtgggtatgtcttttttccctgaggagctatgaaacttttcagggacagaaataataagaaaatagatctgcatccattgtggttcagggtaactgactgggctctttgcctaactactaggcaactttgcttaatgtagaaagaaatgactcaggttaaacagaatgcttcgctgatttttccaaacaaacccacttaaagaatttcagaaacagggagtttcctctcagatgagctagtgaaaacctactcatgccccaaacaatgtagtaaacacaaattgagagcgagcaacaaaatagcccgagagttcaatataatgtggaaattcataatttagaaacaaagtctgtcatttttaataccttcaaacaggaatttaacaatgtctgtcactgtccatctttgaaatgcagaggtatgagatgttatataaccaagatctttaggttagcaagcatatagatcaaatatgttgtaaatggaatccttgtacaattttaaaccttcttaaagtgataatttgtaatatgtttttgaccattatgtaatacgtttatttatttatttatttatttatttatttattatttttttcttttattattatactttaagttttagggtacatgtgcacattgtgcaggttagttacatatgtatacatgtgacatgctggtgcactgcacccactagctcgtcatctagcattaggtatatctcccaatgctatccctcccccctccccccaccccaccacagtccccagagtgtgatattccccttcctgtgtccatgtgttctcattgttcaattcccacctatgagtgagaacatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggattggttccaagtctgttattgtgaataatgccgcaataaacatacatgtgcatgtgtcttgtaatacttttgtaggtttcagtaatattctacaagaagaatggataaccttaatgatctcgaatatttctggttttacttttgcttgagcagtttcataaatgaatattttacttggcacattatttttattattaaaagaaaaagggcttctcctattacaaaaagtagttctataaatattttgatcaaatttttaaactatgtgacaaaacaatgtgaaataaatatttcaaatgccatttattgatgagtaaattgtaaatattgctaaattccatttacaaattcttggaggaacttggtttttaaaggaaaacatcatgatcaatgtatggatgtgctcattaggagactcttggcctttttcagaaggttatactctgccatagtataaagaatcctggtgtgttcgggtgatattttcaatctaaaatctaggaggcaggtgctcacttgtcctcctccatgcttggaaaatgcagggaggaggccatagtggcaactgttaccatgattaatttcgttgggatagaagatggacccgctggttgtaatcaatgcattgaggactctcagatcagtgggactgtgaaattttaaactcctcaaggtagaacacagtggtaatgttttgaaatttaaagattttgaaatgcaagctacttttctcaggccatttcttctaaacaacacaacataatgtttaagccatgtgttgttcacagattataatgttgcagtgataaaatatatactccattggcaaaaataaacagcggtaaagggactgagattcttgatttttaactttgtatttaaccttgtgtaatgctgcctggaaaatttttgtaaaagtatgaatagatgtaagaagattaatatattattactgtattttacaatctttctgtccttgagtttgaagtatattacaggttaaggttaagccaggaagtaagattgctttatagaactttataactttcaaaattgacatttgaagaaattgtgctatactataatagtgaaataatagtaattacaaagtaaatataatcatcattgaaatataaattttcatacattttttgttcgacacatatttatataatacttaatatatgaaaggtattttccattcataatctatttatctttaatgataatcattttagcagtctaatactggaagtagtattttcttcaattgactgatgataacgaatcctcgaaccataaaaagtagaattggatattgtcagtctctacatctctacttaaatgtattttacattcactttaaatgaaaacaatgaaacacatatatctttaagagtgattaatgattagaaataatcaagggaggcttcttatatgacacggaatgctagttagaataaagtacacggctgggccattgggaagttgaacattaaagactttgccaatcacatcttatcatttgccacactgcaggtagagatttatccacattttgatcttataagactcaaatctcatagtacacaaaaggtgtgtgttacagagtgttttcaagctatgacataccacaatgaagcttgacagtaaatgtttaatggttggctcttttggtaacaaattgggcatatttttaaaattattgacattcatttttgcaatggcacaaacatcttttgaagacttactaaatacagggcactatgctaagtgtaatgaagacaaaagcagattctgtgcattcaagtagcttacagtctggggaatagagatttcttgaccttatttcaaaagtaggacctttctatcttatggatttgtgatacaacatctattttattgcgctgtttctccttgtttcgttctctttctttctttctttcttttccttccttccttcctgtccttccttccttcattctttccctccccctccctcctttctttctttccctccctccctttttctttcttttttctttctttccttctttctttctctctttccttctcctttctttctttcttcctttctttctttctttctttttttcttttcttttcttttcttttctttctttcatctgtgtatttcatcagtgtctacaccaggctgaagtgtagtagcacaatcgcagctcactataacctcgaactccctgtctcaagccatcctcctgcttctccttgtttcttaaacttgaataaaatgtttattcgtagtagattttctgctttagcagatgccactggattctgttgacatataaaattcacgaatagatgcatatattttctcttaaaactgttttctgcttttgcatagtccttatattttagaacatgaaatcatttacccctgtactctgttagaagctcttctgatatggtgacattgattagtatattctcatttaaaagtggagaaacagttctgtgaaatactgaacatggatttctgactagctctcatagtgagggttttcttttatgatttgattagttttcaaagtaaaaaaaaaatctatgtctttccagacttggctaggttcaagtggtcatccatataagatcaacaagggataagttgattttctttcaacacttgctttcaatattttacttttttcctcattaaaattcaaattgctctcaagagcagagaagtatgactacatttcccaacagataataatgaaaaatatcatcgagaaaagatgttatgccattttattttattttaagttccagggtacacgtgcaggatgtgcaggtttgttacataggtacacgtgtgccatggtgttttgctgcacctatcaccccatcacctaggtattaagcccagcacgcattagcatttcatcttgatgctctccctccccttacccccactccccggcaaaaagccccagtgtgtgttgttcccctccctgtgtccacgttttctcactgttcagctcccacttacaagcgagaacatgtggtgtttcattttctgttcccatgttactttgctgaagataatggcttccagctccatccatgcctctgcaaagaacatgatcttgttcctttttatggctgcacagtattccatggtgtatatgtaccacattttctttatccagtctatcattgatgggcatttgggttgattccatgtctttgctattgtgaataatgctacagtgaacatacgtaagcatgtatcttgataacagaatgatttatatttctttgggtatatacccaataatgggattgctagatcaaatggtattttgttatgccattttatcaggatgtggtcttcattcaggcagtaataaaataaagtacattaatttttatacatttttggaaatatcaaggctacatcttcatagcttaattcctattactgtgccttatatgaaaaaatatgcaatctaagaggagggaattgccataaattaaaactttgagtgtttaattaatactatgtgataccatcatatagaaagtttaaaaaacttaagcaaatattttattttgaagcttaggaatatacaagttagtatcttatatgtaacacgggtagatgccagtcagattaataagtgagacatttatttatgtttttattcattttttgatgtatttacttaggctttaggtgttgttgcttggcttttgttttgtttgtagggctgctgtacctgaatgataacatttttctagcttctgagtttgtttagaaaaatgtgtgatcttgtaatttagggcagtggattgtaattttttatagaaattagtttttaacaaattagttttttatagaaagatttcttggactgattatgaattttcagtttacaactgacacacataattgttttcttgttaacaataagctttagcccccaatgattttataattatcttccaacattttgcatattggtgttattgatgagtaaatcaagaaaaaaattcagcaatgaattttgcacaatagaatcaattttctacaaaaataacttgaaaataggagacatgatttttaaaaaggagaaacaatggtattattagtgaattaaatgtgaactttgtgatatcagattatttttgctgttttgggggttcacactttcattctatgtaagtgaagttcctagataaatgagtctttgcagattacagagcattcaaaatatattaggttggtgcaaaagtaattgctgtctttgccattactttttttttttgcaccaacataatatatgtcttattgtttgcaagagccatgaaatctaggttattgatttgtgtcttaggggaaatgggagtagcaatattgattactttgtaatctttattttgtcttctttaatatatatgttagtgtttttaatgcaaacttcttattgccataaagctttatcagccttcacatactatttatgactatgttggctttttttcaagtgaaaatatgaaccacagttaaattggatgatttaacctgggcagtatggggatagtaacagggtgggaaagagtctttgagctttgactttgtgtcctgtctggaaaatccaaattaatccgttttaacaggattaagctctcagtgtgaaagtactttgctaggaaattatcaaagcacaagttaattagaacacagagctccttgcatgggctgacagttattaattacatgttcttgggctggcttaatttcaggcaatttactgctgaaagtagtagaaacaaaaagtttctcttagtttttagtcttgtagagaaaaaacaatccctcaaactaccaactgcgaaataactgctgtataaggtataaagaagacatattttagatttaagttcttcagccagtgtttttggtcattttattcccttcactataaatgtgaattctaagtgcagttagtggaacaatttgggaacttgtgtgtttgcctaagtaaatagagtgttcaaagattgatgtagctactggtagataagtgtgagtttgccttgttttaggattagatacatttctgagaagggctgcgcacggtggctcatgcttgtaatcccagctctttgggaggcggaggcaggcgggtcacttgaggtcaggagttcgagaccagcctggccaacatggtgaaaccccatttctactaaaaatacaaacaaaattagtctggcatggtggcgcacacctgtaatcctagctactcaggaggctgaggcaggagaatcgcttgagctggggaggtggaggttgcaatgagtagagattgctccactgcagcctgggtggcagagtaagggagactccatctaaaataaataaataaataaataaataaatatatatatatatatatatatatatatatatatttctgagaagttctatgtaactatactttttttagtcatattgtaagtgcatgggaaattatttaatgagctttatgagcctcggaggttcacatcatgggattactagaaccattgcattgttcccttttaattttttctcctcatacttaaataaaattataatcttattcttaaaaattagattggtcttacctctttatggtttatcgagttggcatatcacctacttatgggatctgaacgttttggtgcttgagcctctgttgagtattacatgcctctgctaataaactaagtactgctagaggcaattattttgaggtaattattttctcaaaattgaaagtattaatgattggtggtatcatactgtggaaaataaatgaaaagtgagagcatagtaattaagttcttagttcttaatgctgagtttcttaattatggtttgtccatgtcatgatgtaagtggctgaggatgtcagggtattgcccagacatacaatgaaaagatgagtcaacagagaatgagggctcaaaaaatcaccaaagtgcattctctataaaaagcaggtggagagaaaggaatataacatttttcaggaagggattatgggcaactggaaggaaaagacacatgaaaacaatccaaaacacaagaaaaggcagcatttcatacctctattgtttgagggcagggggcagacagaatttctgagctgatggcagtaatccctattctactgagtactataaagccacttagctacaaaagagagagaatgaagtataaggaagctaaaaaaaatacgtaacattgaaaaagatgtataagtatcaagttgtgacaggaatgtaaaatatagaagaaaattgctatattaaggctcacataaggaaaaaaaagtgcctcaagaaaacagcatgaaaagatagatttatgcaggaggaattaaggaatatgagaaaatgtagtggacatgcctgaaacacagacatcagtttccctgggtagaggagggagtgattgatgggggaagtggaagaaggagagagagagagaacgtaataataaaaaaaatgagtaaatgacaaaaaattagggaagcaaactgccccagttgaaaactgatttccagaagcataaaggataaagttaaagggagaatttaagaatttagagtttaaggggaatcttggataattaattaaaatcaggcaactatgagcaacataattgaaagtaggtacatgcactgtgtgtttagtataagaatgcaaaaggcaagttgataaaaatgcaaaagattgtggtgatttatgcaagttcagggcaataaataagaaaaagacatttttatgaaaaaagataagatatggaccttttctgaatgatctttatcaatcattagataggatcattattctgaaacaagcattaaaaagttgttaaaatataagaaatctaggaaggttgatggatgattatgaataaaatggaaaaccggaaaagagaaaattagatttgtgaatattatgcaccacaagagatgagattgcctcttttctatgtgcaatcaaaaggtctaaggatttttgtacttgaacttaaaagaatttatgcacattatttatgttttcagattagctacagtatatcttaaaaccattatgggagtaaatattgagtagattaattaaagttttatatcaattcagataaatactttaaaggtttaatttattgacaaatatcatttgaaattaggtaaaatcatctaggttattaaaattatttaaagcatatttagatttttgtgatattcttagagacatctgtgatttgaccatatggctgatcattctatttttagtgcataccacagatctgttaataaaggctaaattgtctttaattttaggttcagacctatgataaatataaattaaccttacaattttttcctaatccatagaataaattttaaattgttaaaaatcacaacattatttttccttaaaaggaaaatacctctgtctttttatccagaagtacaaattttctaagatatatatgttgctaacagttgtgaggtaatatttcactctgcttttaattgcatttccttgatgattcgtgaggaacattttttcataacccttttggccatttgtatttcttcttttgagaaatgtctatgcaaatattttctcccactctgtggggtgtctcttcactctgttaatgtgcagaaactttttagtttgatgcaatctcatttgtctatttttgcttttgttgcctgtgcttttggggtcatatctaaaaaatcattgctgagacttttcccatatgttttcttccagtagttttacagtttcaagtcttacatgcaagtctttaatcgcctttaagttgatttttgtatttgatgtgaaagataagggtataatttcattacacattaattcgcatttctctggtgattagagatgatgaacattttttttcatatatctgttggccattcatatgtcttcttttgagaactatctatacaggtcatttgcccatttcattactgcatgatctcacttatatgtggaacctgaacaagtcaaactcatagaaatagagagtataatggtggttcccagaggcctgagtggggaggaaggtgaacggggaaagaacagttgttggtcgaagagtaaaaagtttcacctaggaggaatgggttctaagaatcttattgcacagcatgaggactatagttaataataatgtaatgtatatttcaaaatagctaaaagaatggattttaaatgttctccctacaaaaaaatgataagtatttgaggttctggctatactaattagcctgatatgatcattccacaatgtatacaagtatcaaaacatcacattgtatcccataaatgcatacaattattatttgtcaattaaaaataaaacttaaaaaataatttgacaacatgctttgatttacattttccagcatgaaaaatggtctttacatccaattttaaaatcacccttttaattttcctcaacttcaaatatgtataggtagtttgcttagcactgttcacttctctgtttactatatgcctactgtgggccagacactgtggcaggtgttaggaacccaaaaaagaatgttgtaatatttgttaattaattgctcctagccttgtagaggagagagatgtgcagacaaataattaaaacaaaatcgtatgaatgtaatgttagaaataagcatgaggtatacaagtaagctagaggaagaaatggttggcactatcagtgcaggcttcacagagagcatgatatctagcaggactctgtgtaatgactatgagatggccaagcataaaaagaggtcagagacattgcaggcagaggacatagcatgtgccaaaacagagatgtgtggaaacagtacagtctgtattttgctattgctattataggggagcagaaatatcatcacccatcctgtgttaatggctgtactccctgtaagaaaagacagattaataagagaaaagcatacaaatttatttaatataagtttaaaataacatgggaaacatcataaagaaacgaagacccaaataaataagtaaacctttttatttttagtgctaggtttggtgcaaaagtggatagtagtggagaagtatgattggataaaaaagtatgatctaatgtaataaaacttgagggaacttaacaaggcctatttgttcagattcccctctgtgactctgtattttcagagataagaatgttcctttcttttgggtatagggagtgcagttctcaaatgaagatcttatgacttgcttcagaggagaagggtgaggggaaagtgagaatgaccttcctgcttctgctgttttcttaaatgtcaaggtgccatgttttggaataacacgtcctggtctccatcattattgtactactacggtcttctagaaacttcctttttccattaaaagttatacaggtccaggcaccgtgactcacctctgtaatcccagcactttgggaggccgaggagggaagattgcttgagcccaggtgtttaagaccagcctaggcaacataatgaaaccccatctccacaaacaatacaaaaattagccaggcatggtggcatgtccctttaatcccagctactcaggaagctgaggtaggaggactgcttgagcccaacaggttgaggccgcagtgagccatgattgtgccactgcgctccaacctggcaacagagtgagaccttgtctcaaaaaagaaagttatgcaaattgacagattgttggtgtcatcatcattattgcttagtctgtgttaggctctagtactttaaatagtttactcccgtatatctcaatatatgtcatttttagctttaggcaaatgttcagagacatgagtgctatattagctcaggaaaattttagaagtctgtcccttaacaaatatttcaaaatcccccttttctgtattggagtatggaaactaacatgtaccaaaagtttacttttgtgataatttattgattgcctactgtacgctacatacggatactttaacgtcaacagatcttggctccaagagaacagcagtacataaatttagattcaggctttattttctcccttttgcccccaattatttcatgttttaagtattttccacatatgatcatgacaattatagtactaaatctatagtgtctaatacacttttcaagcacttgggaggattctatatttttatttgtcaaattcagcttttctcaatactatttaaatgttattcagaagatattaatagttgggagcagattttgttacatttgcctcttggctgttaatacaaacagtagtttttatttttgtgcttttttcttgatgattaattattttgataattcccaatacaatatggtacagcaggctttctttcagtacaaagaaacacagtgtttatcctactgtaaacactgttaatgcagttttctctgaagaatgctttgtgtcttctgaattgggggacaccagcaaggcttttagccataggaacataagaaattcttgtggtcacagagcaaaggtaatctttcatcttttctgtgttatttttatttttatttatttttgttgttgttgtttgtttgttttttaattttttgatggagtcttgctctgtcgcccaggctggagtgaagtggcgtgatctcggctcactgcaacctctgcctcccaggttcaagcaattctcctggctcagactcctgagtagctgggattacaggcacgcatcaccacgactggctaattttgtatttttagtagagatggggtttcaccatgttggccaggctggtaacgaactcctgacctcaagtgatccgcctgccttggcctccgaaagtgctggaattacaggtgtgagccaccgtgcccggccttttctctggttttgaagatttgtgtagcatcaccattcagtcatttctaactgaacaacaggtgaggagtaggaaacatagtttcatccgtatacagaattttgcctgacttcctatgaaacagaaatagcatgagcttgacgtttctgtctattttgacagatctggagaatgaacacaaagtggatagcataaatctctaatttgactacatttaatgtctaagtcattactttattgcaaagtaccatatgaatgaaaattaatgtttactaaacagatgaaaggaaaattcccaagtccaatttgcagatcatatagatggtaaaagaggccccagtttaatgtattaagaggattcagaaatcattctgaatatcagttgtttagttgattttaacacatcattccatgcttaagactgttcaatgcctttctatctaaactccttatcattgcatacaacatgttaataatatggtcctagggttttctccctaatctcagtctttagaaatcattttgtcacagtggttcacactcaccttaaagtcatttgtacttggtgttctctctggaacactagttttccatttcttcaaatgactagatcatcctcattcttcaagtctcatgtcatatgtgactgcttggaagagttccatcctgatcatgccatccaaactactcactcccatttcttgtgttgatctgttttatctttcacagcattattactgtatacaattttcttctttatttgttctcttctttattatctccctctttctgccccatattgtaaactcccttgtagacagttcctcatctgtcttgttcagtttgctttctattgaagtaagaataataagtaatcaaaatagctaccatccagctgctctattgaatcttaaatctagtcagggctgtcgaattgaacagtgaggtagaggctcttggaaagatttcaaagacacagtaagatgatgaaaagattagaaaataaaacctatgaagaggagaaaatggtgacatgggttgcagtattaactaccccagaataataatccattatatttgctcacttcttgcagtttacagaacacttttgcatgtatgaactccgttagtattttacatgatatctacatttatgattatccctgttttacaggcatagaaacggaggctaggggaatttaactgacttgttcaaagacagatagttataagttattatttatgttttctcagttctaaggccaatattttttccatgacactacttttggtttagtcttcaaagcaaataatttaatttggatgtgatgaacaaagatgtttaatattagggattataaattctgataagttatcccagttgttcccagataaatttggaattccttttgaatagatattcatctgtctggtatggtttggaagagggtagagggtatggctagagggtaagagactacttagatattgtctcttcaagctttaaaatcctataatcttttggctaagtttttgactttcaaaattaatcatttcaaatttacttaacatttaaaatttgatcaaatgataccaccctttgagccttctatcacaactggacttggctctaggatgtgctcattgcatgggctgtgtatagtattattcaatacccagagcatgcagtgtgaacataatagagattgaaagacagccagaagggtaaaacatgaattcttaaagagtaattttgtacttcatgtagatttttttaactctccattttcagctgtttactaactatgcttccaaattctattccacaactgaaattttaaactcacaacttaaatttgcatgttgcttctattataatacattttttattcctcttttatttacattaaaaatttactgaaatttcacatgaatagtcaaagttagctttcagtagcagttagaagcattcttttaatagaactataaaaatacatttggaagaacattattatgatctttcatcatgttgaaatttcttttgatgacacatcagatgctatttacagatgataattgaaatctccatagtataattttacctcatgatgatatcagtgaacatatcatcttgtgatcagctaactggatgtttctttaacccatttatttaaaatttcacataatttccaggtgttttcttttataatgagaatctgttacttcaacaattctaagtagatcatatgtctttgatttgaaataggaaaaaaaatttcctagactgttagaatgattttgtttggttggaaagctgcgtgatctctgcatataattccaagtataaaatgtacttgatgcagtcctgactatattccttataattagaaaatttatttttattttttgcgtctccttgcttgtatcaggaaccaaaactaaacttagtcacctaatagccaaatatttagaagtacttgttaagaggcctagtccaaaacatgaataagaaatgttataagtggaagaaaaataacagaagttcacttaagtgagaatataaatggaatagaggtgggaaatggatttatatagaaagaaacattttaatacatgctgattagaaatattgcggcattttctgaaatattatcaaactgaaaattatggtctaatagttttaaagaaaatatcataacatattcaacacattgtgtttctccatgcctggcatatagcaggtcctcaataagtatttgttgaaagaataaataaaccaacaagtcttatttgagcacctgttatgtggaggatacaatcctacgacccagacagaccttatgatctagtatgggagagaagaaatataaggagaatgcacaagtgatcgccatatctgaaagtctgtgataagaattaaagaattggaaaaggttagaggaaggccagattatttctcatctgggaaacttttggggagaaaagaggacttgagcttgggatttagtaagaatcaagtgcacaaaagtatttattgtagaaatttgagcgaatatataaatattattaaatcattattattataagacagtcaataaactaaaacaagaattatatcatcaataaatcttgttataatcatccattcttaacttcatttgcacattacattgatataatatgaaatagtctaggttcctgcaagcctctttgtcacttagctttttttttctttactacgttatataatttataggcagcatatccaaaatgtttcagtaattactctgcccatcattttattctttgggttaaatttctagcctaagttattaaaaattaatttaaataatgaaaataacttcagttatgtctaatttaaaaattcctattaaatatgtcaaataatagtttatttatttttaacctttttcttcctgagaagatcaaagatcttagcatatttctttctatttcctcctaggacatctttgtgaggagtagttggtatcaggaaaagttaatttcatcaggttagggagagtgttaggagaaaagcaaactgattgtcccacccaaaatatttatgcctgtcttgtaagtgatatgcagatcactttgactctaagctagttttctcatccccttttcatgcaacttgcttcttactgactttgccatttatcagacagaaccttattatgtgcattctcctcctattttccctcctctccctcctgtttctccttgttcatctttcttctttattaagtgtacaaggattatgcaggctttgttcaccattctatatctagctacaaacactttctatagggttgaattggaatccatataaatgtttgctgaataaagtaatagccacccgctttggaaaagtcagcccatttaaatatactaatctaagaaaatcagtataggaagattaatctgacttctgaatgtacatagtgcatactaaaataaaatgtggtcagcttttattttattcactcttttgcaatatttctgctactacgctgcagaaccttgtctgtctcatactccttcagcacttattaggtgtgtaatcttgagccagtgaattaaccttcctgagcctttagatataatacgagactaataatatcttgtctatctgaagacagtaaaatggattagaaagtctattgatccaacttatgataaatgaagatgtgaataaaatttttaaaaattgatttatgaaaattatactgttttctgctctttgcttattagttactgtaactaattcctcatgagattccaaaaccccttaacttaaaaaacaataaaataatagatgtatgtgtgtatatgtgtatatatgtatatatactcatatatatataacatatatatcatatatataattttttcgctaaaaactcatggtacctacctagtaatggtgattattatcatcagttagaagtgtgtaattcatgaaatttctaaaaacaaattcaaatcaaaagctttggtatgcatatttaatgatatattttgaagagttaaagcttacgtaaccatcaccagtgtcctttcaattgccataattgtagaataattttttattggttggctgtttttcttttttttttactggcactgaaactttaccccacattgttcttttattcattaactaaagttgtaccctaatacttggttctgtactaggagctgcagatacagcaatgaataagacacaatccctcccttcaaagagataacattttattgggagaagtaggcaatagagcagacaattaatatactgtgttgaagtgctatagcaagaatgagctcaggatacattgtgaacacatgaaagttctccgaacccagctagaaggtagaggagtcagtcagggaaagcttcctagaggaggtgatgtcagtattgtatttctcctgcctatacatgtccttcccaaggaggttgaaatgcaaattatttaaacatttagtatctaagtgagatatacagtaaaaatttatcatttggttatactggctacttaatgtttagtactaaatgaaactacaaaacacattaccaggactagaggtggggtagaaaagaaaaaaaaaaaaagccataccaagaatgaagaggcagttttcacaaacctgccaagtaaagaataaggtatgattaggaatcagatgcttactagtagacttcctggagactaagaatcagaaggctgaatggaatttaggtgacaatgctgaagatttttctaagagggtgatgtatttaggttaagtaacaaacatgacagttaatttgagttgtgtgctttaggttgttcatagaactgagaaactgggatcagaccaagttaccatggcactatttctgttttaaatggtctggtaaaccacctgtctaatctattaatcaaaatgtgctgatatgttgtagtgattaccttattatctattcctaataatactcctacaatgtgttttcagcccatattggagtatggctaatgcactatgttaatattcttttgctagatatgttcattttaaagttgtcaattactttttgttgttcctcaagttcttgtgtatttttggcacatgccatttaagtgtatttttttactatattttatgaaaataattttacagctacctcatgtatcagcccaaaatgttagtaaatgacttgtcttcctacaactctggatgagatatatctatatctgccttttaggggctggtggggctacacactgtagaattcttttctacctcttaaattccattggcttgattggattccttcggaacatattataccttcttgagttttgtgtaaaactctacccttctgattttacctgttaattaagtttacaagaatgacttgctgaatcatggcacatttattttgattattcccatcctggctttcttcatatttccattatcatttcaaatatgcatttaatttttgcttgcatggtaatttcagccaacttaccttcatttaggtcagtttgtacaagaaaattaattatcttattgtttcatccactggattgatttctgctactgtatatacaagccaatagtttgttcttttcttttggtgccttctgtaaaactggggaccattgtcaattaattgatggctcacagatttctttctgacctctattaccttttctgaacttcttgtatcacagaatcacctatcattttattgtgttcactttgttggcttagatgatttattgtctcactactaattatataactagggaaattagagatggaaagattaatgtaatcttccaacttctttttgtgctgtctgcacttatatttttcttagagtattgcttcaacatgaagaaaaagaatgctcatttaatcacccatccatccaatttttaatttattttttaactctcagtacaatacttcacacaaagttggttacaaatgaacgaatatatcaatttgtttcttaatgcaataaaagtcctgctttcaaggagtcaggttctgcttttgctttacctataactctctatagtctaaaaaggaaggagaaatggagtgagaaacagaaatagagagtttttaatccagagagacagagagtctttttaaatgcagtattgcttagaaagagcttactaaggtaaactcaagtctcaggtaatttttttttctggaataggttttattttgtgcaaaaattgtcaaatataaaagtagtttatgtctgaatttgccatcgattatcatagactttacacagaaaccttctcatggaagatgaatgaatttttctgaaatcacttttaaatgtagccaatttgtatcagatcctataacatgaatgttaacactgaagatttcatttcacttcaatcttagccaaaagacatattgacctagaaaaggacatatgtgaaaaaaaaactaaaaatattaaatatgcttgcatcatgtctaacttggcaaagcaaatgtataatttatcttagaaataaatattatataacagagtaataaataatgtttacagtgggaagcagtcttatcttcaaaaacaacttttctagttgtgattataaaacaatcttgcaaataaagaagtgcagctcaatgaaatgtaaaagcatgccacttcaacataatttagctagttgctttatcttgacacatttcttgattttcatgatattagtgtaaaatataaatattttcatacattttccataacccgattgctctttctttccaaaataatgatgaaatggaacaagaaaaaattgtctcccagcaaatatttagacatgtgacattttgtgtttttaaaggtcattgatattttagggtatttatcttaactacttaatatttttaattgcttgaattgccttcagaaggtgactacttttctatttggttgcatacatggaacccacaataataatatgtatgaaaattttcctctttataaataattcatgcaaattcaacaatacaccctgaaaagtaaatatttatcacctgcgtgtaatatggaaaacatttagtgttattaagaagtaaccgattgcaatgaatagaagaaatctgttttaatgtggtaagtctacctcccttaagatacagtttgtctagggcagctgtgaatttgttcctatacttcatggcccacctaatcaaattcttcaagagaggtaattatctttttattctcatttttttatatatattttttattatgctttaagttttagggtacttgtgcacaacgtgcaggttagttacatatgtattattctcatttttttaaggttcacaacttccatgatggaaatagattattagtaactataactcctgaagaacaagccaatattttgttgttgttgtttttctgtgtcttctgtaaaactattaatctcggtcaattaatttatggtttgggaggcagtcagtcatgtcatgaagacctaatctatctagaataaaaaaacaagatgcccaggcttaaaatttctttgttacaatataatagcatttctgtaaatagtaattttatttttagaggaagagtaaaacaattttttttgtttgtttgtttgttttggtttctccatgatccttgcattagattttacatttaatttaacttattttaatttttatctacatttgctcttgttaataaatacttttaaacaagtacaacaaataaaattccagaattgatcacttttattattgcaaaagataatctttcatcttgaatatttatgaattatcatattcccttctaacaaggatagcaatgacagtttctaatcctaaatgactgatacaattaattaacctgtgaaatataaaatgctaaaggaacaagtcaagagaatatatagaagtatgaaatccaaactaaaattgtttttatcttttagtttggaaatatacaggaaattgctgagttctgtctctatcaccagatagccaaagtagaattttagtatgtgctcatggaatggtgggtggatcgatgaagattatcaggaatattggagggtttctattttatctcttgtggtatggcataaatggtgaagcattaaggtatgaaaatgtctaccttgtactctcccatagtaaatatgataagctatgaaatcttgaagtggaaatatccacaactctacagaaatataaataattgaataagcagataaaggggggagaggagggataactctgccatacagaaaaattccagtttataaatgtggacacaattagggaaatacaaaatcatcatcaggcaaacacacagtaaccattgttgtttcaggccaagtccactaatatgtgctaaaataaggggggcaaaagttttaggataaacagggtattaacatagtttcaaaatatctccctcaagttatctatttggttactgtattagtttgttctcatgctgctaataaagacaaacccaagactgggtaatttataaaggagagaggtttaattgactcagttccacatggctggggaggcctcaggaaacttacaatcatggtggaaagggaagcaaacatgtccttcttcacgtgctggcaggagagagaagtgcagagcgaaaaggggaaaagccccttaaaaaactatcagatcttgtgagaactcactcactatcacgagaacagcaacatgggggtaactacccctatgattcagttacctcccaccggatccctcccacaacacagggattatgggaactacaattcaagatgagatttgggtagggatacagacaaaccatatcaattacaaagaggctaatgtagcatcatagaagaataatcagcagacttcactttaaccaagtaatcaaggttataacatagtgacagtttttatgctcatcccatctcctcaccatcatataatgcattgagaagaacacagcatcacttctgtagtattcttgcccctgcaaaaaagaataacttcagtctaatcatcagacaaacccaaactgaaacattatacaaaataattggccagtactcattaaaaaatcaaggttatgaaatacaagggaaggctgccaaactgtcaaacgttggaagagattaaggagaaacaacaactaactacaatataggacagctatatacaatatagtcaacattcaggagaaacaacaactaaatacaatatagtcaatatattgtaatatattgactagaaatataatataggatcctggaatgaatactggactagaaaaaaaactgatgaaattcaagtgaggtttatagtttagttgatagttatcttccaatgataatttcctcattttgatcatttgtttatgattatataagatacttggggaactgagtgaagagtgtacaggtactctccaccatttttacaatttttctctaagtccaaaattattttaaaataagaagtaaataagcaaacaaacaaaaaggcagaaatactgtctgcaccttccatgacacaggctttatcaagtgatatgatgaatttggatgttatatagataagaagtgaatttacacatgtagtaaaatcggtgtatctatttaatggactttttaaccacatgtcggtatctttaacgccacagatatacagtgagatcataataaccagtatgtcagcttgaagaataggaacatatagttttatcttctaagattcaaattattattcatgatttgtttaaagcaaatcaaggctgagtttgtaactctggaatttttaacttacagattctcttactcattcctgtcttccaaacataaaacatttttatttccctgtcaattcattattaggagaaacaagaatcttgaaaaagtctttcctatgcatccagcaataaatgtattctactccaccatggactgtttattgactttattacaagtccattatctgttttcatttttacttctccaaaattgctaattagaacacaacacaaccatttgcatccatagaaactttgcgtttacacgattatctctaaatggtattatttccattgagttgtatttctttgtgactttccaatccatattttactaattcattttgtgcataaaattgcacatgatttttaaattactattactacattttactttattttaaacttaacctttaatattgcacactgagaatccttataatagatttgaagtacaatgccctttttaggatttctatgtgtttgaaattacatgtatcagtgaataaggtatactgtcaaatacttaataccttaagaagtcattaatgttaccaaattatagtgaatggtgctatattatattttgaacgtttgtggcctctaaaccggtagcaagtctcttttagataattttgtaaaccccaaagttgtgtattctatttaagattatttatacactcatgtattgattgagatatctctgcaaatatggttcatttaggatggatcttgttagttattagaagttaatagtcaaataagtattcccctcccctaagcttccaggctaactcatgtctccctaactttggccacaggcccaagcaagcatctatttttaaagtgaccctggaagtatgtttcttgccttcggaagtagagtgatgcattatctggtttgagtggaaaagttggccgggcgcggtggcccacgcctgtaatcccagcactttgggaggccgagaagggtggatcacaaggtcaggagatcgagaccatcctggctaacacagtgaaaccccgtctctactaaaaataccgccgtggtggtgggcgcctctagtcccagctactcgggaggctgaggccacgtaaatacacaataattgttttgctaattagtttgaacactatgaatgaatttgtaaaaaaaaaaaacctataatatccaataaaccattccaaaaaggaacacgttttaagggaaatgattgtatatatgttatgaggtaaaatttatttttactccagaatgtcagctagtaatgacacctggctaattttcgtatttttagtagagatggggtttcaccatgttggccaggctggtctcaaactcctgacctcaagtgatccacctgcgtcagcctcccaaagtgctgggattacagccctgagccaccgtgcctggcctggaaatctataaataattattttggcacctatccatctgcattctgacctccttttggcgtccagagatctcaaatccttgagcatttcagggaccactactgtgtaatacccaactgtggttttgttcttgactttcatttaaatctgccatgaaaacacacataacaagcaagtcttacgtttcctaggtcccactattttaaggtttaatttgcaaattaacttccaaagctatattattctacttgttagccctttcaaatagaatcttgctgccaactggttagccatttcaaagtctttaaacatgtgcaatacatttgtatgtattacacagtcaatatgttatttcattctacattgattgctctctattggcaattgtctttttatttggggctaaaacaaatgctgaagtaaaataatggcagagtttttcaatattcggtaggaatacaaaatgaaaaggctgccttttttaaataaccaatcgcttaagtacttcatgtaatacttcttaatttcacacttataagagaatgtttatacaggtatagggttactgaatatttcacttaatttttttataatgatattattattataaaattacatggtgtttcttttactggaagaaactataaaattcagtaaactcctctaaacttcaggtaatttctttcatatgcaaatacattcacaactttaaatctatttgaagtaatttagttctacagtatgttgtgtttctctgtttacctaccaacacacacacaccaagatgcagatcacaaacacagaaaaagaaattgttcccttgatttaggacttgaaatataatcaagccttaagatgaataaattatttgaaaatatcctctaggtatttgcacatataatatatcccaagggttttacaatacaatgaaatatactttttttctaaatgactgtgcagacacatgcagaatccattatgcattaaagggaccaataacttctcctttcactgataataattcatgtagtgttataaacaatgctaatcttgccaggagatggcttcttattcattttgaaattatcagtgaatcagacaatatatctatttcatgttgtaaataaatgaggaaacatagagtaaggggaaaaataatcctaaaataaaatgtatacaatagtattgcccttgattttaaagtacttgtgtaagtaacagaaaatcatgatgtctaatgtaaatgtcccaagttttagaagagtggctaaatccattgacagagtactcaatgctgtataacagagaaagaaataggtgtatttaggtgtattattgtaaacaggtgtatttttataagtaacgtgctaatcatggatttgcttgatggaatctattccaaagaacccaacttagttcttgaagtgccataggtctcaccttcccaattagattgtaagctctccttcatcaactattacctctttttttttgtttgtttgtatctcccatagtacctagaactgtactgattcttaatcagtagtcaacaattgcctatagaacctaatgaaatacttagtgtattcgttccagcaacatgttcagcactgtttcattgaggagaggggataataagcaggatggtatgataggaaatatgcattgacctggatttttaaatgaaaaatgaaataaattaaaatattaaaacttaaatgttaaaaatctctatataggattatagtcacatgacttatgaagctttgagcaaaaatatgccaagaaggaaatcataactaactggcatttattcttgcaaagtaaaaaattaaaaagctttcaaacaaacaaaaaccaaatacacacttgataaaaattatttttatctccctataaaggtttttgttttacttttgtttttggtggattgattttatatgatgctaagagctctgaaacagcagggctgttttccaaatttagcccccactaagtgagggaaatgcatttccaactctatgtttgcttttaattatttatttaccaggttgccctttctccagaggtagtaaatccacttaccttttatgcatttttgtctcttgaactgaaagtataggtaggatctttgtctcagcaagaagaggaaatagactagactgcgggggtgagggcagtgcaggcaatctcgtaatgtgttaatagtaaccagcaggaataattctgactagatcatttccactaaatagtttagtttgtgaagaagactgacaggatcatttccactaaatagtttagtttgtgaagaagactgacaggagtgaaggctcagaagattatttggaaaagaccagtgctttgcatctggtgaaagtcccagcaaatcatggtatcagtgaggactatactaggtgtctctttttccatctgacatatacccgtgcaaagttttaagattcagcagtaaagcttttattctcctaccacaatcactatggctgccactggttgtgaaaatcacctcattttattgtttttttcttcaacttttatttttaagctctagggtacatgtgcaggatttgcaagtttgttacatatgcaaatatgtgctatggtggtttgccgcatagatcaacccatcacctaggtattaagcccagcatgcactagctattcttcctgatgctttccctcctccttccccacctccagactccagtgtgtgttgtttccacccatgtgtccatgtgttctcatctttcagctcccacttataagtgagaacatgcagtgttttggttttctgtatctgcattagtttgctgaggataacggcttcaagctccatccatgtccctgccaagaacatgatctcattcctttttatggcttcatagtattccatggtgtctatgtaccacatttgctttatctagtctatcattgacgggcatttatgttgattccatgtctttgctattatggatagtgctacagcagacatatgtgtgcatgtgtctttataatagaacaatctgtattcatttgggtatatacccagtaatgggattgctgggccaaaggggatttctgtccctaggcctttgaggaattgccacactgtcttccacaatgactgaactaattaacattcccaccagcagaatcactttatccaagtgcttcaagctgttctgtaacttaaggtggaattttcgacaatgtcaaaattactcagtttcatactgttgatgttcatgtaaatttttggttaattttttaacagcttgtttgagatatcaaaagacagaattataactaatttagttctagatctaattgactttccttctcattcatgtatcgcaaatagaacaagcactcccactgtgcaatggcagaacagtgagtttcataagggggtacaaggtaacagaacaatagaaaaaaaactgattggttaacgtcagcttgcttcaggttacttttttttggtaagggtttaagcagaggagacctccttattacactgactcaggtaggattggaagtatcctgttttcaggaaaaactgatctgtttcaggatctgtctgcttccttagagtttcagtttgattatttggcctttggcatgattgcctccatttttgttcgatctgctctttagggccaactgtagtagctaaatccaaaacaatggactggcataatttttgtttaacagagttataatttaaatacagttggcccttgaacaacgtgggtgttcagggtaatgaaccctgtgcagttgaaaatctgcatataacttttgacatcacaaaaccttaactactaatagcctattgtgaagagttactgatattataaacagttgattaacaaatgttttctatgttatatgtattatgtactggattcttacaataaagtaagctagggaaaagaaaatgttattaagaaaatcataaggaaaagaaaatatatttgctattcattaagtggaagtggatcgtcataaaggtcttcattctcatcatcttttcattgagtgggctgaggaggaggaggaagagaaggagttggtctcgctgtctcaggggtggcagaggtagaaacagtggaggaagtggaaggggaggcaggaacacttggtgtaactttttctgaaacaaaatctgtgcataagtggacttgagcagttcaaacccatgttattcaaggatcaactgtatttggttagttgctgatatgtcttctttttcgcaggtatacccttgtaggaaattaaagcccactttctccattattatctctttaagagaggtttttcttcttaaaatttattttttatctctctgatatgatactgcctctcttccatctttatcatttgcaaccaaattatatctagaaccagaacctgtttatgaaaagatgtgccttctcacttcgtgctgctgaagaaagatccacagtgatagtagagaaagcaacatattagctgctaaaaagattgcaaacataaactacaattgtaaattttgaagtcaactatgttctgagcttgatttctttgcttcaactgtctgtatgaaatggaataaatacagctaaccaaccttcagggatagttttgaggaatgttgtgaaaaataataaggtgcaatcgtcacaaaaataattttctagaaaaactgaattgaaaatcaacctgagtatttaagatacagttttaaaaaactatgagaacaacctttctttctaaaacttaattcttatttttctttatgattatctaattttgtcatattaatgttgtcaaggtgccatattatgtacaatgaatagagaacttgagttctgagcaaaagttacattttagattttgtaataacattgagaagattcaagataatgagctttgtgtttggttatttatgtaagtagttgaacactcacttttttttctttcttgacttgatttttaaggccatttatattagatcttccctaattcatacatatgacttttttcttttaggtataatccattgtatagtcacttttaagatgttttgaaaattaaaaatattttaaattcaataaatagcaatattggatctttaaattcaatagggaaatctcaggaaatgtactgtaagttacttccctatgcttgtcttgaataatcttttaattttatttttagttaaaaaattacttagcaactgtagcagtgacataggtaacagaactgccttacaaacaaccttgcattatattcattttctactatattttttaacatcctgtagtctatgaattatcagaatcattgacctcttaatcatttgtttgcttcttgaattttaagggaactctgggcactatcaaaatgagggaaacataatatcacattctaaggaccttactatattcaaacctataagcaacaaatttaagtactagattataggctaatcttaaaaactattttttatagtatcagttgtttttttaacaaaaaataccttagagaaaaacaataaaaattaattatttatgcagagctctaattttgttctctgtaacaggatgcttggtttctgtcttattgtttccctgagacatcaaaaacaggacttaaataaattttcgaaaagagggtttctatagttacgtgtttttgtttgttttttagtattgggtactagatacattacgtacttgtaatctgacataaacaatttaattatcattagcttattgtatctttgctgttgatcaactcaacactcaaagcttactcttcgctaccagtgtcttacaaaatatgtactgactatattttgagaagcctaaaataaatgacaaaagtactaatttgctgaactttggaagtgtatgagaatgtttaagcgatttatgacatgttgaggctatggaaggtagaatggaagatgtggaactgggtgacattgaagtaacatgtaaaatgatttctaggaagccaaggaactaaattgtactcaactagtttttcctgtgagcccagattgtgcacagaccctcttccaaacgtgtttcacaaatccaaggcagttatagaagaagtaagaatgtgtgtcctgattatgagccagaaacatgacctttactgaaaggcaatgatatatttattaactatttaaacatttctagaaatctacagactcatttaatgcttgcattaaagttattttaacaaaatccacttacatactttcttcttatgtatggtaaaaattactttcctctaaacatggtaaaaattatcacctgtatctgcccatgtcttggaagagaaagtacatacaaaaaaatctgtttcattgatattgaaggacaatatatgtatgtatctacaacacaaatatacctttgatttactaagccaagtaagaaatggaagtgtttgggtataatagactctcaatgacaagtcctgccactttttctttcttagcacgtcttcctttgtagactatattgtttctaaagtgagactatttatgagtttatcctcctagcatagatgcctgatctgttctccttttagcttgaaactatttcagtaagagctttacacaataggcttgagggcactttaagaacatgtcttaagaatatttgaaattaatgactaatcatcccaattcaataggacaaatattctgatctacatttgtgcatcacccacacatttttgttttaaaatttttatttagctcttagagatgctgtgagggaagccatcctccaaagctccaaaattctataattatttttaaaattgtatttatggctaggtataaattcaagataagtgggtgtagaacctgaaaaagcatagatggggaagtaaaaataggtattacagtatgtgccccaataagtaaactctactccatatattatcctcttgcatattctttaaatctggtgttaccaaaatgggaaccaagaattattttttttacctgtaatatttcataaacatgctcttacataaccctcctgctttggaggatctaaagcacaaaatggaagagagattatatagccacagtttttccttgggattattaggtatttcaagtaagtgttagatacttagggccaaaaattaacttctacttcaactaaaatgtgtgcgtatgtaaataatataatatatacaatgtaatatatataacatgtgtatatagttaagattatttttgaaataagtgacttttgtaggatggtggcactgttgacataccaaggcaggaatagatactttctttcaaatgatttacagaggtcaaaagtaaaggtacatgtgttatacaatactgtctatgatatatgttctacacttgtgtcagttttttttttatacaggggagaataggactaattagtctttttcattgcattttctatcaacaggttcttttctaaagttcatgtagtaagtaatatgtcatagaaactgaaaaaaggatagcaatcataggctggcttttatcttaccaattaatctaagaaccatatacacacaataattcgctggtaataagttaaagttttctcagaatgtgaagtattactttaattcgatgagcagattggtacattagagctttttcattggagaagaaaaacttcataaagcctaattcccttttgatttatataacagtacccaaactcttactgagcccccttcgtctattacttagaattgtgatgatcatatgaattgggaatcatttaattgagcataataatcatcaggcaagccagtgaaccaggttgttgaacaaattaagcttattaccattaagagtggtggcacgtgcctgtaatcccaactactcaggaggctgaggcaggaaaatcacttggaccagggagtccgaggttgcagtgagccgagatcgcgccactgcactccagcctggcgacacagcgagactccgtctctcacttctatcttttaagcactaagttaaaagagtacttttacacaataaactaggggtgttttatacttacaacagctaacattcattagacattatgtatccagcattattctaagagtattgtatgcatttttcactgtctccatacaacaactatttacaataagttttgttcataacctcatttaaaagatgagaaaacaatcatagagaagttaaataattggactcagatcacacagcttaaaagtagcaatgctgccagacgtggtggttcacacctctataatcctagcactttgggaggccaaggcggggggttcacttgaagtgaggagtttgagaccagcctggccaacatggtgaaaccctgtctctacaaaaatacagaaattagctgggcaagggcttacttggccgggctcagtggctcacgcctgtaatcccagcactttgggaggccgaggcaggtggatcatccaaagtcaggagttcaaaatcagcctggccaacatggtgaaacctcgtctctactaaaaatacaaaaaaattagctgggtgtggtggcaggtgcctgtaatcccagctacttgggaggctgaggcaggagaattacttgaacgtgggaggcagaggttgcaatgaacctagatcgcgccactgtactacagcttgagcaacagagtgatactctgtctcaaaaaaaaaaaaaaaaaagcaattctgaggcaactcctttagcaatttactgcataaagttttctatttttgtcctcagaaaatcgtcttttatgtatttggtctttattaactatgtaaccattatattgacatttggccaaatgcaaaatgcattcttatcctgaaataagcaattaaaaatgaattgatatttttaggcaagcctagcatgtagcaacacactttttatggttttgctaatctgatagtgtaagttcaatgtttataatgaagatgtatttaccaaaactcaaatttatgcaatatattaaatttatcattaaatgtataaatttttgacagatagattattaatatcctctatatgcaaacccatagactattatcacgagttagccatgtgtttgcctttaggcagtttgcccgaataaaaaatattcaagagcaaattttttttaattttaactatagtagtgttttataattaatgtacgagtttagctgaagaaaagacctgaataaagaatagacttaaagttcattcgtatttaagttactggctattgtcactgaattatctattcttggttttatgaataggcatggaaatcatgaactggactcatcatcacacttatgtcatttatttgatttgtgaaacattttggatcaataattttaattaatatatatctaatgtgtttccattttgtaaaacaatttctttacagttcttaacacattgagggagaaatcaaacagattaacattcaaattttcatgtatgaccattggtaaacacagaacagaaggaaaacatcccaaaatgttttttctaccaaaattatggatgactctttacaaataaatttcagcagttttagataaatttaaatgaatattgaattaaaatggcaaaagcaattaaatagaaatatagttatatgccttgttttcagatcccagatgcctgatctccagattacgtgaaaattattattaatctcaatgacaaatattgaaatgagcattttgctatgttactgataggttgcagtttttaatcaatagattgaaaaactcacaagatttggatttgtaacacgttgctgcaagatttgggtttgacatttgctttaacgtttaattcaattatttttacatttccactgagattgacttgtataacaacatggtgtttatttcaattgttaagttgatctgtgatggcttcgaaaatatgtaatgttccttaatgtataaatgttttaaaatactataaaacttgcagaatatttcttttaccattagcattattatactgtaatcattcacattattgatgtggactattatttttaagaaattggtattcacagtaataggctgaggcattagcattattcatagtcagaagttcattggaaagtaaaattaaatattcaaataccttataatattttctttaaaaatagcaatagttgtattcactcgcaacatacttgagcatgagtctaatatgcacttgtcatagagcctgttcatagaaaaatgaataataacagtacccaaacatttgtcttctccttctttctcaatcatggaaatgaaaaaggtcactactatttatattaatatgtatcagaaaccgttgggcttctgctagatacaagcaaataaatataaacaagaagaatagcagatcctgagcatttgcctttataagagagaagtgctaaatctgaaaagtagagtaacttggactataaaattaaagtttatctgaaatgtggtgtataatcatattttaacctcatctctgctaaaaaggtaaattaaaaattacatgggtatggtgaaacatgcctgtagtcccagtgactctggaggctgaggtagaagagtcgcttgagcccaggagttaaaagtggcagtgagctatgatcgcacccctgcactccagcctgggtgacaatgagactgagtctcaaaaaaaaaatcgtatttcacaccacttagataaaatcatataaatatttcaatatcactcctggattaaataaaatcatatgtaaacatttacttaagctaaattattttttaaaggggtatgctatctataagacttgggcaatttacttagtttccctgtaaaatggaatattctttacctataaaatgggtattccttacctttgatatgagagttaaatggaatagtgtaattatatacctagctgtaaaatagctatagctaattctccattaaaaatattcacttgtacacatgcacacaaccaattaagacttcaaattaaggcatgtatacattctgtagagtttcaaatataactttggaaaatacagcagccatatttacttatatgttaatatgcagatattgagattattagattatgttacaatatgctgttcataactgagttgtttagtcaatgtttcctacttttttattgttaaaacagcacagctatgaagtgcagttatcttaatttagctataactaagactaatgtggatctggaggctcatctaattgcaccctcaagatcaacaggatttagttaaatctcatcttccccatgtgtagctggaccttaacattctatgattcttcattaatcagccaatttttttcagggcaaaggctgcttctcagttgtcaaatagacaaacttgaaagctatatgataactcttaagattgtcaaacaattatagttggccgaaagcagtaatacactctgtctcacttttgggacctgaattatctaaaagttaactttagtttggaatgaactttaattaattccaggaaacaaaaaccagtaagaagcaaattatttcaccaagttattacattcattttttatgattatcttcaatggatttgatggtaagaatgtgaattaataaattagatgtatatgatattaagctaaactaacctagattttcagtaagagattaagaaatctaaggtcattatgattcaacctttccttccctataaactttcagaaaaccctctttgctactctctcttctcgggatcttcatctccaagggaggggattccaataaaatcagaaaagaaaaaaggcttatattatttggcatttgatattcttaaatcctactgttcttattacagtagatctggcatcatatggtaatgaggttttattttaaatgaaaatcctcaagactaagtagaaaaacatggacacaaaattatgtatttgatttcaggtatgtgaaaatatgtatgagattgacagtagttatatatgggggttagcatcacctggaactttttaaaactattttttttcatttttcaaactttgtacaatgaacatgtatgttatttatgagcaatgcaattaagtgatattttaaaacattgtggaaactttttttgctatagactgaaactcaaaattctacttctataactaaaatcttcagtctgtaaatttctgaaaatacattaataatatataatatcataatatattctaataagaaagcacatcagacactgtctgtttcaaggctgtgcttgatgaacctttgaacttatagcttgttatggagagtagagaagagaatggctgtgttctcagcagttgtgtttttccaaagaccatgcctcaaggcaatgcaggggcaccttttaactcatgaacaaatgtgtttgttgattaaacgtccagactcagtaatcacagcccagcagagagcttcgtgacatatctttccacctatttcatagtctagttttctaggatattctcctgagaaaatctttaggaaaaaaagtgaatgacatatggttcattctatgtagtgtctgaaggtctgtttctatagcaacaattaacaggctaaatgttaggatttgaaacattctatagctaccattgcttatgttaacaacaaactttagggaaacttctgaccttatagtagtgactttgaaagagtgaattgttttcaagaatttattttttttctaaatctgcagtagtcaggatataaaggagaaatgtgtcttctggcgccccttttcctatctgcttctctacttcagatgtttatttttgtatttctgctcatatcctcccaaattgtaaatatgaaactttgaaacattataattatgatacgtaatcagggccaatcaatgcccttaagtcaaaatgcatagcatgatgagatactttatattgcatagtgtcttaaaaaattataacatctattatttcatttaagcctcccaataatcccttcaagtacataagacaggtattatagtcactcaatagatgggtatgtaagttatggttgagtgtcttccctaagatgtattaaaagcagaggcagttttagaatccatgttttctgcctctaaactctatactgtctccagatagttttcttgatactgtattcattattatggtctaggaagttgatgaatcttaaattcaattcatagtttcacatcatgtgttcacaattccaaaatcatatttatctaaacttcgaagaaatacggaagtatagttaatatgattagagctaaatgtctcaggcactgggccagttgctaccttttgcttctacattgtgtctacaaaacaagcaaactaaaatatctgtaaatattacattaacattttcttcaacatagatgtattattaaaaatctagtggcataattataagacaactgtcatactcagcagcaaatgttctacattatttaatacatcttcaatgagccaggtcagagggtggtatgcatacggtagaagtgcaaaaatattccttcttataaaaatagacaaaaaaacccaacacaatccaacttggttaattggaacagcatggcaaaaagagatttgattaagccctttttacttttaatttcaactcttatagtagtacatccttctaaaatgcagaagtcttccattcaggtttttagtcaatgatctaatctgtcattttcatctatggaagaattccaggggataccaaagaagttactaatctatatccacagggtagaaagggactttggaatggtggagtctaattttttcttaatgtgttgtacttaatctaacattagcttgttgaaagtttattttatgttctcgccttgacatttccaaattaggcacctttggcatttacattactctttttatttcccggagctttgttgtagtacactgaaataatgactcatcatacaatatgtgatgacctaaaatagttgctgtagcttcccaatgtgccagaaagaaatagctgaagccctgacatcttgtttcattaaacaaaaattcaaagtaatggcagttgccaaagaacataaaatattattatgttgaaagattttctaagtttttaagacttttcgtttcttttttcttttttttttttttttttgagacgaaatcttgctcttgtcctccaggctggagtgagatggcacgatgtcggctcactgcaacctccgcctcctgggttcaagtgattctcctgcctcggccccccaagtagttgggattataggcgcctgccaccacaaccagctaatttttgtatttttagtagagacgaggttttaccatgttggccaggctggtttcgaactcctgacctcaggtgatccacccaccttggcctcccaaagtgctgggattacaggtgtgagccaccgcgctcagcctttaagactttttgataaccatatctcatattgtgtaggtaaataagaaccctgaaaatcatctgcctgcaatcataagttttgtctgtagcttcctaatgcatatagaaaaaaaccacaataaatgaaattgactaatctagcaaaatgcctaagcaaatagactccctctccaacattcagaattatctttaatcttgtgatataattacctcaattatccataaccattattccatgctgaaaacagaaatgtgttccacttcagctttctgaggtaaaaaaaaaaggactaacttttgaagaggaaaacaaaacaatcatttgagctgcaaagtgtttccatttttatgcacattaaaaaatccatttggaaaggaagaattcattgtaatctgcaagagtaacacattttgaattgtaatacacatattttatttcatacgaatttattaattattgacagaagtactcatgagagtgtttaagttggaatgtgggatatcatgtgtcaaaaaaaggctcacataatttgttattattgctctatgacactcttttgtttttgtgctttttgcctttagatcagaatgaatatgctctgcacaatttgttaaatctttagaaaaccatcaaaagaccactctggaattatttgcattgagccaaaaactattcggataacaggtggcctgagtgggtgtgtgtgaaattcaagggatagaaggaaagcaagatttgcttacttgaaatcctccttcagttcagtgatgggactccttaattgaattcaaatcctgagcaattgtatttgatttcctttctgtattaataaaggcatagaggcataaaagtgtttaacatgttcaagaaacataatatggtttgtgttagatgtgttggcatatgtgcttgttgtgtacttgcagggcccgtgttgaagggggaaatgagaagtaggttgtggaaattttgtttaagatctaaagagtttgggttttactgtgtggtcaatatagatttcctgagctgattgacaacatgattttatctcatacgggaaataaactatggtggcaattttgagaagaactgaaatgggtaagagtctggaagcaaggaaaaatatggcgagactattggaataatctagatgaaagttgatgagggcctagataaaaggaagagacagattcagacagtttgatgattcaactcttaaattatctggaaaaactatgtctcaatgaaatattagttttttttttcttctttttagaggacaaacctcagttaactacaagaaaatgttcaaccctataaaatgatgaagcacttactagaattttaaccacggtacaatgaaacagtatactaaacaaaaataaaaatgccattttttgtcaccagtttcttaatgacaaaataaggccttatattttgaaacaacataagacttgataattttcaaaattaaaaagctcagaaggtaattcctcattaacaatagatcacactggcctttaatgtatgtaaacaatcttgagtattgtcaataaaggaggaaaggatgataattacaaacagactaagcttcttgcaattgttttctgcctactcaaatagaacataagagagctcagtcccgtgtacccaaggttaggaaaaaaggaaatattactgtgtccatttttaatgtcaccacttttcccttctatggcttaccagatcatcaaaatgatcctctaatgccgtggctaaaagaatagatgtcctaaagcactcttttttttttctattttctcgagctttcgtgatagataagatcgttcagtactgctttgaaacaacgacattttataatataaaattacttttgaatcagaaggtctggccattcttctctcctctttcctgtgctttgaattatttttggaccccagcataattcaaggtaaatagatcctgtgtgaataaagtatgggcagaatgattctttctctgcacatgtagtaaatattaaacattgatcagacagttatgtgcatgagaaaatatcttgagactgtgtatttggtgtttctctttccctctctgtctgacacacacacacacacacacacacacacacgtttagaaagattgatgtgaaacagacctaaattaaaaaggtcaaactaacccccttcaaatcctgtcaaccttcccacctatattcttacttccatgttcctaattgaaattggaaaaaaagtaataggcgaaactacacaatgctggtgttgatttggcagtgagggtcgagataagagagagaaaactaagctctagtgatgcagtggcagattggcgattagtaggcagaccattctggggaatgaatagagcctcatgagtaattatttaacatgaaagatagtgtttacattgctcttccctgcctgtttcacattctggtaatcataatcttgtgaggctcaaatgagataatgaatgtgaaagtgctttttaaagtatcatagattttaaggacattatacatttaggtctaggtaacaacatttcagaagatataggaattttcatctcccaccccccattcagtttctcacggattgctttgaaactgttagccttaagagttccatttttattatgtaactacatagttagaaaaggtaagaatttcactaataaaatattcttgctgcccagtaatcagacaattaacagggttctgttcccccacaaacaagacatcctcctgggcttcctcaagagtttcctcaagaaaaaagttaaaaataaataaagtaaaaatacaaagcagaaaagtaaaatgttggaaacacaaacttactaagccacaccttggaaacacagctagatttttagtttctaagaatttaagagtctaagagatgattatgtgaacaattatgaattaagcccctcctgtgggcaggggcctgattattttcctatttttcttattccatacttaatagggggttgttatatactttgctttttctacacacagtgctggcttatccttggcagtcttaaagaaacttaatatcacagatttttattttttaaatttatttattattattattagagacagagtcttgctctgctgcccagtcctgagttcagtggtgtgatttcggctcactgaaacctccacctcccaggttcaagtgattctctcgcctcagcctcctaagtagctgggctcacaggcacgctctaccatgcctggctaattgttgtatttttagtagagatggggtttcaccatgttggccaggctggtcttgaattcccggactcaagtcatctgcccgtctcggcctcccaaagtgctggaattacaaatgtgagccactgcaccttgcccagtgtgacagatttttaaaagcgaagatgaccttggagataatccagtgagaaaatcacactcaactggaatgtaaactccatgaaataagccatttcatactcacaactctattactaaacctaatagcttgcaataatacataagagatgtaaacagaagaggaaattacatgttaaaaagatagagtcttgcccaggttcacaaaaatagaatctaggtcttcacttctagctcagtgcttttcccatcatgccacactgagcctcctgaaggatatgatgtcttctccaaatcagtataatttaagttctagaataatgttttcttggttactaatgtgtaactcatactaaattcataacttttgaattggattatactgatttatatctgcatattacaaactatacctacttcacttgattttactattgggcattttttgttacaatttgtttacttaaatttggaactgtagagaaaataaacagaattagatgaccaaaataacagaaaggaaattgtttcatctttgaatagacaatagttaattaccaggtcctaaagccacttctaatacccatgaagtttcttagttatcttgccaagaatgaaaaataaatgaaattatgcaaaacattagttggtaggttaaattctgtggcaattaaaagcaatttattaagtgagtaatgtataccatagagaaggaaaaacttagcctctacacttctagggtgtttttccggcggagcctgataattaaattgacataagacagaacaacagaagaaaagcatacaagtgtatttaatacaaactacataacacaggagacttaagaaaatgaagacccaaagacatcattagagctgaacacctatatgctgaattggacaaaaagtaataagctgtgaaaatgtgacaaggcaaaacttctagggctatgggacttgtttgggtggagatgtgggcaggaaataagggttagtctgacatagtgtgtttgtacagatttttcttggtctcaccttctcatccttgatggtaagaatgaaactttccttctagtataaggaagatatctttcacatggggatttcatctcttgtttctaagaaacagaatgaagtttggatgatcttcttgtatctgcttttcttcaagtgtctttaactcagaatagtcaatattccagaatggcatattttagggtggcatattcttaactccttcaatacaaaaaggcttgtgtagagactttatttaaagcaacatttaatgttaatttttttaaaattatatgtccctttatcctatttgtttcaaaattttgctacttcaaacctaacactttccacagaaaaagcctgtcattgccttctagggataaaatactgccatgcagaacatggtgcacatattagacatttaagtaatttagatgctggaagggaatgtaacatattatacttgttaacattgttgacagcaacatggaaagctcattttgtctgattaccagccttatgcttcatccggaatcttatttcaatatttaatacatttcagcatcttcctttcttatatcaaagttaaatatattgtacccaaattttatcctcttccatattccattcccttagtggaaattgaggacagttggtcattttattctgggtaagattactatttacacttatatagcattgttaaatcacctccttgatctttgccaggcttaataattattataattaacatcttttgagttcctactaggtattatgtacttttacttgctgtattttatatgtttcccacaactctttgaaatagatgttacctctattttaaagatgaaacaattgatgcttcaagagaacgacttatcctagatcaactagtggcagagcaagttttagcaatgagtaacactgcaagaaacaaaaggataaagaagactcaagttacaatttgcagttgggttttttaacctctagctccaaagagatgaaataatgttcctctttcaataatgttttctctggtttgtcttttgtctctcagattaatgtgaaaaacactcttttgcaaaatgtcaggtattctggtaatctaatctctagattaccaaatcttggtagtcagtcctcttctttctacgatgtgaacttatgctgaaaaagactaaccttagtgtttttgtaatgtgttaggaaatatattagagttttctattgtcaaaacgtgttcctctctgcctgtgtgctttctaataactacgttcccctttccataaacatgagccttcagatacacagttgtatggccagcagtgtcacagaagaagaaacaaataaaatgcattcaataaaaatgagataaggaacacatggattccttattttaatttccaggaggatatttttcatcttgagtagctgaacaattttaaactaagacttatttttaaataagttttgccacctataaaattcaattatttaaaatgtatacatgccattaagatataattaccttgcattcagagaaaaggatttaaacattaggaaatttctttaacaggctgacaattttcttttttaataaatggaacaagaaaggaatacccagaaccacaaagaaacatatttaaagcattaatggaagaaagataaatgcatatctttaaaatgctacaattgagattaaattggtgattaaaatttgccatcttctgacaacaataactttttatatatattttaaaatgagtaatactattttcattagaaactgaatcttctaaaactggactacttattatctataattggtgggcggcaacacattaaaattcaaatttctacatatttccatatgtaaatgtgctttttatattttttaatatgctgctctttttaggatttcaaagttcagaaaaataagattgccttggaaatacaatttatttttctttctctttaaaagtctatttcatgagctttctgctgtttaagttttacagtagggctcctgacattcttcatagaaataaatcttatttcttttgtttacccaggaaaagagaaagaaatctgtagttcatttagagataaggtctgtctcctgctcaccctccgcctttccttccctccatccctaataccttttcttggtgattctgaaactctataaaatactggtatataataggcttcatcttacatttctctttaggcttttcttttaagaggtggaacagtgtaatgcatataactacttgaaaaggagcaatttgcctttgttcacttcattcgaagatatctatcaatttaacattattcaactgtatctagaagattccctttctgccaaattggaaaataggtacccatattgataataccaggcaagcatatcttactgatcagataccaaaatatgaggttgtaactatgatcgtaatatgatcagaccaaccatgatggagatgacaactctgtgtcactcttggaagcctaatgaaacacttaagctttggaaacgtagactgtttttaactatttttaatccatcagtggttgttacatacccaaaagataaatgattgctctttgaggttctttacaacactcgttgaaaaataaatgatgaatataatagattgaggatagacataacttatcctgaaactgctattcatttatagcattatatcatctagtcatacaaaacaaacacattcatacacagatgtacctgaatgccatattgagacttttaaatcttttttttttccttgcattctctatccctagtaaatgtaagctgaagtttcatcctggtatcgggggagagggataaagggactcatcatccataaaacttaggtattggtaaagaagaacaagctggccaggcacagtggctcacacctgtaatcccagcattttgggaggccaaggcgggcggatcacttgagcttaggagtttgagaccagcctggtcaacatggtgaaaccctgtctctactaaaaacataaaaattagccaggtgtggtggcctgtgatcccagctactcaggacctcagctccttgggaggctgaggcacaagaatcgcttgaaccctggaggcagaggttgctgtgagtcaagatggtgccactgcactccagccatgtgacagagtgagattccatctcaaaaaagcaaaaacgaaacaaaacaaaaaaagaagaatcatttaggaatttcagacaatgcgacctagtaaaagaatgactctctgttcaaaatgcttgacttctgagaattatcttttttacacttaaaaatttgttttgagaaatatcttttgaaataaaaatattctctgtacaagttcatacaattgctaaggcacatatctttccctgaaaaaaaatgacccttgccagcagtgaaagtatatttaattaatataaattcataaattctattttaataacataagcgaagagctttatattgagagccctttgagataaactgtatcaatagatttcacaagctactcagttgttattatgtattaatttagtatttttatattttttcatcagttttatcttagaactttcctgaagtgtcctattatgttttctatcatgtttgtttgcttgtcacattttctaaaatggttagctgaccgagactaaagaattcaatagaaattattaactaatctcaagtaaagatattgctcttagaacttttggccaagagttaaacatagctggaaaaaagtctaaagcttatacttattttaaaagaggcattgcctattctgaaattaaatgttcttcataaagtaaaagtatgctttggaatgtgctttattttcttcttagaagccaggtatgtaataataaaaaatacctctcttatttcacagccttaaattttttaggttacttttatttagtagttaccctggttctcttgactatttcttgaaagggggagatatttttctaaggaaaaataggcagataatttctacttttatgagactctttacaaacactctaagaataagtgcaaaagcttttttggcatataaagtattgcagcttttttgcaaaaataccaaatctaagaaaatgagaatggtagtgggaggattgtatttctcctcattatagtacattaaaaataggtctttacaggaaaaggactaaaacaagatacttaaaaaataaccatgatataaatggtttactattttaaaagtttaatttataatagctgtttttatcaaaaatctctgccatgaaaagcctttttcttgaagtctagacaggtaagaagtttatataaatacatcaatagatcaaaaggctaaaatctttcaattaataatgagatgtagtttgatgcactgaaagggaaacaagagcagtaatacaatttgtatactgcagtcatgacattttagtgaccttcaaatttgatggatatttgttttctaaaggttatcatcatgtttaaaaatattttattaatttataacatttataccataaacaccattaatttatatcattaataaattccactataatgtattagtgaaccagttagcagctgtaagattgagtaatatttagacttttattaatagtttctaaatgtcccagactaattaaatcttctcattccacaagaacaatgcttaattatcttgactacacagcttataagcaagatattaatagaatattcttgtttcacaccttcagtggtatggagactgtcagtaaaactatctcttttcattgctaacacttcattggaccgattagatgacttctgaattcattagtgaagtgctaacttcctactggaactggaactggcatagtgtgttttattactgtgtatgtttacatgtgctgatacacctttcagaaagttgaatctttgactaacatataaacctgaaattagacagtaacccgccaccagagggattgtcaatctctggattgcctaagtgtcagatgtctgccaggtgccatacgtttatctaaagcaggttatagcagtggattatcatagagtcatagcagtggattatcataaagtcatagcactttagaacaaaaaagagtctaatccaattgttctattttgcagaggcaaaaaatgaggattggattaactatttctacctagccagtactttatccgtgttaaaaatgttattactcaaattagctgatgtgcacaggtagtggtagtgattttgctacctgatattataatagaaaatgattatatttaatttcccctttttcagtgaagctttcatcattagggaaattggcctgatcatcttatgatcataattacaacctcatactctgaagggcagttgatatagaacaaatccttttcaaagcaacaatataaattgagatcatttgggtaactttcatgacagctcttccctattagcattcaccactttcaatattttattgttcccagacatgattaaaatgaatcttttataaaaataactttgttatctaaaactttttaccagattataatatgaaaattcttcagctgaaggaataatttttagctaccccacttcatggcatgttccagaaataattccccactgggtcaacatcccccagagctcttcttcacagacaaatagagacacaaagaatgtatgcaatttgatgttactgagcacatacacattttggaactattattccccctatcagatagtactattactcttgcttttagtggtaactttgacaatttattgctagaattattcatctttagtgaggctgaaggtccaatgttagaatgttttagagacttatttctgagagggccttaggtctatcaaggtgggcaaggttgttatttttaatcaaaataaaatgttatgaatcatttaaaaatgtaaactctttaaacagtctacaattttaaatcttttgtttaatttagaaagtaggcaaggctagaaaggaaaggaaattttacccatattacttccacacagtatatttatatattttatttaaaaaatttttttaaataacatttaaaaacaggttacaaaatacttatggcacacatcaatggatataactgtaaaatacattatataacttttatgcaattttattttacatatcctcaccttaaataaaaatagcaaaattttataacgtttcagataagaacaaaataaattaaataatacaaagactcatgaatttcaatttgtttctattttgaaagaagagtgagaaaatttttaaattattttaatattcaatgtagcttctttagccagtgctttccttaggttaaataaaatttgtgtgtaaagtcaatgatgggaacatcattttgaaaattacagtaatagttgagttcatgacactgacttaattacactgacgtttagaagagattttataaatttaaaagattattcctgtcatttaccccagctatattttcttccaataaggctttaaaacttgctttggaaaatgctatgcagaacagttacttagcatgtgtagcaagatacgaagtgggaaatacagatgaaaaacaagtttacactgtttagaaaacaatttggtctagtgctggttatatttgcactttcacaatacatcctgtgcattatgcattacttaaaaatgtattcgtgttttacacattttatgtactttcattgatttgagaatttgaaagtctttcaacatcatctcaaggtatcctgtactccatcgtttactggtacattgcttaaaatttcacgtgtgtcatatctagtctttaaaaatatttgtaattcttttatcaaagaacggataaatgcctaaaatttgtttttattttattatgaattttgtattgttattaagattaattaagattatattgcaataaaaattaacagttgacttgtttgtctaattttgagaccagcttaatatgatctataaagtttacaagtataatttctgaataatgtaagttttaaaaatattactgttttttaatcaaataaataatgagataggtaattcatagataaatgtaaagtgcagttgagactcttaaccaacggtctcttaatacacaatttattttgtctgccttcttttataaatatcagctccattcttgggcaacttttaatgtctcaagcgttttccttttctactatgctcctgatcttcattaaagttttctgtagaatggttataaatattaaaacggtcataaatgttgaaactttccttaagtaggtaatatttgttatccaacgtctcagaggaatttccatttgcttcataaagcatggcacttttttaaagacaaaaaacaaacctggaattgacattcacggccgagcacggtggctcatgcctataatcctagcactttgggaggctgaggcaggttgatcacctgaggtcaggagtttgagaccagtctggccaacatggtgaaaccctgtctctactaaaaatacaaaaattagccgagtgtggtggcacctgcctgtaatcccagctactagcgaggctgaggcaatagaatcgcttgaacccgggaggcaggggttgcagtgagccgagatcatgccactgcactccagcctgggtgacagaatgagactccatctcaaaaaaaaaaaaaagaaaagaaaagaaaagaaattcacatgcatctgggaacaagtgctactccaatgctgtagcaattgtcctacagcgcacaccactatgtagaaaaatgaatttttattaatgataaacatacataagcaaccatgacataatttaaaaatcgtcttataatttgtcaggtttaataagtagttcacttggttcagctgaattatacatgtagtacttttgctacctgggattagaaaactattttatcattcatttcttaatggttgataaggtgaattctaattttaacagatttttattcctagtcatagaaatgtagatgcgaattgagtctgtacatctgcttacattttctttctataagctagtaagtaaataggcgttttgtttaacaaatcagactgaacagagttagtacaatttggctggccagggcctagcattaaagagaaaactgagaaaatttgcatagctgtggtgttccagaccaccatttcttttattattattatttcaacattttctgggtacaggtggtttttagttacatagataagttctttactggtgatttctgagattttgatgcacccatcacccaagcagtgtatgttgcactcaatgtgtagacttttattcctcgtgcccctgtaacccttcccctcgagtccccagagtccattatatcatccttatgacttttgcatcctcataccttagctctcacttataagtgagaacatacaatgtttggttttccattcctgagttacttcacttagaataatggtctccaacttcatctaggttgctgtgaatgccattatttcattcctttttatggctgagtagtattccatggtatgtatgcgtatatatatatatatatatatatatatatatcacattttctttatccactcattgcttgatgggcatttaggctgcttccatatttttgcaattgcaaattgtgctgctataaacatgtgtgtgcaagtgtcttattcatataatgacttattttcctctgcatagatacccagtagtggaattgctggatcaaatagtagttctactttcagttctttaaggaatctccgtactgttttccatagtggtcgtactagtttacacttccactgacagtgtaaaagtgttcccttttcaccacatccacaccaacatctattttttttttatgttttaactctgaccattcttacaagagtaagatggtatcgcattgtggttttgatttgcatttccctgataattggtgatgttaagcattttttttcatatgccagacaaccatttctgtgtgacttcaaagacagcatcacttcctccaaatgaaagtgagtataggatttgtagtagtgaaatgactcattataaccaatcaatgtaaagatggtaaactataaactaacatttattataattttaatacaacatttaatgttcctaagtcagtaacttaatagttaaagtagaactataatatggtagattaaatttggtttgtgatgcagtactttttaaagtgaaattaagtttgcagttattgctgggatcattggctgtcatttgtgagataattcataactcatttttttgaactcattatttataaaaggtatcaatttgacagctctggagacacacttcattttttcaattcaaataataggaacagcaatgctgaaactttcagcagcatctccaactaaagcatctgtcacgtctatcactaatttgaaaagtctgtttcctgagtgaggaattattttggtcaacacatctgagcagcaccccagaaagtcagcctttatcctcagagcaataacgatgatagtgacagttcttgacttttgggagatgcagatgtatatctggttaagaacttccagcttgcaacccagccatttcctcctctccaagtagggggcaagaattaaatatgctaacatgcagaagttcttcctagcacagtacctttcatttaatatgtgatagttttccttttattgtttcttttcttctccagaatacttttgaaaagaaactaaaactaacactacattattttgatatttgactgtttttcatctgcctctatacccttcaagatgtttctttttcagtatcattttcttctctcatttttcattcaactctaacaataaaattgtacatagaaaatagaatacaatgaagaaattttaactgaaagcctgcattttaggaagtagctcacaaaaaaatagatgaaccataaaggatttctttataccataatgagcaaattagtaactaaatagaaaatcattgattctgggataatagggcaggtgctctcctttatattagttgagtatcagcttgagatgaatgttataaaaatagaactcaatacggattaaaaacaataagcatgcaatgttttgcttgattcatttaaagacaatactagaaaaaatttgagactgatttaatacatttatcgtgtcatggaaaacatatgacttataccctaggttgattccttttttgacactgcatcgcatcctatttatggatgagaaagagttgggtcattaaacatatattccttccatggatatcaatacttttactttagcatcacaatcatattgattataataattatcttaatttttatcattctcaatccttataaaaatcctcaactcttactaattccattttatagaagaagcaattgaaggtaaaaatgattgagtgtcttgtagaacaaagtcatacagtgagaaagacaggacttttctttaaaatgaatactagattacttgcttctttggttcccttgagaatttttcttagtagtgaaatactaattatacagaagtcaatggcaaacaagtgtttgtgagctagaaatgggcatatacaggactagggtaaaatgaaaatcacattatcaactgcccgatgctaagtgttagaggttacagaacaatattagtgatgaagcccacttatcatagaagtcaagcttattttgctctgttacagactaatgagagatgcaatttagaaaggatttctgtatgaaaccaaagtttacctgtttatcatataacacttgcttttttgttgactctctatctttgacaaagcaagtttttaaacaattatttgaattttctttttgattatattctctaccatacatgctatcttaattctgtgtatattctctacaatgtcttaactactcaatagtttcttcattcaatagatatttactgaactcctactttttgccaggtcctgtcttagggaatttactgacaaatatctacgctgatagttagagacatagttcggattcacttgatcaattatatttggtgtctttgaatgtttaatacaaattacaagtatatttatacaaatgaatagatttcttcataaaatgtgttcatcccagatggccactgcttcttagaaaaaaaataacgtctatatatcttcttgatacaattactactagcttggaatttttgaaaccttaggagagaaaataccacagccaaactattttcaggctttattttcctgctaagggaagattctgaatctttcctaaaaaataaatattacatttctcctaaatttttatcttcattttcatagagaaagtattcctctcaggagaagtgactatcaatttttctcttcagaagaatttttatacttcagaagtatttagtttgactattagacaatcccagaaaaagcattttgctcatctctaaaatgtgatgtttcaggttatatgttttacttcaagaagaatataattttaatagtcaccagatatcattactgaacattatcactttccagccaaaaagaaagtaaagcatttcagaaatacttattcctgcccactcatttcataataagacttcaagtaatttattgcctaatataagacaattagtgagttctacagtcaacgacatggacaatgccagttcttgtgaacatttccaagaggatatttatgcttaactttttcttttttaaaaaataaatagctttatgtaattaagtagctttaccttataacatataattagaagatttaagtattcattgtaagatcttttttatgtatacatttattaactagaggcatgtgacttcagcatcatgaaccaagtcagtatctgaatatatatattctttacatttttttttgccactacttttgagatctattactgtatggggtgatttgaatatactataaacttttggtaaaacttttctctcatgttaaaataactttttaagtgctcagcaatataggtattataagaataagtattgtgactaaagaagataatcagcagaaatgctgcctacaagataaatttgaaaaaatgaattaacataccaaacgttagcccatttccatctcaaaatacacagcttgctttttttctttgaaagccaatggctcacagaaagtttattcaacaagtatttcttgagtgcctactatgtacaaagcactgtatgaggactttggagcataaaagcagtataatacaaggaagagtatgaaaagaagcttgggaatgaaaccacgtgaaacagctgaaaggagttcagagataggagagatgacttctttctgtcaaggatagcatagtagatagcaaccagtttttttatgttattacagataaataatacaatattccctcaagtaactgtttaatatcaagcatataaatatttcaatatatatgtcaaacaaaaacagcatgtttcagttttttatgtttgttaggtaagatagagcaataaaggaagggatagagaaaggaaaatgcaaagaatggacagaggaaagagatacggaagaaggataagggaagtatggagagaaaagaagtgtctccatattactccatatcaaggattataaaatagcttcagatgaccagtataagagctctgtgtagaacatcccaggacttcctgtcttttaaaagataataggaagtagattacaaagatctatgtgaaacttacataattggatatagacacctcagtaaagagttatgataaataaaaagagattaagtcatggacaaggtatagctagaccagggtttctcatccttggcactattgacattttgggccaaatgtttctttgttgtggagggttgtcctgtgcactgcaggttgttttgcagcatttctgacattcacccactagatgccagtagccacagttttccaattatgaacggcattaatgactccagacatcttcaaatatctcctcagggataaaatcacccctggttgagaaccactgacctagagcataaatatttcagttgtagtgaaggagaagtttagaaaagaaagtacagtcacccgacacaaatgatagccacaaaatgaacgtcatgggaagaacagggattatgatctaatgtggagatacgtagaaaaataaatggaacaatgagaagagagaaaacataatggaagcacattgttcttttgggtagtttgcaatgccttatgtctgaagtctctctacctatgaaaaaatagacaaataatggcatgaccaaacaaaactctagaaaaagtatcatttagtgtcaaacatgatagtaattatcaaactttactatgtttttcctgacagttttaaggtataaacaattaatatctttggaactgcctcagattttagaattgccccacttagcttttccctgggaaaataatattgctcatctaaaggaaaaaagtaagataattaatgaaactgtttattttccttcactcttgaaagcatgaggaagaataaattttattccataaattttttcatggcttccatttattagtaattttcacatggtgaaattcaggtattttacatagaatttcttttttattttgttattacaattaatatttcgaacacccaaaatacattccatctacttgtgcgttatgaaaccatggattatatgtattccaaactctgttcattctattcctcaactaaatatatatatatacacacacatatttagacagagtctcattctttttgcccgggctggagtgcagaggtacaatctcggcttactgcaacctccgcctccaggttcaaacgattctcctgcctcagcctcctgagtagagtagctgggattacaggctcccgccaccatgatgggctaatttttgtatttttagtagagatggggcttcgtcatgttggccaggctggtctcgagctcctgacctcaggtgatctggcccacctcagcctcccaaagtgctgggattacaggcgtgagccaccatgcctgggcacaacaatctatttcaaacctcactagtagcacaatgtcctctgtatttctaaccaataatctaaaaatcactgctatattttgatattggagggttgcaaagaagtagaaaagctttattttttattttaatattttcagctattttcacagtttaccattgaaactttaaaatcaaggggcaagagttattgacaatttgcctccctttaggctttctcatgacaagcaagattataatttctggccttttaaaaataagaatgtggtgactacagactcatccccttagggaaatttgtcacgcaaaccgattacctaacttattaaggcttgtagaaatttggtatgcttttaagaacaataagtattatttgatgaagaaattttaaatagatatgattctttcattttgttagagaccctaaaatgaacctcgaaacagaagatatcccaatgattgtatgatatgggaacaaaaacatagcgttgggttttcttgttttgtttttgatactatagattcagactttttagctaagactaggattggaaggtttaaaatatgtttggttgtgcatgagtagagacaagaaacaacaaataggaagaatgctctttggctttcttaagctaaatatctgcttttactaaataatcgaccctctgttataaggctctgtttcaaatttatcttcaatgtcatcatgattgtcttcctttatccttacaagttcattttaataaacacaaaaaaattatttaaacatattgtattatataattcctagcaccatgatatttattcactgaaatcttttgaagagccatgaattttttaatagcagaattttataaacaataatttaaatattttcccattcagtagtaaacactagctgggaaccaccaacactgtgcaaatagtagctacagtgagcaaataattcctatgaggttttgtgagcttttcactcagttaattgaacaatacagttatatgctcaccctgaccctccaaactcagtaggagagttattatggggtcatttatcctgcacattgcaaatatgaaatgctatataaatgcacaattataataatgatgatgagttgcagtgaggcttaatgtcattgtccctatttaagtataatttaagattggatttagcaagatttctttttcattaacaacaggaatcacataatcacactaggaaacaaatgaatgtcactaatgagacagttttgttcaagtagcatgctttcaatatattagtcaattcctcaaagtcctataaatgagcatgctttatatattattgaacagcattatataggcatcggtacttttctctgacttcaagcaagaccatacattaagcataccaggaaaaaatgaacttatatctatcctccaaaggctgcagtaaagtttgattcactggtatcttttattaactacaacagtcacgtcacccttcatctttggcaatatagtgacttttaggctatgcctatatctgttttaccttcttccttccacctctacttgcaaacaaaatctgtatataatcaatagcatgtactgagatgatgcttcaaatttaccgagaaacgaaaaagaatatgtggaagaacaaagggaagtcttatatgtgctacttaaaatcacgaaattaagtgtagcagttacgtgtaatatttgagtgtagaaaataagattagaaactctagaaacaatgtttttcttcagtcaaaaaactccacaaagatggacagtaatagaagtaggagcaaagctgaattaaagtacacagataacaggttttttttttcttttttcatttatcgagttgaaagtcgttttattttcattgtttgctggactctattaaggatttacagggcaacaggagggaaaagaatttgataatctttgatcaaactatacgatgttaatgatacttattgctcatctttcttctatttttttctattattaattctctgtgggcctagcatttacctctttatcgcataaatcttaaagcaaagaaaataatgctcatagtagttgcttattaatggatttctgtgaggttacactgcagggaaaggatttaaaaacataataatcctgccagtcctttgaacagtttagagcacaggagatacttaaagttttatagcattctcctgggaagccatcagctctttgccttttctcgaatttaagattttaattgcctcagtgtttcaataacaattacagcctattcagaaatttcctttccatgatctgacagctctgggttttaatttctgagaagctttccttaagtaggtaatatttgttagccaaagtctcagaggaatttcaatctgtacattatggaataaatttcccatttatctgcttttgatccatcagtgttttgattgattgtgtatattatgcaagcagagctttccaatgtttcctttttctcttgtgccaccaatctagcaatgcattgatttgatcacttgacttattagttcatattaatccaaacaaagtatcttccgcttttttggcataaatttaattcaatttctattcagacttgttcaaatccaataaagtttttctattaagatggattgtggtgaagtgcaacttctgattctttcccaaacttctttgtccttcagaacataactttagaaaattctaagcctgaatcttccgtatttatttaggagaatatgagaaaaaaataaataaaatgtagacatttcctcaaatccattctctttgatagggaagaaacagttttacctaacaaaaaggccaggctttcacctgctacatcctgcaattcttctgttcttcacccctgttctctacgaatcatttggctgagactgtactttttgcttaagctatcatcctcattacttcttcttgtacctcttacattaactgtattgactaacagtattagttttctactgctgtgtaacaaattgccaaaaaaacctagtagcttaaaacaatacccatttgttagctcactgttctgtaagtcagaagtccagggacctcatctgggttctctgtttaatgtctcacaaggatgaagtctaggtgccagctgggcccagctcttatctagaggctctggaaaaaatctgctttcatgctaattcaagtcaatagcggactcagttctttagggttgtaggactgaggtccctgcttccttgctggctatcagccaggggccatgctctgctcctacaggcaacccacatttcttctaacgaggccctttccatggtcaaagccagcgactgcatgtagaagctttttcatgcttcacttggacacccctttcacttataagccagagaacattatctgcttttaaaatgttaataggatgagaataactccacttggataagtctttttgccaccatataagccaacatgctcacaggagtgatatctcatatttacaggtaagagaacttgggttagcatggtagaaaaagttccgttatcatggaaagacttccagtacccttcaatttttttgactgctatccatagcattgaaatgcgttgttctgtgcaatccagaacacaggcacaaacacacacacacacacacacacacacacacacacagagagaaatgtttcaccaaagagtacttatttttactttgtgcaataaatgttattttcaaatgtcttgtatttcattaaaggaaaatattaatttaacttaaaaaatttatgaccaaacctactaatgcattttgttttgttttaaccagattggaaaaggcagtcacttttgtttcactttttggaaacccatttgtaattttgatgttctacaaaactgaactatcaaaattgggattaagataacatctgaagtgagttatatgttctttttaatactaattcatcccattctccttttcacattagtgtctttgtcatgtgcacttaaatttagtttcaatgcgaaaaaagaggcttaggaattccattggtactcacatagctttttccatccaggtaggagcattttattctgtgtaaaacccaccacaatgttcaccagtataaatgatcactaatagtagttattgtgatagtcactcgacggcagctttaaaatctgtgttgcctgaaattaaaagtggccacagaggggagtctctatatatagtattagaattctgccccagtcacaattcttgtgattgttcaacaataaaacaaatattaatgtggtatagtttgtttaatgtcctccaattttcttttagaaatatttttatagatattttgctttaagctatgactttttaatatactcatcacacaactatagctttgcatctaccaaacttgagactgaaacacagctcttttttccaataacgctgtagcctaatgaaaaattggcacagcatgaatctttcaggttccagttaattgttaacttcttgaagaaaccacatttgaccaaccaatcaaaattaaactttccatagcttcctgccccttcccttcttagcactgatcataacctccaacaatatggaattggtgtaattatttctataaggcctttatgcttcatacaaaaaggattgtgtcaattttgcctaataccatgtcaccagcacctagcacaatgcctgacacacggaaggccctcagttaaggtttattcaataaattaatgatgaatatcagcatgaattattttctttattcctcattaagtgtattttgttagagaccttgctaacctgtaggttcatgtgagcttttcctcagagagtgctatggctaatgggcattcatgttactgccacttcaatggaaagcaaccacacatagttatactttgaaagtctacctccacaacttcacaatgataatgttgattttgaaaaacctttccatagctataatttttatggaagaggagaagaaatatcaagctgctaggcaatgtgttctttcttgcatctgtatttcttatgatcatatgattttatatgactgccagtttactcattaacatcaaaagttgctaccacagatattagcctattgcatttcttttgattaagttataaattttttggcaagggtagcattagtgtatagatttgaaagaaaatatgagcgtaataaatagatctcttcatttcattctagcagtttgtattggcaggtgattttgtactcattcatgttctttttcttctgtaataacataattagtgtaatgaagcattgagttatcccttaaagtagaatatgaatgatgcctaactgtaaatagggctcacataccactcaaaatcattatgaatagatgtgaaggcacataattccacctatcttaataaaaatattaatttaacttacaaaatgtatgacctccattaaaaaatcattatatcatgttctaaagtttgatggagataatgcaccttccctaattcactggctcttcattttattattgttattttattgaataataactaccctgcagaaagagaagcctcaaggatgttttgctgatgggatctgaatcaatataacggctttaaatgaattggacatgctcattttacccacatctacttccctgatttttctgaacttaaaagtaaaaatgacccaggtatttgattattttatgttcatttcaagacttaagaatgaaaaaaggtctggcaaccaagatggccaaataggaacagctccagtctacagctcccagcctgagcaatgcagaagacaggtgatttcctcatttccatctgaggtatcaggttaatctcactagggagtgccagacaatgggcgcaggacagtgggtgcagcgcactgtgcgcgagccgaagcacggcgaggcattgcctcactcgggaagcccaaggggtcagggagttccttttcctagtcaaagaaaggggtgacagacggcacctggaaaatcgggtcactcccaccccaatactgcgcttttccgacgggcttaaaaaacagcgcaccaggagattatatcccacacctggctcggagggtcctacgcccacggagtcttgctgattgctagcacagcagtctgagataaaactgcaaggtggcagcgaggctgggggaggggcgaccgccattgcccaggcttgcttaggtaaacaaagcagccgggaagctcgagctgggtggaacccaccacagctcaaggaggcctgcctgactctgtaggctccacccctgggggcagggcacagacaaacaaaaagacagcagtaacctctgcagacttaaatgtcactgtctgacagttttggagagagcagtggttctcccagcacgcagctggagatctgagaacgggcagactgcctcctcaagtgggtccctgacacctgacccccgaacagcctaactgggaggcacccccaagtaggggcagactgacacctcacatggccgggtactcctctgagacaaaacttccagaggaacaatcagatagcagcattcacggttcacgaaaacctgctgttctgcagccactgctgctgataaccaggcaaacagggtctggagtggacctccagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatgggaaaaaacagagcagaaaaactggaaactctaaaaagcagagcacctctcctcatccaaaggaacgcagttcctcaccagcaacggaacaaagctggacggagaatgaccttgacgagttgagagaagaaggcttcagacgatcaaactactccgagctacaggaggaaattcaaaccaaagcaaagaagttaaaaactttgaaaaaaatttagacgaatgtataactagaataaccaatacagagaagtccttaaaggagctgatggagctgaaagccaaggctcaagaactacgtgaagaatgcagaagcctcaggagccgatgcaatcaactggaagaaagggtatcagtgatggaagatgaaatgaatgaaatgaagtgagaagggaagtttagagaaaaaagaataaagagaaacaaacaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaaaagcaactccaagacacataattgtcagattcaccaaagttgaaatgaaggaaaaaatgttaagggcagccagagagaaaggtcgggttacccacaaagggaagcccatcggactaacagctgatctcttggcagaaactctacaagccagaagagagtgggggccaatattcaacattcttaaagaaaagaattttcaacccagaatttcctatccagccaaactaagcttcataagtgaaggagaaataaaatcttttacagacaagcaaatgctgagagattttgtcaccaccaggcctgccctaaaagagctcctggaggaagcactaaacatggaaaggaacaaccggtaccagccgctgcaaaatcatgccaaattctaaagaccatcgaggctaggaagaaactgcatcaactaatgagcaaaataaccagctaacatcataatgatgggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaagggacggaggaagatctaccaagcaaatggaaaaccaaagaggcaggggttgcaatcctagtctctgataaaacagactttaaaccaacaaagatcaaaagagacaaagaaggccattacttaatggtaaagggatcaattcaacaagaagagctaactatcctaaatatctatgcacccaatacaggagcacccggattcataaagcaagtcctgagtgacctacaaagagacttagactcccacacaataataatgggagactttaacaccccactgtcaacattagacagatcaacaagacagaaagttaacaaggatacccaggaattgaactcagctctgcaccaagaggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaaccagaactcaggattaagaaactcactcaaaaccactcaactacatggaaactgaacaacctgctcctgaatgactactgggtacataaggaaatgaaggcagaaataaagatgttctttgaaaccaatgagagcaaagacacaacataccagaatctctgggacgctttcaaagcagtgagtagaaggaaatttatagcactaaatgcccacaagagaaagcaggaaagatccaaacttgacaccctaacatcacaattaaaagaactagaaaagcaagagcaaacacattcaaaagctagcagaaggcaagaaataacttaaatcagagcagaactgaaggaaatagagacacaaaaaacccttcaaaaaattattgaatccgggagctggttttttgaaaggatcaacaaaattgatagaccactagcaagactaataaagaagaaaagagaagaatcaaatagacacaataaaaaatgataaaggggatatcaccactgatcccacagaaatacaaactaccatcagagaatactacaaacacctctatgcaaataaactagaaaatctagaagaaatggataaattcctcgacacatacaccctcccaagaataaaccaggaagaacttgaatctctgaatagaccaataacagcctctgaaattgtggcaataatcaatagcttatcaagcaaaaagagtccaggaccagatggattcacagctgaattctactggaggtacaaggaggaactggtaccattccttctgaaactattccaatcaatagaaaaagagggaatcctcccaaactcatttgatgacgccagcatcatcctgataccaaagctgggcagagacacaaccaaaaaagagaattttagaccgatatccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaatggaaccaaagtcaaaaaccacatgattatctcaatagatgcagaaaaggcctttgacaaaattcaacaaccttcatgctaaaaactctcaataaattagtactgatgggatgtatctcaaaatagtaagagctatctatgacaaacccacagccaatatcatactgaatgggcaaaaactggaagcattccctttgaaaactggcacaagacagggatgccctctctctccactcctattcaacatagtgttggaagtgctggccaggcaatcaggcaggagaaggaaataaagggtattcaattaggaaaagaggaagtcaaattgtccctgtttgcagatgacatgattgtatatttagaaaaccccattgtctcagccccaaatctccttaagctgataagcaacttcagcaaagtctcaggatacaaaatcaatgtacaaaaatcacaagcattcttatacaccaataacagacaaacggagagccaaatcatgagtgaactcccattcacaattgcttcaaagagaataaaatacctaggaatccaacttataagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacaatattggaaaaaaatactttaaagttcatatggaaccaaaaaagagcccgcattgccaagtcaatcctaaaccaaaagaacaaagctggaggcatcacactacctgacttcaaactatactacaaggctacagtaaccaaaacaacatggtactggcaccaaaacagagatatagatcaatggaacagaacagagccctcagaaataacgcctcatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaaggttagacctaaaaccataaaaaccctagaagaaaacctaggcattaccattcagcacataggcatgggcaaggacttcatgtctaaaacaccaaaagcaatggcaacaaaagccaaaattgacaaatgggatctaattaaactaaagagcttctgcacagcaaaagaaactaccatcagagtgaacagggaacctacagaatgggagaaaattttcgcaacctactcatctgacaaagggctaatatccagaatctacaatgaactcaaacaaatttacaagaaaaaacaaacaactccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatgacaatcattaaaaagtcaggaaacaacaggtgctggagaggatgtggagaaataggaacacttttacactgttggtgggactgtaaactagttcaaccattgtggaagtcagtgtggcaattcctcagggatctggaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcggtaaactattgcaaggaaaaaaaccaaacaccgcatgttctcactcatagttgggaattgaacaatgagaacacacatggacacaggaaggggaacatcacactctggggactgttgtggggtggggggaggggggagggatagcattagtagatatacctaatgctaaatgacgagttaatgggtgcagcacaccagcatggcacatgtatacatatgtaactaacctgcacattgtacacatgtaccctaaaacttacagtataataataatcaaataaaaataataaaaaagaatgaaaaaaatatggtctataaaaatagatttgcataaatacaatctgcagctggcttcattctctttttataatgggttggatcatagcaccatgttgagctaaaatctattgcttttggtaatccagtcaagaaaaaagtagtaaccaacaattacatataaatgacataattttataaagtgaaaatactacatggtaataatttgataaattacttaagaaaatttaagattgtaaggtttgtccagattttttcctatagtttattaaaaataatgaaccaaaacaaaaaatttcaattactattgcatataaagagcaattataatctgtcaatgactacaagccagccatcttaacatcaactgagaacaaaattctaaaaacaaattattcttataactttaagtaaaaaaattgaagaactaatttaagtgcatactatttgtctgcttagaaaatggtaaaatgataggaacttcttaaaggaatttctattcaaaatatcgttgcagacacttagattaaatcaggctgggcatggtgacacatgcctgtagtcccagctacttgagagaaagaggtgagaggatggcttgagcccaggagatcaagactgcagagagctttgatggtgccatggcactccagcctttctcaaaaataaataaataaataaataaaataaaaacaattttaaaaaccatgtttataaacatgtattacaagttcattatttaaatgagactataaaacctaaagatgtaaacatcactttaaaagccttcctacttttttcttgactgatttgccaaaagctgcagattttagctgaggatggtgctacaattcagcttcttttaaagatgaaggtgactagagagtgtacttatgctgaacctgcaactatttcttcactataagaaataatttctccttttacaggccatttattccatattgcaatttatgacttaagtaagtgacttttttctttccctgttcttgtaaattctcagagtgattgtcagtctttctcatttgaatatcatggaaactctaccatttcagttttagtccagtgcaaatacagtctattcagtccttctgatttcaactttgcctatttactatataatagtaaataggcaaaaaaaactttgcctaaatactatgtaatagtatttcaaggtaatactatttagaaaaatgtattataaccgtttttacttggtttgtctcccactctttaatgaagccaaagtaaaaaatccagttaaaataaatttttgctgagagttgttttgttaaaaacatatattatcagagttgcatattaggaaagtaatcaatgttaactattttcattaccaatcatgtcactctgaacataatctcaaaataatcacataattctattggctaattttataaaattcacttactcatgaaatcaacatacccctttattttatcatttgctaatcatttagatttttaagagcaatttcacatactatcaaatttttggccacatatcagattaaacaaaggcacagaaagattaaataagttacccaaatatcatagctaagaagtgaaagttggacttaattttctgtctttggaacccaaagttctatgctccttcaaatgcagcatacatgtgtcttccattaatgacaattaaagtcaacttattccattactgtatgcattttaacctgaaggtttagagacatagagttggtttcctgactcaaaagttttagcattggcctggtgtggtgggtgatacctgtaaatctcagccctactttgggaggccaagatgggaggcttgcttgaggccaggagttcaagaccagcctaggcaacataacaagactctgtagctaaaaaaaaatttttttaaatcaaccaggaatagtgattcatgcctttagtcctacctactaggtaggctgaggtgggagaattgcttgagcccaagaattcgaggttacagtgagctatgatcatgccactgcactccagcttgggtgacagagggagatactacatttttttttaagttttattattattcagcttcatatttaatggaccaaagactttctctggttacttaactatatggcttagagagaaaaggcattctttggcaaatcttaaatgatagttgaatacattattgcttcaaaaaagtcattgctttcaaaacaactaatacaattaaacagtgatagcaatatcaaaggcagtgctatcttgtgaatcacttaggttgatcatagtaagccacagctaaaagctatctcctattattagggtgcacccataaatgtattcttccaccttttttagattttcctttataaaagtcatttctgttattggatgcagagatactcttaactgctatttctttgttgttaattgtggctttcttttatcattaaaaagcgtctttctttttcactcttatttttttaacttcaaatttattttgtcagatatcaagattgctatttgaaacctccctagtcgattattattctgtccagaattttgtaaattatgtgaaattcacaaactatagtaaaataatgatctaggaatattggttgatgggattatctctgtactacttgtttgaataaaaaattggtatgtttttctacagaacaaaattgccatctttaaatttttcctctagtcatggaagtgttaattgtatttaaaaatcactttgttccactgctattgttgtgagtaaattaaatgatcaagaaagcaactgtgagatttaacagagttttgcataaacaacttatgtttgagagtagtcctgccagcatattcctgccagaatttgtccttgtaacagcagacattacatacccatgcagggcttccagacatctaggaattaatacagattttaggacaacgatttctttgcctttcttccttctgttctcttcttccttccttccttttcttattcctcttctccttcatttgctcctttcttcatgcctgcctttctgcctgagttccttctttgaatatttgcagagccaagtgttcagaaatgcattccaaagtagctttctactgcatttaattttgtagtctatgacatttccttcattttctttcacttaaagagaggcaatgagacaattgtcctaacagttatgcataaactagtgagacactgatcatccgtgactcttcgggctttttgctatcagtaaggctcagaatcaaaggactggaaaagaagcaggagactggcttcttatcttggcactgacaaaaattaacattaggacgttgaataagtcatttatctcttctggatcagattccttaactattaaaacagaaagttagaactttgcacggtggcatgtgcctgtggtcccagctcctcaggaagctgagatgggagaatagcttgagcccaggagttccataccaaccgaggcaacatagtgcaaccccgtctctaaacaacaaaactacacaaagcaacagaaacttggatggtcttcaagtaccctctttcaatactgctcatgagagtatgcttattagacatagagattgacaggtacaatgtttaatgtggaaaaatttatagtttcttataaaaataaaagaaccacaataagagatagtgatgaggagtgaaaaaaatgtagatattggagtgcaacacatctaaaattaaatcttgctctgtaacttattagttctatgtggtaattcaacatctcattttatcttttaatctggcattgcattgttttcatagtaaagattaaatgagaaaaatagagtgtttctcacatcacttggtgtataataataaatcagcaaatggaaacaattattatgtatctgtttttaatagtttttcttgttgagccatttccacaggaatgactcaactgagaggagttttttattcccttttctatttatcttagggcaacagatggtggcttagacagtagtacttcccagggtatatcacaatgacagatttagtgacatgaactttatgaagtcctctgctaatagcttctctactgccagaatgcaaggtatcaggccaaaaggtgtgtgggaggctaatgactacgtttccacaaatattggcatgagctggatacttgattcatgagagcaacttcccaatttttggcaagttacctgtaaagaccatttagaaaaatttctggctttctctgagtagcaagtgttttatgaaacctgtagaatttttcaaacctacctaaagtataggcaatataatatgattggctagattatctatggaggcattatattgccaattcttctatctttggctttcattttcttagttgcttgcctatacagatggttttaatttggaccaaaatattttagtaatttaaaataagactttaaaacttgaggaatctttcatgatacaataacaatgattttgtttcagtgccccaatatcagcagattgtagaaaaattaagtatgaatagagaatagtaatgaatatataatcacaaatatgttaggcagtaaccttaaagattgagatagtttgccaaaagcagctcgcatatctttcattcttttacttatagaacagatgaataaaatcttgaaaacatttagacattatactaatttattttaccataaattcttacttaagaaaaaattgataattaatggagagaacaagaatgtaacctctacatgggcagagctctttgccttattcactcatatatccctagtatatagaacattaccaagcacatacttggcattaaataaatgcattgaataagtgaacaataccttgatgaaaacataaactctttgctaatactgccttcctaaatgtgttttttaaaaatcacttaagcatgctttcagaatctgaatcctgccatttatcagaaaaaatagcttaacctctttgaacttcactatttctttttctgtaatatgcatttctgttaacatgaggtaaaactaacttttatcactgtgcctggaacaaagtaggtggacattaactgtttgtggattttgtttcataaacacaatacctgcatttaagaaaatagggtcctataactttaacctagaaattgttatttataaaagaagatttgtatcaattctttatatcaataaaagaagcatatcaattgttattaacaaaagaaaataatggctctttgtgacagtttttaaaatgtagcaatagaagaagcaacgctgcctatgatttactacttaagaacaaatgttcatgatgatgcatataatctatttttcttaagcaaatgcataatttagtcagcatcatatgcagttttgaaaagtaaagcattattatttagatgtcatttctgtgatctcatgaaatatagaatccctggaatgagagaaaagaataaaatattctctttaacatatttcactgcataatataaaaggtctgtaaaattacctgaaaggcaaaggtgtcacaccatacctcagtggtgatttgcaccaaatacactgtctttcataaatttcctgagcaaacagagatttccaatgagaaatgaatactttaatcaatgcaacttttcaacctatttagtccctgatcttgaaaaattatacccagtcatgaaggatggaactaattttgaatttacagagaaactcataacaaatttaaataccataatatgcgtattatatctgcagctgtcagaaaactttatttacagtcagttgcctttctctgaataatcatattgttgtcctgaaagatatttaagacctttgccaaattagaggtatggcctatatttagtgaatcatcatcattgcacctccccagggagagcttagatgagagagctcatgttgtcgtcagctgttgttaagtggaagggatggtactgatccaaagactttaataaattgttattggaaatgtggtttacccaaagaccattgttctcaaaatgtattatcataacatccactggagagaaagtcatcaaagacgaaagatgtctgtaccattttatatgatcaagaaagactaattttttgctatggaaaagacatcatcattattttaggagataattagaataatgtttttgtttgtttgtttttaaaaactggactggtgatgtataaaatgctaaaaataaaaactggattgagtataaaataatgaagtcttctatctttgacaaaactttatatttttcatgctatgtaatctaaaagcatatctcatttgtagttataaattattttaaaaacctttcaaacataaacagtcatagagacaacagtacagtgatcctccataacaccatcatccagattcaataattattaaaattttgcaaccaatctatccctttctctttcccattctcttcgttgaattatttaaaatcatttcacattgcttcagtatctatttctaaaattgtggctatattactgcaaaaccatgatgcaattaccaccccccaaaattttaggaataattccttaatttaataccccagtccatattcaaattttatttatagtctcagaaacatctcatttttttctttttaaaatgtactttaagactggataaaactgtagaacaacatgttgatattttagcaaaattgctacaattggtctatattatagaacaagtctgtgtgatagaaactgtctccacggcactcaagtgagtggaatgatcgtgactgaattctatatatagaatctttcagtgagaagtaaaaacagatgttgtatgaagcatctgatgtttcataaatgggttattttatccaaaatttcagtgatcaatagttcatagattttttatattaggtaagttacttctccctcttgaaaaacgtgaaggaaaatattcaaacattcaaagggctttgaattattatgaaatgattatgaaatgatggtgctttggatggtggttataataaaatgtgtgtagttgtagcacctttcttttcattcctcactctcaaaacacatgcatacacacgtatacacagacacacacatacacacacagagtcatgagcaaaaggatttgaagatttgttagttcgaattttctgacaggttttattttataaattgagttgtacaggaggtactctgagagggtaagttgaagaattctccacaaatctaattagaaaatttaaaaagtgaaaatatattacatgtcatttgtggtctgatattttagctttaattacactgaggggagttataaaataggcatatcagtttcgctaaatattgacaccatctgatataacgtttgtagaactgggacaggaaacactattttcaaagttgtcaaactgaagtactatttttctccataaataaacaaaatggtagaagagtacacaaaaccataaacagattctacctgagaattaaaccactaaagtagaagccaagctttagatagctacaaaactggccattacttcttatacttcacttttctgtaaaatattctaggcagaagattttttaaaataaaatcaccaataaacaattttgtttaaaatttttatgagtctgtgtggtctcctaactctttaagaatgagaaatgtatttaaggattcatttaaggaagtagataaaggcatggtacagaatacctacatattaatttgtgggatgtgtagactgagttatgagaatactcaagttaaaagtcactttcgcattcctttcaaacaaaaggctttgtcaggtgaatgctatgttttatatttaattagcaataacaagtaagatttaattgtaaccaaactcagctatttagaagtatcttgtttgtaaaacagcgtagaataatgtcaacaatttagcaagaaaacccaattcacagcatttcagagcaaaaagggatagaggtcctctattgcaacttctgtgtcatggatgaaaacagtgaggctcaaaaagtttgagtgacacatcaagaagtggtaagagtcaagactagaactcatgtctcctactgcccagcctaatgtcctttatgctaatcacacatatttaacggctagggtgttgaatgatactagaatgaattatacattatataaattattcattatgcaaattaatttttgttgtctcagttttctgtattcatgacatatttgaatttaacaagattcatctggtacttctagctatttctacattttatgagttgtatacattttatatcaataagttataaaacaatagcagaagtcgcttcttttttccagatgagacagcaaaaccagaaactgacccttcaactttgaagtagctttttgtttgtttctttcccctttatataggatgtcttgaagccgagaaggaagagctgttggagagacgaggagttaagagttcattcggctgtccagatgtatccaagtaccctgtgttatttggcaataaatacatctgggcaactgactgaacttttcacttttcatgactcagctggaaccctccacaaccagaagagcctgttataaagtgaaaagtttgtgatctcttaatctaatgaaatgggaagtaggaattgcttgtgggtgaagagacaccattgtaaatgtaagtgggaatgtattttagtatgcaactaaattgatttttaagtgtcttgacaaaagataaagaggatttttctagcttgcaaaattaaaatcaaattaacagaaaattttgatctgctcccatcagtgacacttgtcgtgtacttaactcaccggtataaaataactattttatactgtgatggagagtagctggcaaatgctggcaaatattatttgtatattacaatatttaaaagatgtctaacctcaagctatggctatgtacatggatccatctaatgtatttaccccaatcactctttatctcatgatgcaatttcattttattcatagcaattatcacgatttgaaattatcctacatctttgtttaaatgtttattttctgtatctccagctagaatgtaagctccattggagcaggggcctggtttaccttgtttactactacatgcccagcatctggcatagtgcctggcatgtaataagcaatcgataaatatttgaatatatgaaactactattatacagcttttggtcctgcagatcggttggagttggtctccaacacagatatttagcatatggtttgctccattagctctgctctttgaaaaccttcagtttgttgtgctatgtgcatactaacactgagataattcccagatagttctgctaccacctatggagaaagcagtttcaaattgctgggcattctgcccactaaggcaaattctctccatgtctgttactaccatcatagagtgatttgcaatagctactttaagtctatcaattgggaagtgtatgtttttaaagtattattttatgtaaatggaataggtctagctgtgaaaaacataattttatatgctgtagattttgagttaactgttgtgtgaattcgcacataatttaacaataatcacgctcatggaacatgtcaaacacaagcagaggtatttagtaaatacaaatgaggagaaaaaaatttttttttccatttgaattccaagcataggaggaacaggtaaatctgtttaaataaccacttaacattatcttggaggagagagaataaaagtaatgagcctagacttgcattcaaattgaataatcactggtggaagagtagtctttaatttcattgatgataataactgaaaaactttctatcaaaataataaaaattatctgatttgactataattagcaaaggtgagtttttagtatgacaaatgtatgatttattagaaaatcgctagagtacatttgaagttgaaaggaaaacttcctacaatattcattagtcctaaggataatttttgaattaaatgagctcccccaaaattattgtaaatctgtgccacattaatataatcttcccaggactaatctgaacatttatggctaattcatttttgatttagacatctgctaaaagctcactgggtataataactagagggataatatttgaattatgagtcataatttctgaacactgaaaattgataaaaatcaaacttctatatgtattattatttattcaatttttaaatgctttgttataaaaagtgagacagaagtgatctagttgactatattctacaatttcttttttttttgagacagggtctgttgccctagctggagtagaatgatgtgatcagggctcactgcagcctcgaccacctgagttcaagggatcctcccacctcagcctctcaagtagctaggaccagaggcacacgccaccacatctggctaattttttgtattttttgtagacatggggttttgccattttgtccaggctggtcttgaactcctgagctcaagcaatccacccactccggcctcccaaagtgctgggattataggcgtgagccatcgcacatggtctattctacaatttaaaaaaatttagtgtgaaatttagtctttcagtttgatagaaaatatgctgcatcattataatgtgctaacggaatttccagaaatctagtgtaaactataccttttcatgggtgaatctagactctccaatttttgttaaaacatgagtagaaatgctggcattttttcttaagactcatcaatattatcttcaaccaggtctgggaaaaaaagaataaaaagtagtgtgagagcagaaaacgtgattgaaacacgaccaatctttcttcagtgccaaagggtggaaaaggtaatggtaaaaatgaattataaatggttagctttagaagttgcaaggcaagcgttttcaataaagatgcaagcttctatcctctccaagcacaatttgggcaaaaccacagctcttcctttattcttagatagtatcttttgacttcacaccttaaatctcctaccttcccatcaatcagccaattactttgtacccaggacttggccaaggattgtggatgttacatggaaagtacatctatatggctcttctgctcaaaatttgcctttagtattaatacaacacctttaaaaagccttgttcgtgccagcctttgtgccccacagttttttgttttctttgattttgttaatattttttgagacagggtctcactgtgtcacccagactgaagtgcagtggtgcgatcacggctcactgctgctgccacctgctggcctcaagccatcctcccacctcagtccccaagcccaccccacagtagctgggactacaggcccgcaccatcacatggggctgattttttttgcagagatggcgtcttgctctgtcccatagtttttaaacttattttttaaaattatttttgcttccaaggtgattattgatgatgacttttaagtatttctgtgagtgatacggattctgatagtttgcaatttatttccaaatttccagtggagattcgattttggttcagttgttttggagtgttcacactattttggatgacatatgctgtatgacacatggcatatagccatataagcatagatttcataggcatgaattaaatataatactcatggtatggattcatacttaattaaattttcacattaattgaggttattctgcaatatcttgtgtaaaattgtactattgaaaattatgtgaaaactaatgtttctcccccatttgtcttagcaactgtagttactgttattgatgtctgaagattttacagtgctttagagaaggcatgaaaagatctgtgatttacactgtagaaaggattgagagattggtctgagtgtgtatttagtgactagtgatcctgatcttatttctatgatttaatctgtgattttctcttcatacttgagacagctaattggttttaagttaatcaatctttttctggacacgaaattataaatatgtatgactacacaaagtaacacagaaacacacaaatgttatataagttggttgtaattataaattatattaattttatataattatatatataatataatataaattatattaatattaatattaatatttaatatatataatataatataatataataataatataaaataaataaataaaataatataataatattaataatataattataattataaattataacacttattaaattatcaaacctactttcaaggcaaatattataaaatctcattaaaaattagtcaattattccgtcaattatctcacaagtgattttaaaaaaattttacaaaacacaatccttcacaaatttgaaaacttgaatttataagcattcttttgtgttcatgcaactttaaaagttccattacacagatcagaaagttccatatatgcatatcagaaagtttcattagagttgtttcgctatgtttttcagtttctgttattgattgatcttatccaagacaagaagttttgcatcaccttcccttttagtagaattactcacagaacatttcttattgcaaaatatcatcatcacagtggcctggccatttggggaaacatgtaagataacataatttatgttacataattcatataatttattcccatcacaccatgttccgaaactcttaccaccagttcacaggtattttctatcatgtctactcagtgttcatgcaaattttaacagcatgaggagacatgattttgcctacaagtcatttttgttaataaattggaaatctatatacataatattttttgtgattattactcattcttctcaataaaattggaacttagaaaaataaatatttgatgtttaatttttctgcttatatttctcaggaatatacatgtaaaaaagcataaggaagctggctaatttttaaaggaatataatattttgagtaacagtaatggaattcatccatagctaaaaatgtggctaataaagtgcttcatgagatgattattgtatcagcttgttttgttatactctattggagcacagcatatttcactctatctttgaacctttaaaaattatactaatatttggatacataaaaataaatattgaaaatcattttaatacttttagcataaggaaaaaggaaaaagtttgatacttattgagggctaagaagcaggatgggaccttttggtttcccttaccattttttctgtcacttattttcagacctcccagagaaagagatgtctgtgttgtctggtaaaatttatgggacagtattggcctgactaatggtcagggtgatatagctctctctctctcacacagaatattttgagttcctagatattggaaggccatattttatgtattacggtagtaaggggatgatttggagattgatttttgtgtaggtagcactgatagaactgataaatgagagctaagggatgaagaagggagaaaatattaactatgtatcttgagtgacaaggatagtgctattaaatgagatggaaaacacagggagatgtgatttcttctggttaaattttacttccaaatttctagaaggagctagaagcacactaaagaaagcttatcaagacagattttcacgatcatatttctttttcttttttttttttaattatactttaagttttagggtacatgtgcacattgtgcaggttagttacatatgtatacatgtgccatgctggtgtgctgcacccactaactcgtcatcgagcattaggtatatctcccaatgctatccctcccccctccccccaccccaccacagtccccagagtgtgatattccccttcctgtgtccatgtgatctcattgttcaattcccacctatgagtgagaatatgcagtgtttggttttttgttcttgtgatagtttacagagaatgatgatttccaatttcatccatgtccctacaaaggacatgaactcatcattttttatggctgcatagtattccatggtgtatatgtgccacattttcttagtccagtctatcattgttggacatttgggttggttccaagtctttgctattgtgaataatgccgcaataaacatacgtgtgcgtgtgtctttatagcagcatgatttatagtcatttgggtatatacccagtaatgggatggctgggtcaaatggtatttccagttctagatccctgaggaatcgccacactgacttccacaatggttgaattagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttaagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtgctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccgtttattaaatagggaatcctttccccatttcttatttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtatttttttccaatattgtgaagaaagtcattggtagcttgatggggatggcattgaatctgtaaattaccttgggcagtatggccattttcacgatattgattcttcctacctatgagcatagaatgttcttccatttgtttgtatcctcttttatttctttgagcagtggtttgtagttctccttgaagaggtccttcacatcccttgtaagttggattcctaggtattttattctctttgaagcagttgtgaatgggagttcacttatgatttggctctctgtctgttattggtgtataagaatgcttgtgatttttgcacattgattttgtatcctgagactttgctgaagttgcttatcagcttaaggggatttggggctgagacaatggggttttctaaatatacaatcatgtcatctgcaaacagggacaatttgacgtcctcttttcctaattgaataccctttatttccttctcctgcctgatcgccctggccagcacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgcgagtttttagcatgaaggattgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatatcggtctaaaattctcttttttggttgtgtctctgcccagctttggtatcaggatgatgctggcctcatcaaatgagttagggaggattccctctttttctattgattggaatagtttcagaaggaatggtaccagttcctccttgtacctctggtagaatttggctgtgaatccatctggtcctggactctttttgcttggtaagctattgattattgccacaatttcagaggctgttattggtctattcagagattcaagttcttcctagtttagtcttgggagagtgtatgtgtcgaggaatttatccatttcttctagattttctagtttatttgcatagaggtgtttgtagtattctctgatggtagtttgtatttctgtgggatcagtggtaatatcccctttgtcattttttattgcgtctatttgattcttctctctttttttctttattagtcttgctagtggtctatcaattttgttgatcctttcaaaaaaccagctcccggattcaataattttttgaagggttttttgtgtctctatttccttcagttctgctctgatttaagttatttcttgccttctgctagcttttgaatgtgtttgctcttgcttttctagttcttttaattgtgatgttagggtgtcaagtttggatctttcctgctttctcttgtgggcacttagtgctataaatttccctctacacactgctttgaatgcgtcccagagattctggtatgttgtgtctttgctctcattggtttcaaagaacatctttatgtctgccttcatttccttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtcctcttggtgtagagctgagttcaattcctgggtatccttgttgactttctgtctcattgatatgtctaatgttgacagtggggtgttaaagtcctccattattattgtgtgggagtctaagtctctttgtaggtcactcaggacttgctttatgaatccgggtgctcctgtattggttgcatagatatttaggatagttagctcttcttgttgaattgatccctttaccattaagtaatggccttctttgtctcttttgatctttgttggtttaaagtctgttttatcagagactcggattgcaacccctgcctttttggttttccatttgcttggtagatcttcctccatccttttattttgagcctatgtgtgtctctgcacgtgagatgggtttcctgaatgcaacacactgatgggtcttgactctttatccaatttgccagtctgtgtcttttaattggagcatttagtccatttacatttaaagttaatattgttatgtgtgactttgatcctgtcattatgatgttagctggttattttgcttgatagttgatgcagtttcttcctagtcttgatggtctttacaatttggcatgattttgcaatggctggtaccggttgttcctttccatgtttagcccttccttcaggagctcttttagggcaggactgatggtgacaaagtctctcagcatttgcttgcctgtaaagtattttatttctccttcacttatgaagcttagtttggctggatatgaaattctgggttgaaaattcctttctttaagaatgttgaatattggtccccattctcttctggcttgtagagtttctgccaagagatctgctgttagtctgatgggcttccctttgagagtaacccgacctttctctctggctgcctttaacattttttccttcatttcaactttggtgaatctgacaagtgtgtgtcttagagttgctcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagaggtagatttggtcttttcacatagtcccatatttcttggaggctttgttggtttctttttattcttttttctctaaacttcccttctcgcttcatttcattcatttcatcttccatcactgataccctttcttccagttgattgcatcggctcctgaggcttctgcattcttcacgtagttcttgagccttggctttcagctccatcagctcctttaaggacttctctgtattggttattctagttatacattcttctaaatttttttcaaagttttcaacttctttgcctttggtttgaatttcctcccgtagctcagagtaatttgatcgtctggagccttcttctctcagctcgtcaaagtcattctccatccagctttcttccattgctggtgaggaactgcgttcctttggaggaggagaggcgctctgcattttagagtttccagtttttctactctgttttttcccatctttgtggttttatctacttttggtctttgatgatggtgatgtacagatgggtttttggtgtggatgtcctttctgtctgttagttttccttctaacagacaggaccctcagctgcaggtcttttggagtacccggccgtgtgaggtgtcagtctgcccctgctagggggtgcctcccagttaggctgctcaggggtcaggggtcaggaacccacctgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggttccacccagttcgagcttccgggctgctttgtttacctaagcaagcctgggcaatggcgggcgcccctcccccagcctcactgccaccttgcagtttgatctcagactgctgtgctagcaatcagtgagactccgtgggcataggaccctcggaaccaggtgcaggatataatctcctggtgcgccgttttttaagcctgttggaaaagcgcagtattggggtgggagtgacccgattttccaggtgccgtctgtcacccctttgtttgactaggaaagggaactccctgaccccttgcacttcccaagtgaggcaatgcctcgccctgcttcggctcgcgcacggtgcgtgcacccactgacctgcgcccactgtctggcactccctagtgagatgaacccggtatctcagatggaaatgcagaaatcacccttcttctgcgtcgctcacgctgggagctgtagaccggagctgttcctcttcggccatcttgagaagtttttgaagaatatattcttaatttctttttcaaagcattgatttgaagccatgtctactccaagagggggaaatttggtataaaccatgtataaataaaacatatacagaaaatttttaaaaactgcgatgataaataattgaaaaatctgctctctttgccatattttatcacttacacagtataacatgcttacctgtttgctgaattaataactgtttcttatcaccattaagtgcatttaagtttatttaattggttactatgcaagttatttcgatgtttaactaattttctctttcttctttttctctccccagaaaggatgatatgatgaacctagcctgttaatttcgtcttctcaattttaaactttggttgcttaagactgaagcaatcatggtgaacctgaggaatgcggtgcattcattcctgtaaggatgttactacttattattttagtgaaaagataactttgcttggtagcttgctcaacatgttaaaaaaatgcttctatatgatcagctatatttgcctaaatctgcataaatggcttgcttcccaaaagactaatattatgggtgtttcctattcaaaaataattaatggaaaaaaaaatttggactctaattaagcacttgagctcatatacttaaacaagtaatatggtgataatgccctaaattcaaataatctcaatgttcatggctactttttccatgggtaaaacttagaaaggaaaaatttctgtccttttccttcttgcatgaactgaacagttaagagaatgaaatgcctctggttttgtgaagaatagttgaggtaggaaaagaaaaggttggaagttaggggatagggcttggcgatgtagctggatgggaaaaaccaatgtcatcctcagaagtattgatgcagtgacccagttgcagccaataatatacaacataaagggtgtaggtaaagatacaggagattcaaataataagcaattctaaatttgatctaatccaggtataccttctttttacatagaaaaatgttggtttcttccgaacctgctttttgaggaacgaagcatagaaaaaaatgatccaaagcaatgtaaactctgattggtatagttgagaaaccccaaatctccttgctcctaggtagtctcctttatgattcttgtaaaagagctcacccaggaaaaagtttacaatgtggtggagatataaagttcagcaacattggatcctctgcagtgtgcatcactgtggcccatcttgagtgtcattgttgtgatgatagtttcaagtatggaagagtccaagagaactagagcagacaactgggaaagaaaagagtgaaggacagtgataaagaagggaaaagaagagttgggtatgggaaaatgaaaggacaagtgttcctgctccatgagcctgtgccaacttagtatatagccattggcccatataccaaagtgtaggactgccgtaaagggcaccaaattattctgctatgaaattaattaaagaattcatatacaattgttttaaattctattgagagaaacaaggaagaattcctgtcttctaacaatgtcctaggtcatagaaaaactcagtagattttaaatatattcaactttttaaattaaattatcattttgtttatatactaagaatgtaaagttatgttttcattaaaactttagtagcaatgagtaaattatatgcatttcagagagaaattatgacttttgtatacatattttatgagattcctatgagcttaaaaacaattaggataaactttaagagcaagacctaaattactcctcttttgtaaaaggactttataatttcactgagcatgttaagtattaaaaattagatttaattataatacagccaattcttcattacaaaactgaagaataaaggattaaactttaataaaaatcataatatcttgtctataagtagtgctcaataaaaatttattaaactgaatttaattgaaaccaggaaagtgaagtaaatactttatcaagatttatcctaacaccattaccttattttgtaattcacaacagatatgtttacatctgacaagactccttccttcaataattcagtatttgtcttacagattcttttattaaaaaaaaattttctgaccagtagggataggctagataactacttgaaacagtccaaactcaaagatactcaaattataaaattcataatttgacataattttcttcgtatatgtttctgttatatataatttgtcctgtactcctctaccatttttagagacatatgaatgaatttcgatgttttcacaatttacttagaacatttgaggcagactgcatattcccctaggaccttattctataggtttaaggataaatgtatttgtcattctgcaatcaacaactgaagacgcagtttagtatttgagataaattcttgtgggactacttgagatgatcttcagctaatttaaaacagaacattgttttttaaaatgccagcaggacaagttttttatcagctaggccagaaaggactctggaaaacgtgctggatttaagattacttttttgagtccagttcttcacacatagacatcgtctcaaaataaaatcaagacttaaattatcctggcaaattttgaaatacatgagttgggatatagcaaacataaaatacttttgtttaactacaaagcagacagaaggtacctccagcatttactgagggcctcttatgacacaggtattaaaggttgacatatatcatttaattttcacaacaaccatatgatggagattgttcttgtacagatgaagttgatgttctgataggttaagtgactggtcaaaaattactgaagtcagatagccaggacattggccacatgccacattcaataaatacagtgacagagtaatcaaagctgagagcgaataacttgcttctgtttatttggtcctttatttcactaatttttactcatattaatcacagattaattatgacatagattttggaatcctgtattatttttgcctattttttatgttttgggaaaataatacatttggaagaatttactgattacttctcatcatttgataagaattacgatttctctgataatggtagtcagcaatgagtccattaaatcacacatatattatccctgcctggagatactatcttcagttcaaagaacaagtgactgggataatgacataaaaatacataatatggggaacacatagactctgaatgttatgtcatgtgttccatctccctaatttcagaaagaatcatccttcaactatcttgcatagaaaattatgtagcatatattgtgcaaccagaggcaatttcctcctctataaataatatcaaggttgaacaaccactacatataggaaatgtatcctcatgttgctgtttaacattaattaaataactattactacacatggaataaacataaatcagtcattcacaggtaatatttcttagttttaagcaggaaatattgaacatgcttggctgtcttgtctattttatgaaggaaaaaatgtgtagctttattagacattttaggagcttacactttgagagaatacttatgtacataactcgaataaatctcatgtcgccatagggggatattaatttagaatgtgcaaatgacaaccacatccatctctggcaatagcctgccacctggcctgaaattcctactggtagaatctaccaaaggaccatcatgagaaatgtacatttctaatgtacttaaatgacttaagagatttagttccagtgcatgaaaagtaacaaatccataggcattaatcatcaccacaaatcattatctagcctagaacaaggcccacaaaatataagacaagacagaaatgtggagagtggcaggtagaaggaaagtttatagcacaaaacgttaagaaacaattgaaccagcataatggcactttgcaaatgtgagaaggtagaaaaacttctgaaaagaaatgaaagggtattcttgtcaaaacccactgtacctcttccagacgctttgccagaatttgatctgatggcaacttaattccttcttagccttggatcaatagaatgcaacttccagtttccttgttagggtcatggatgctttaagaaaatcccccttcattctgttatcagctgtctcagaacatatctaaaggaatcagtattttaaaaatataaagaatagactattacagcaaatcaagcagtactgtggtttcagatcgcagtaaaagtttaaaacatagactttgaaatcagtgggacctgagtatggaccctggccccaccacttactggctgtttaggcttgaaaaagttacttaccctttctgaactttactcagtcttctcatctacgtgatggatataaattagaactgacatcatgaggttgtttaataagatcaaatgagattatacatatatgtttcagcaaactaagtgcctaactcataataatcactcaataaaagttggtaatttttggagagaaagaagaaatactgagattaattaagagagtagaaataatgatgatgacaatgatgctgatgatgataatgatgacaatgatccatgaagaagcagttgttttgcatgagcaacgtattgtgtataagtaatataatatgtacctgattgtttttttttttcttaattttcagtgtgcacctaattggcctattggtttggcaatgtgatatttctgtgagcccagtagcagctatagtaactgacattttcaatacctccgatggtggacgcttcaaattcccagacggggtacaaaactggccagcactttcaatcgtcatcataataatcatgacaataggtggcaacatccttgtgatcatggcagtaagcatggaaaagaaactgcacaatgccaccaattacttcttaatgtccctagccattgctgatatgctagtgggactacttgtcatgcccctgtctctcctggcaatcctttatggtaagtacaattttattcacttttcaatctcgtataatgtcataaatttgtgtcatagtaaacactcataaagttaattattttacttgtaacatttggaaaaagaaaaaagcaaatcgtgtgacagaaggagttggatgtatgtatcatatttattaaacaaatcagtaacagtcttccaaaagcaaaacatacattttatatatattaaaatcatacatagatgctctcttgcttagtgtctttgtaaacaatgaatgaacagttagttgccttacaatgtactgaatgagacattaacagaaacatctttcaacccctgtgttctgggcagtacacatacctactaccatctctgatacaaagaaggaaaaaccggctcatcctctttaataaatatattttaagaaatccttttttaaagctgccaaactaagtggttgacacaaaacaggcactcaataatagctattcttcttgttcatggagtctataatttgtgttattacaaagagacaagagatagcaaaattaattactaagtatataagtgtaagttcatatcatcactttaaaaattcaggcattgaaagtttcaatatattgattttaaagaggtttttaatttttcttttgattttcttccatcccttcattctgttcattttaacctaaggttttgtttctagctaatatttatgatgaacaatcaaatagtttatacaactctacaaagtatctttactaggaagttggagagcccagtttgaatttaattgctaatatgcttatctcacaaaggagtaaaatagacttccagttgcctggagtgtataatggaattagactagaagaaataatattgaaagtgtatctagttgtcgaatcctaaaagaaaataaatgcatctagaaaataatctctcatgtaatgtaaaaattaagtagcctgttctatacctatggcaacagtagattatcttaataggcattttataaagtgttctcagaatatatgcttttcatattcttcatcgagtttcaatgatgcattagccttaaagcactagtattttatctgctcagtgggcattttaccactctattgctccaaaattaagaaaagattactggaatgaagtgaaactatgatttagaaggtatactgtgttctgtggtgtctgtttcgccagcttctccctttaaaaaaatgtgagtggccaaataatgatattagcataaatccaagtctcttaacatatctattcccctgcccaaataaacaaagaacaatataaaaaacaaataaaactgcacaataccaccattaagtgtggagaacattcaaatttcaaattacctgtaagtaggaaaacaaatgggaaataacattgaactatctattagacttctaccccatgctgttgcgtagaagaagagtagtccaggaaagatagcatgaaataaactagaggaaagctattaggaagcctaagattgatctaaaaccaccacaggtggccgggcgcggttactcacgcctgtaatcctagcactttgggaggcccaggctggcggatcacttgaggtcaggagcttgaaaccagcctggccaacagggtgaaacccagtctctgctgaaaatacaaaaaaattagccgggcgtggtggtgggcgcctgtaatcccaactactcgggaggctgaggcaggagaattgcttgaacctgggaggcagaggttgcagcaactcgagatcacaacactgcactctagcttgggcgacagagcaatactccataaaaaaattaaaaaaaaaaaccaccacaagcaagtaagtctaccccaagtacgaaaatactgaaaagtttctctagaaggtcagctttcagataaggtactgaaaagtatgcataagactcaagaaagcagccttggaaaattaactctttggaggtggaaaaaggtaaaaaaggaagcaagaggtgacttgaaaaaaaaaaagcacagtgaaaggaaaaagaagcaagagggggaaatttatcatcttacagtacagaaaatgtcaaaatattaggacccatcacccctccctctactgtctcccactgtcccccaaaggccctccagtaaagaaaccatactttgatacacaaagaaaagaggatgctcttgagcttggaattttggaagctacctacaaactgtcagtcatgttcatagaaattctgagatgcaaccaatcttcatctataccaagctactatagaaaaaaatcagaatatgagaatagaaagaaggcatttgatgaacattccctccaatacagaatgatcaagccgaagaatatgctagcaaaacacttcaaaaaaaatctgcaaacaagcatgttaaggtattaaaaaatgtactttgaagtagtaatctaataactaagaatagaaatggtcaaaaaaataggacagcatgaaggaaaattaactgaattcaggacaaataaaatagaagaaaaatacatcatatcaggaatgaacataaaaagcacccaacgaagaattgattcatatgaagcttaataaggagtatagaagaaaaacagattaccaaagagaatgaagatgagacgaagaaagaagtaaaatatgttagagtgtggttgaaatagaatatcagcaaaaatgattaaatgtatgtatgagaacccttgaaaaggaacaaataggaaaacagaattaatatttaaaactataatccaataatgtcttccagatatgaaagagagtctgactctacatattgataggttcaacccagtgctagaaaattgacctgaaacaatgaactctgagataaatctgagacactggatttttcaatataaagaaaaaatcctcagggtttccaaagcaaaaagagggaaaaatttacaagagcaagagtgttagactgccttacatgtaaaaaaaaaaaaaaaaaaaaagacaaaacaaagcaatagtgaaacaatactatcaaaacacaaccatttataggacattctttgaaagacaaatctatacagacagaaaacagatcaatagtttcaatggctgaaagtgggaagatgacttcaaaaagccatttattttgttattatgaaactgttttatatcttgattgtggtgatggttatacaaatatatatatataaatttgaagagctataaattctagtatacagttttaaaaaggtgaattttactctatataatagatgccataaatttaaaaatatttttaaatacacaaaatggtttggaaatatgattctatgtctagacaagttgtccattaaggctataaaaagtttaagtcttttaaaattcagggaattatgtaccacaagcccttttaaaaaataaaatagtggaggtcaggtgtggtggctcatgcctttaatctcagcactttgggaggcctaggcgggcggatcacttgtggtcaagagttcgagaccagcctggccaaccggatttctttagtagagacccagtatctactaaaaatacaaaaaaattatctgggtatggtgctgcctgcccgtaatctcagttccttgggagactgaggcaggagaatcgcttgaacccaggaggcggaggttgtagttagccaagattgagccactgcaatccagcttgggcgacagagggagattccatctcaaataaaataaaatagaataaaataaaattacaaaataaagcaaaataaaatagtggatgggattcatctaacaaagggatgactgggaaagtttcatcaaaaagactgatgataaacatttaatatatttaactttagagctaaaataaaagaaatggtattttaagagcagaaaaataccatgtcatataatatatattatgttttatctgttctaacaatctggaaacaatgcaaccaaaaattaggaagagaaagaggaaggggaagaggagagtagaatcatttcgttgattcttctataaacgaatgataagaattaaattataaccataaaaaactggcaaatcagaaagtaatagaattaataagaaaacatgggtctagggtcattaagcatgttataaatataaagttaaccactagaacaaaaatacacacgttcttaaacaccaaaggaaatgtaattagtagaagagccaaaatcagtcaaatagaggaagaaatagaagaaaataaggctgggcgtggtggctcacgcctgtaatcagcactttgggaggccgaggtgggcagatcacgaggtcaggagatccagaccatcctggttaacatggtgaaacaccgtctctactaaaaatacaaaaaaaatagccaggtgtggtggtgggcacctgtggtcccagctactcgggaggttgaggcaggagaacggtgtgaacctgggaggcggagcttgcagtgagccgagatcgcgccactgcactccagcctgggcggcagagcgagactctatttcaaaaaaaaaaaagagaaaagaaaacataatgcacttaacattatatgatgatataatatgacagagttaaaatcaaacatatcagtaagtaataatcataaactcgaatgaagaagctatcactctattaaacataaaagatttttaattaggcatatgaagaaagacccaagtatattccatatacaaaagtaacccttacaacccagggattagtaagcgctaaaaataaaggggtaggtgaaaagtataccaagcaaatggtaacaataaagcagaaattgcgatcttgatatctgacaaaagaaatttgaagtaaaaaaatggtaagactaaaaaagaaagatgcttattaatgataaaagaaagccacaattaaagacaaagaaatggcagttaagaatatctctgcatccaataacacagaaatgacttttataaaggaaaatctaaaaacggtggaagaatacatttatgggtgcattctaatatgggagattttaatatactgtactcagtacaagaaagactggaccaaaaacaaagaatatatatcttatgaatgtatattgaactttacactcttatcgtagaaagtatagcttcttaagtgcacatgaagtacgcaaaatttaatcatatattaggtcacaagaaaaggttaaagtagaaattttataaaaagttctttttgataacaatgtaataatactagaaagtactaacaacaaaagctttaatatcatcttggaaccataaattttaaacagctcttgggtgaaaagaagaatgcaaacagaaattaccaaatttattttaaaatatgatagcataaacactgctttatcaaaatctataggatacacataaaggagtgaacagaggaacattcacaattccaattacatttattagtaaaaaaccaaagtatatgaataaatttccattaaataatcttgaaaaaggaccaaaaaagagaacaaaagaaagcacaaagcagaaaaaaaaaataataaagataagagcagtaattgactgggtagagaacagtagagaataaaaggacagtatacctaatcaagaaattaaactcctggcttttttttcttttcttttcttttctttttttttttgagatggggtctcgctctgtcacctaggctggagtgcagtggtacgatctcggctcactgcaactttcgcctcctgggttcgagtgattctcccacctcagcctcctgcgtagctgggattacacacgtgcaccgccacactcggctaattttttatgtttttggtagagacggggtttcacaatgttggccaggccactcctgacctcaagtgatccgcccgcctcagtctcccaaagtgctatgattacaggcgtgagccagcgcgccagggcactcctgactttttaaaagatttttcacaaaatagaaaattgctagctagttttaacaaggaaaaaggaatagagcataaatatatcaaatataatatgagagggcatataatcatagaaaaaaataaattttgtaaatcacaagattaccttgtagatttacatgcaaatcaatggaaaacataaaaaatagataatttatcagaggaatccaggttaacaaaattgaccccatgagatataaaaggaaacagaccaatttcagtagaagaaatagttatcaaggaaacttgcacaaaaatccctccggactcaaatagtttcactgggctcttctagttataatgcttcaaaaattgtttcagagcattgaaaacaaagtgaaacttcctaaggtttatatgaagtgagaataactttgatacataaaccaggtaaagacagtatgaagaaaggatgctatagaccaatgtcacttatgactattaatgcaaaaatactttataaaatcttagcacacagaatccaatgtcatgtgaattgaaaaaactcaaagttgtagaagcagagagtagaacagtgtcttccagaggctggggtgatatggggtggggaagggagataggaattgttgtcaaagagtacagtttcagttagacatggtgaataaattctggagacctattattgtacagtataatgacaatgcttaataatattgtattgcatgcttgaaattgttaacagtaggtcctaaatgttccagtctcaaaaaaatgtatgttaggtggtggatatgttaattagcttgatctaatcatttcacaatgcatagatatgtcaaaatatcacaatatacaccataaatgtatactaattttaattgtcaattataacttaagaaaactgaaataaaaaagaatccaactccacattaaaaaagaatacaccacgaccaactgggtggtcacactattattactattctagtaacattgtgttactagtaacacaggaacagaaaaccaaacaccacatgttctcactcataagtgggagttgaacaatgagaacacatggacacagggaggggaacatcacacaccggggcctgttggggcatagagggggcaatgggagggagagcattaagacaaaacctaatgcatgcagggcttaaaacctggatgatgggttgatgggtgcaggaaaccaccacaggacatgtatacctatgtaacaaacctgcacattcttcgcatgtatcccagaacttaaagtagaaaatatatgtatatatacacacaccatgaccaactgggtggtcacactattattctagtaacactatgttggctcaatatagggaaatattttcctaaaatatattaacatatgacattaacattattactaataagcacatattaaaaattaaagctaaaatataatgaatattgataattatattaatacattattatatttataacattaacataaaaatattaatttaaaagtatatgatttatctctaaagatactgagtgaataaacatttgccaaaatttatagcttttttgataaaaatccctcaagaatatagaaattgatattacttttttactgtgataaaagataaataactttgtcagacagctggcatcttagttcataggaaaacaataaaagcacttgttctaagatcaggaaaaatatgagcatgccttatgtttccatttccacttaacattttgctgtagatattagtcaatgcagttagataagataaattaattagagttataaaaactgaacaagtataaccatctctttttccagtgtatctcacacttcataagaaaatcaggataaaactattaaaaaataagatattcagtgagatagcaggatgtaacattagcatggaaaggtctatagaattaatatacccaaataaccagttggagaaacctccatttaaaatagcaaggaaaagagaatacattaaggagaaaatatgcaaaatctattgttaggaaaaattaaaaacacccctaaaagacaaatgattgatatcattggcataacaacaataataataataacaataatacatgccaaacaccaaaagcaaacttcaaaaacaaactcatagaaaatagttgcaaaatatattgcaaagggctaatatctctaatacataaacaattctttataactgaagtagaaatccagcactcaatagaagaaatgaactaaagatgtgagtaggcaatttggattttttaaatatattttataggccaggtgcggcagctcacacctataatcccagcactttgggaggctgaggcaggtggatcacttgagcccaggagtttgagaacagtctgggcaacatagtgaaaccccagtctctccaacaacaacaacaaaattagccaagggtggtggcgggcacctgtagtctcagctacttgggaggctgagatgggaggatggcttgagccctggaggctgaggctacagtaagccattttcatgccactacactccagcctgggtgacagccaaaccctctctctctctctcaaaaatatatattttaaatatatatataaacatgtgtgaatatttgaattatatatatacacatttatatatatatatatggtccttaaatacatgaaaatatgtttaatctcaatcattagaaggaaaatgcaaaataaatgacaccatgataccattttttaacctatcagattggcaaaatatgacaagcttgaattgcactgtggcaaggctatggggacatcagcactctcgtatattgctggtgggaatgtcaattgctacaaaccattttggaggaaaatctgacaacactgaaaaaaactacataagtaattatgttttaactcagaaaactaacatctaaagtgttcactggatgataaacgtgtgttaatagcaacatatatatgtgtgagattattcatataagcattatttgtaattgcaaaatattctaaacaatctaagttctatatagagagagattaattaaatatattacagactatccacaaaatgggatttattttttaaaataaggaatttctttattacctgatacagattataaacagaatccaaataacttaattctatttgaaactaataacataaccacactgaagtacaaaaaaatctgacccaaataactttaatacacaatatttgtacaatatacattctgtctaaatataaataaactctaaatagtaggtttgctttttattggtgttatgcaatagtgattgtataacaccaccaatattgttagtgtactctgagattgtataagtgtgtaggtataccaaagacaatagaagccagatttctcactgttgcataaggtagttaaaaattcgaaagggggaaggaaataatgaactctacatcattggactaatattcatgatatccgtgtaaattcatagtggtagtaggtgatagttagctagctagctagctagagagataacataatatttatatgtatactttgaattatgtcctagtctgtccactaagagggcctagcagcagtgtcacatgcgtagcaatgagcgaaaacagaaacagaaactccttggggaaatagtcaatttcaggaatgggacagaaaaattacagcatgagattgggagggccgggcacggtggctcatgcctgtaatcccagcactttgggaggctgaagcaggcagatcacgaggtcaggagatacagaccagccaggccaatatggtgaaaccccatctctattaaaaatataaaaattagccaggcgtggtgacacacgcctgtagtcccagctactcaggagactgaggcagaattgcttgaacccgagaggcggaggttgcagtgagccaagagctgagattgcaccactgcactccagcttgggcgacagagcaagacgactccgtctaaaaaaaaaaaaaaaaaaaaaaaaaaaaaaaaaaaaaaaaaaaaaaaaaaaaaaatatgagattggaacaccttttcagctgaaaagtaaggaagtgaacatagaataatggaaacattaaaaaaaaaaaaacccacaggagccagcttaacagagcccccactgaccaaatgtgggaacattcaaacattaagtttaaataagagttctgatgacaacaaaaatagagtaagcccactaaaaactatctcttcttttgtattcaatcaataactctgtaaaaaaattcaaaagcaactacctgaggactcagaaaaataaacaaaaacagattgaaagggaaatcaaaacttagagaagtaacctatatgggaatgaggttcccttttttttccctctcttttctctagtagctttgccccaggcaggactcagtcacttagctgcatggtggtagcccaggagtggtttaatccttatggaaacccaatctttccagccagagtaactgacaaaaggagtctctatggtctccctaatgtaggggaaatacagttttccctcccttttttgtctcctggctttgtctggagaagactctagtcagagagctttgatagtatgagcactaaaattttgaagaaaccttttctttctggccagcagaccagaaaaagaggactttgtggaccagaaagcatgaaagggaaccccatagagtagacagctggtaaaaggttttcttaattctgcgtttaaacctgaaaaagtgccagtcttaatgctgagctttaagtaaacaggacagacttcaagaagcatagaaaagctttagaaaatttaatgtatttaaacatccatccaagtcagagaccatgccctgaatgacatgtgtgtgggacagactcaaagcagcgtagccaaggttataaaaacaaaatacattgaatccactcaccacagaggcaagactgaactctaagtctgaatttaactgggttttcaatgcctactaaatcaaacaagtaaacaaaatcagcattctcaagcagattttaacaagatctaaaatctacaaaatataaaactcagaatatccaggatacaatttaaaattgcttgacataaaatatatccagaaaaaagactaacagataccaacctcagattaccaagatgttgcaactgtcagccaaagcttctaaagcagctactgttttttttttttttttaatttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacagacgtgtgcgtgtgtctttatagcagcatgatttatagtcctttgggtatatacccagtaatgggatggctgggtcaaatggtatttctagttctagatccctgaggaatcgccacactgacttcctgttggtgggactgtaaactagttcaaccattgtaaagcagctactgttacaatactctatgtagtaatgaatagaaattaatggaaatatggatgctctcaaaggaaaaataaattattaaaaattgaaaattttaggacagaaaaatacaatatctaaatttaaaaaatatatagcataggcttaataacaaagtagagatggcagaggaaagagtcaatttgaagatgaatcgatagaaattattcaaaccaaagaatagaaacactgaggaaaaatgaacaatgcctcaagaacctgtgggattcagccaaattacagaaaatttgtgccattagagtcccaaagggagaggagaaaaagacgggttggtgcagaaagaaaatttgaacaaaaatgggcaatgattgccccaatttggtgaaagaaaaatttagagattcaagaaattcagcaaacctcgaacaggataaactcaaggaaaaccatgcccagacacattataatcaaattgccaacactggcaataaaaagtaatgaactattgatacacataatgacatggaagaatcctaaaataattaagttgagttaaagaagccacacagaaagagtacatactacgtgtccatttatatagaattttagaaactgcaaactaatctacagtggcagaaagaacagcagtgattgctggggacaatcatgagtggggtggtgcagatgaaaagggttattaaatgggaagaagagaagttgaggtgcagtggatatgttgattatctagatagtagtgataatttcacaaatatacatatatatgtcaaaacatcacattgtacattttaaatatatatagtttatgtttgtcaattgtatccagtaaagctgttgttaaaaattgtaagatgtagctaaagtagtgcttagaggaagatttatggcattaattacttattttagaaagtaaggacggtctcaaatcagtaatctaaacctctactcttagaaactagaaatgaagagcaaattaaacccagtgcaagcagaagaaagaaaataagaaagttcagagcacaaattattaagattaaaaataggagaactgtagaggaaaaccagtgtgttccaaagctcattcttttttttttttttttgacggagtcacgctttgtcgcccaggctggagtgcaatggcttgatctcggctcactgcaagctctgcctcccaggttcacgccattcttctgcctcagcctcccgagtagccgggactacaggcgccggccccaatgcccggctaattttttgtatttttagtagagacggagtttcaccgtgttagccaggatggtctcgatctcctgacctcgtgatccgcccgcctcagcctccgaaagtgctgggattacaggcttgagccaccgcactcagccccccaaagctcattcttttacaaaagtaatgaaattgacaaactgccaggaagacaatcaatttaaaaagagagaaaactcaaattaccagtatcagttattaaagaagtagaatcactgcaaaacctgtagacattaaaaaattatttctatcaattcaacaacttatatgaaatgaaccaattctcttaaacatataaactcccaaagattgcatatgaaaaaatggttaaactgtttaaatagcttaactctcgttaaaagccttcagtgaagagaagacccacagaaggggagaaaaatgtttgcaaactacctatctgacaaggcattaatagccagaatatataaggagctcaaacaactccatagaaaaaagtctaataatccaataaaaaatgggctaaatatttgaatagacattaaacaggcatatgagaaggtgctcaacatcactgatcatcagagacaagcaaatcaaaactacaaattaaactacaatctcgccccagttaaaatgacttgtgtccaaaagacaggcaataacaaatgctggtgaggatgtggagaaaagggaacccctgtataccgttggtgggaatgtaaattagtacaactccattagtatggggaacagtttggaggttcctcgataaactaaaaattgagctgctatatgatctagcaatcccactgctgggaatatacacaaaagaaaggaaatcagcatgtaaagagttatctgtactcccatgtttgctgcagcactgttcacaatagccaaggtttggaagcaacctaaatgtccaccaacagatgaatggataaagaaaaggtagtacttgtacacaatggagtactatttagccataaaaaaggagaagattcagtaattttcaacaacatgaatggaactgggggtcattatgttaagtgaaataatccagacacaggaagacaaacgtcagatgttctcacttatttgtgaaatctaaaaatcaaaacaattgaacccattgagatagagagtagaaggacggttaccagaagctgggaagggtagtggggggggatgggtggtagtgggaaaggttaatgagaacaaaaaatggctagaaagaatggataagacttagtgtttgatagcacaacagtgtgactatagtcaataaaaacttaattgtacattttaaaataacttaaagagtataattggattgtttgtaagtcaatgcataaatgcttgaggggacagatatcccattcttcatgatgtgattattatgcattgtatacctatatctaaacatctcaggtaccctgtaaatatatacacactatgtacctacaacaattaaaaattaaaaattagaaaaagtttaaaagcttctaaaaatctccatgcctggatagcttcactggcaaattctactgtacatttcgggaagaaaaaaataagaattctatacaatctctcccagaaaatagaagcaaaagaatacatttatatcatgttatgagaccaggattaccctgataataaaaccggagaccttataatcaagaaaattagggatcaattgcttcattaatatagatgcaaaaataatcaagatatattaacaaatttagttcagcaatatataaaagggataatacattctgatatagcgggcccaacattaaaaaatcaattaatgttgattaattgatcatctcaatagactaaagaatataataaccatatgatcatctcaattttggattagttgatacagaaaagacatttggcaaaaatgaactccaagataaaaacgatcaattaggctcagtggctcaggcctgtaatcccagcaatctgggaggctgaggtgggaggatcacttgagcacaggagtttgagaccagcctgggcaaccaggggaaacctcaactctaaaaaaaaaaagagaggccgggcacggtggctcccacctgtaatcccagcacgttgggaggctgaggcaggtggatcacgaggtgaggagatcgagaccatccaggctaacacggtgaaactccgtctctactaaaaatacaaaaaattagccgggcatggtggcgggcgcctgtagtcccagctacttgggaggctgaggcaggagaatggtgtgaacccgggagggggagcttgcagtgagccgagatcgagccactgcactccagcctgggcgacagagcgagactccgtctcaaaaaaaaagaaagagagagagagaaagaaaaaaagaaaattagccaggcatggtggtgagtgcctgtaaccccatctgatccagaggctgagatggaaggatcacctgaacccaaggaggttgaggctgtagtgagccatgattgtgccactgcacttcagcctggatgacagaacgagaccctgtctcaaaaagaaaaaataaagattaaaattcacccagaaaactcagaatggaagggaagttcctcaacttgataaaggggatctacaattatccttaagcagacgttgtactttatggtgaaagattgaatgacttcacctgaagttcaagaataagatcaggatatccactttcaccactcttattcaacatcatactgcaggtcctagccagtgtagtaacataagaaaaattaatgaaatgcacactggaaagaaaagaacagaactgttttggtttgaagatgacataattgtctacacagaaaatcccaagggatctacaaagacgctcctagaaataatacagtagcctgcttctgaaatggcccccaatagtccctgccacaatgatcccctcccttttggtgtgagaatagagcagaagtgattggatgctacttctgagattacgttataaaagactgtgacttccatcttgcttgcactttctctcttgctggcattctctcttgctcattcactttcttgttctgatgaagcaagctgccatgttgtaaactgtcctatagagaggcccacatggcaaggaattgagagaagcctcccacatccaatgtgggtcccaggccttcaatccaaaagccagcaaattatatgagctgcatgagtgaacatagaagtggatttttctccagatgagccttaaggtggctgcaacctggctgacaccttgattgcagcctatgaaacatgctgaagaagaggatatgctgtgacccaatgcctgattcacagaaactgtgaaataatgaatgtttttataagctactaatttgggggataatttgctatgcattcacagataactaaaataattattaagtgagtttagcaagctcttaggatgcaaagcccatatgcacaaataaattgtgtttctatatagtagtggtggaaattggaagtcaaagtttcaaagagtaccatttataatatcataaaaaatcataaaattataaatgtaaatctaccaaattatgtgcaggagctgtatgctgcaaacttcaaaatactgatgaaataaattaaagacccaaataaatggagagatatatcctgattatggattagaagaagaatcaatattattaagatgtcagtttgcccccaaatgatctgtagattcaacacaattgcaaccaaaactctcagcaggtttttttaatcaaaaagctgatcctaaaatttatgcagaaaggcaaaagaactacaatagctgaaacagttttgaaaaacagcacaattggagaactcataatactggaatttaggacttactgtcaagctacagtaatcaagaagaatggtattgttggaaagaaaagtgcatatatgaatggatataaatagaggatccagaaatcaacaaatataatcaattaatatttttactaaaaggcatttcaatggagaaagaatagtcttttcaacaaatgttggaaatccacattcagaaaaaaaacctgaattcatattttacaccttctacaaaaataaactcaaaatggaatatagagctaaatttaaaatgcaaaactactaaacttctggaagaaaacagaagaaaatctttaatgatattgggttaggccaagagctcttacctatgatgtcaaaaaccacaagccataaaaagaatgggtaaattggacttcatcaaaattaaaagcttttgctctttgaacaacaggattgagccaatgaagaaaagccacagattgataaagaatattcagcagtaacatattcagtaaacgatttgtatcctgaatagataaagaactctcaaaactcaaaataagaaaaatggctaattaaaaataagaagttatttgaacagacacttcaccaaggaagatatgtagctatcaaataaatagacaataaaatgtcaaaaaaaaaaccacacaaaacaacaacaacaacaaaccacttgctgagtgtggtgcctcacacctgcaatcccagcaccttggaatgcggaggcaggaggatcgcttgagcccaggagtttgagaccagcctgggcagcatggcaaaaccctgtctctataaaaaatacaaaattagctgggcatggtggtgtgtgcctgtagtcccagctacttggaggctgaggtgggaggatggcttgagtccagagcccaggaagttgaggatgcagtgagccgaggtcacaccactgcactccagcctggttgacagagcaagtccatgtctcaaaaaaaaaaaaaaaaaaaaaagaaaaaaaaaaacagtacttaggagtcttacagtagagaggctcaaaagcagacagttaccctgaaatatggcaaataggatgaaagagaattgtaggatcaaaaaaggtggtcaatttagtgtcagaaagcttcccagaggaagtgacatctaagtggggatctaaaagatatgcaggaattaatctcattacaacctgagtgacagagtaagacactgttaaaaaacaaaaacaacaaaaaaacaaaaacaaaaaaagcatttgtagtaattaaccaaaaggatagtaatcatatatctttaaggaaaaaaataaaaaatcattgctagtctaaatctattttcattataaaccgaaagcaacctcaaattgccccttaccattacatgatatttcaatatatatgttttcattcgtagagctatttgcagattaaagctaggttataaatatgagctcattcaattcctatacagataacagactttaaggctgaagttaggtgatcatgaagacttgaacttttaaacattcttattggtttaggagctcagatcacacccattttccttgtggccgattggcatgtttttgtctgagttgacgcatctgtgtgtaagtgcaactacctcaagaaatggctaacttaaacggtaccttcagaggcactgaaacgtgaattatcattctaccccatcattgcatttcaactaacaatgaactcttgaaaaaaaagatgataaagagttttgcttctgctaaattctacttgaaaacactgaacctctaactgtcattgttcaaataatttttttccggctttcttttcccatcctgttatcctgtcattgtatgtgtatttgaggtatcacatttaatctgttctgtcttctattactttgaagaaattagatatatatctcaaatctttgtaaataaatcagttacataaagatatattattcagctgtcaacactgtctagaggcaagtctttaagaaagttgtgtataattattcgtatgtagctttgcaggaaatgacaataatcatagctaacagttgttattccttacgtgccaggcactgttttaagcactttacatgtatttcatcatttaattctcgcaaaccatatgagttagattctgttgtcatctgtagtttacatacaatagaatagaggaagaggtctatttggtaattcacagaaggacacataattcgtatattgtagagtaggaattttaaactgaggctctgtggcttttgaaccaatgtttttaaacactgcaatagataacaaagaagatatttccctctttgtcaaagaaactaaacctaagtaaatacctacaaagaaaggtagcagacacaataaaaacaccaacgtgtccagttttaatcagatagtaagttcatacacataaaagggggaggtagtgagactgaagatgtatgaaattattggactagagttgggtaaagatagttcaggaagacttcacagagatggtgagactggttaaattttgaagagcaaggtttcattagaatttgagtgcattaacatgtcaagagcttagcagttgttatcattgtattttattttatttttatttttgtggagatggggttttgctatgttgcccaggctggtctcagactcctggctcaaggttattttaaattctcacaaaaacataacattatagacatgaaaagtgaagatcattcatttggcaattatttattgagcacctacagtattaccaagcacacatctaggttctgtgtctggtgcacaaaacaaatttttgccttcatgcagcttacttatttctcatttaggcaataacttgcccagggtcacatgattagactactagacagcaaagtcagaattggaacctagatctagctgattataacacatatttttatttgtcattatagcatttcaacactcatagtttacatttaaaaggcaggagaagattttgggggagaatgagggacatgtaaacttgattagaggaaaattaaaactcaaattgttccctagaataccaagaaggtaagtatgctgtttaaagaaatgcttcaaaattggcagaaatgaaggtaattttgtgaattggatcagtgcctcaactgttcatttggtgtcatttgagtacttacttcataatatgcttcaaaatgattatttaaaaataattaggcctttgggtgtcattaaggtacttagttcacagtatgcttcaaaatgattactcttgcttccataaatatataacttttttgcagtcatgtatttccacaatgacctctgatctctagtttgaaaatattttcttgctgtaattttcttcacccttcaaattcctactcactccaaatttctggaaagatctgctatggtaagattcttacctgggctctacttttcattaaaatagaaaacaaaaacaaaaaggaaataacaactataaaacggaactaatttcaaaaagactaagaccgttaaacttaagagatgcaaactgatacctgggagcagacatatcagatatataacagcatcttcaaattgctaatgcaagtgagcatacaccattaaatttattaaagttcagacactttttaatataatgatacagaaactctcagactttagatatttagacaatgaataagttagaatgaaataaagcacttaaatcagtaatttttggatttaataccttagacagcacatgtttattttagtacaacaaaggcatgcacaaatcagaaaaatattcaaatatatttgaaaatgtattatgtaatttgtgaaaatctcagtatctcttatgcaataagctgcatttttacttacagcattattattttttcttgctattcttagaatatcttcagatccccttccaagccacctagtaaatgttctccaggtaccttttgattctctcaaaagaaaagcgcatgccttctggtccactgtaccagaattttaaggctcatgatcaataactaattgattagtgcaattcaccgaagactatcataaacaaagagtagctgacatagctctgtacataaacacagagtagctgacaaagctccatttttgcatacagattggcaaaattcccaaggggcattataatgttgcatttagttagctaccactgaagtcacaatatcaccctatttctctcccaacagaacccaaccacagatgttcccatcctctgttaccagcctagcaccccttctttttgtcactcccagttgaattgctagtcggcttcatccacagtcaattttcggaacccaagaaattgtttcaaaatatttctaagttccatagtagcaattagatcttctaggctcatctaaaaaaaaaacttgtattattatgtaatatttgataactattaaaaatacatgattcaggacaagatggagtagactcacttttccctgctgatctcctctaaatacaaccaaatacccttataaataatttgatagacatttataaaaaacactctgaaagtgcaaagaagatgaactggctggggaactcaatacttgaagaatgacactctagtgacttccctgtggttttttttttatctccagtaccctctctgggtactggagaggcctgtaactcaggatcaccaacagttgtagacaaaaaccaaagaaaccaaagcaggaacttagaaaaagactcatatccagtgacagggtgggcccatctcccaatagcagtggaaacagtcctgggcacaagacaatgcattccccctaagattaagaataaggcaaggatatcaatgttcaccactgttatacaacataggactgaaagttgttttaagtcaccaagtttgtggtaatttcttacagcagtcataggaaactaatacatttgtcttcctttgttgagtagccattgcaataaggcaaaaagaggcatatatattagaaagaaagaagtaaaacagttcccatatgcacatgatgtaattgtttttgtagaacatctcaaagaacctacaaagaaactcctagaattaatgagttcaacaaggtcacaagggtataaaatcaatgcacagaagtcaatgacatttttatattaacaatgatcatatggaaactcaaaataaaattcaatattatttactatcacttaaaatactcaggtctaaacataataaaatatgtgcggaatttatagttaacattacaaaatgttgatgcatgaaatcaaagacctaaataaatcaagaggcataccctgttcatggattggaagagtcaacatagtaaagatatcagttcttcctctattagtttgttagagctgccataacaaactaccacttactgggtggcttaaacaacagagttattttatcacagttttggaggctagaagtcagaggtcaaaatgtcggtaggattgctttcttctaaggtctttctccttggctttgtagatggccatgttcttcttgtgacttacacatggtcttccctcagtactgtgtccacttttcttcttcttaaaggatactagtcatattggattagggcccaccctaataacctcattttaacttaattacctctctaaaggcactacctctaactacagccacattctgaggtactggggttaggacttcaacatatgaatttagggggacacaattcagctcataacacttctcaaatttatttaatgcaattcctaccaaaactccaaaaaggattttaagacatgatcaagcttgttttaaaatttatatagaaagacacaggtaggtccttgaagaactaaaataaccttgaaaaagaatgcattaagaggaatcactgtacctgatattaaggattacaagacagctgcagtaatcaagataatatcatatttgcagaggaagggacacatagatcaatggaacagaacaaagaattcagaaatatacccacataaatatgtccaattgatttttgacaaaggtgcaaaagtaattcaatagaggaacaaatggtgccaaagaaaatggtcctccataggtaaaaacaaatgaactttgatctaacttgatacctatacaaaaattaaaacagaccatagacttaaatgtacaatgtaaaactataaaacttttagaaaaaaaaaacacaaaattttcagaatctagggcttggggtagttcttagatttgacagcaaaagcccaatccataaaatgtaaaaatgtgtaaattggactttatcaaaatgaaaaacttttgctctgcaaaagagccctttaaaggaattggaaaaccatctacagcgtgagagaaatatttgtaaatgatacatccaacaaaagaagaatgtattagtttcctatgtctgctgtaaaaaaattccacaaacttggtggcttaaaaccacggaagtggccgggcacggtggctcatgcctataatccctgcactttgggaggccaaggcgggtggatcacctgaggtcaggagttcgagtccagcctggccaacatggtgaagccccgtctctactaaaaatacaaaaatcagccaggtgtggtggcaggcgcctgtaatcccagttacttgggaggctgaggcaggagaattgcttgaattcaggaggtggaggttgcagtgagctgagatcgcaccattgcactccagcctgggggacaagagcgagacttcatctaaaaaaaaaaaaaaaaaacacggaaatttattgtctcccagtcctggaggtcaaaagtctgaaatcagtactattaaactgaaatcaacttgtctgcaaggtcatgctccctccctccagagattctaggagaatatcctttctttgggagttttagattctggtgactactggcattccttggcttatggccacatcactcccttctctgcctctgcaatcacattgccttcttctcatctttttgaaatctatctctgctccccttctctgaggatacaagtgtttgtattcagggcccacctacatcatccagaataatctcttcatcttaagatccttaactacctctgcaaagactcctttttattgccatatgaggtaacattcaaaggttccaggcatttggacttggctattttttggggggtcatttttcaccctactacaactggtatatagaacatataaataattctcaaatttcaacaggaaaaaaataaaattttatttagataatgagcaaaagaccaaaaaacacatttcattgtacagaatataaaagatgtttgacatgagttattagacattaaggaaatgcaaatttaaaccacaatgaagttttgtaaatcccaaaactttaagaggatagcatgagaccaggagtttgaggacagcctgggcaacattgcaagatcctatgtctacaaaacttaaaaaaaaatagctgaatgtgggggtgtgtgcctgtagccccaactacttgggaggctgaggcaggaggattgcttgagtccacgagtttaagattacagtgaagggatcaaatcactacactccaacctgggcaacagagcaagaccttatctcaaaaaaccatacaaaaaaccccccccaaatcacaatgagatactactccatatctatcagaatggctagaataaaaaatagtgacaaaactaaatgccaaggatgtggagaaactggatcactcatacattgctggtgggaatgtaaaatgggacagtagctttggaaaacactttggcagtttattacaaacctaaacaaacaactaacatgcaatccagcagttgcactcctgggcttttatcccagagaaatgaagatttatatttacacaaaaacctgtccactgatgtttatagcaacttgattcttaatagccccaaactggaaacaacatttaacaggtgaacaagctgtggtacctccataccatggaataccacgcagcaataaaaaggaatgaactattgattcttgcaacaatcaagatgattctccagagaattacgctaagtgaaaagtgccaatcccaaaacatgacatgctgtatgcttccatttataaatatttctatgacaaaattatagaaatagagaccagattaatgcttttcagggtttaaggatggggagcagagaaggaaagtgggtgtggttataaaaggccaacaggataaatccaaatggtgatgttaatgttctgccatcttggctatatcaatgtcaatatcttggttgtgctattttattataattttgcaagatgttaccattgcagcaaactgagaaaagggcacatgtgatctctcggcataatttattgcaactaactgcatgtcaatctacacttatctttaaataaaaattttaattaaaaaatgtatatataaggcatatataagttgtgaagcaatccagactcatttcatactaagacctggaacttccatctctcaggagaccttgatctctctagtgaggaataatacatagaaaatataaaaatgtataataatacatatatgtgtaatatattatttaaatgctgacagcagaaaatagatatctatatacaaattgctactattttagaaattacatccttcaatgaggacaatgtttataactaaggttataaaaatttaaaaaacaactggagttaatggtccttgtcatcattctattatggattaactcagttttcaattaaattgtgaaaagaaaaccctattttctctaaataatagtccatagactgtcacagtaccaccaactccaaatttatatttcaatcacatctcacatattttcagtagaattgtaatttttttgtcaccagtttagccacaacttcataatcttcaaaaacataatgaaacaaacaaacaaaaacaaaacaaaacaaacaaacaaaaacaggagaactccaaaatgtataaggccaagtctttatctttcttttgtaaattctactgcagccaaacaagtacccaaatcgttcaggtaaactagacactctgtgcctatgaactcaacttgaaattctatagtgatagtgctccaaaaagccacccaataaaaactaaaatctctgaaggtttgtattcaccaacataatttttttcctcgtctgcttaaagtcaccaatatgtaggtattaaatagttcaaatgtgtttagttcaaattttgctaacagaattgttatattctacaatttcaatttgcaatcatcattttattgtttaacaaaaacaatacctagcctaaatatttctattaatgcatattaggaaaccaattgcccttgccctctctacttcttgccagcctgctaagatacctgtaaagaggtagatgtgtgttctccaccttgtaaggttaggaggaataaaaccttaaaaaacatgaacacacatacacacaaacacacacacacacacagaaataataagcctttgcccagccacataccatgtaatcctatgcctctttttcctgcagatttgctactctaagttttaataatgaccacactcacatcgtgaaattatacaccagtttattcaaatcaatgtacaaattgaatattatcacatttattttgttcattggaaaagacaatatgtcatttcagtttattttcatttttaaacaccaatatttaagtcttaaaaggaaataaaagtttacaataatgatgaatgtcaaacttaaaggtgtttgttatctggctgggcatggtggctcatgcctgcaatctcagaggtttgggaggccaagacaggagaaccatttgagaccaaaatttgggaacagcctgggcaacatagttagacctctatctctacaaaaaaaaccaaaaaaatagccaagcatagtggcatgccagtagtcccagctacttaggaggctgaggtgggaggatgggttgagcctgggaattcaggctgcagtgacctatgatcatgccactgcactccagcctgggcaacagaatgagaacctgtctctaaaaaagaaaagatgttttgttatctattaggcctttcaaaaatatatggttttttctgaggttttcaagttatataagacttctatgccagccaccctaaacaaaacagaagaagcacaaatattactaaacaaattaatgcttcattaacaagcaaatcaccaatggtgaaaaaagaacacatttaaatcaaaatcagtactgatacagaggtaagaattacatccaggcacagacatttggagttattcccccatgttaaaaattccatcacaatgtgcaaaataattattaaatcttctttttgaaatatatccccccacttttgttttgcctgatacagatattttaaccttaggtgtacagaaccctattaaagaacccagattacaattttttatcatttacataacagtggcagttttctcccatgttcttgcacaaaaagaatttattttcacataaattacaccctgcatttttcaatagtaggaataaaaaatactcatgttcaggtttacatatatttaccatgactaaattggaacaaatcagctcacagcttcctcatgcctacagttcaaattaaatttcctcttttatattcctagggcttctctagttgcatgtcaaacttttcagatcagctgtcttgattcctatcttttcctctccttgaaaaataagtgtatcttccatctcaaccatcctccttttcagcagcttccatttgattggtctggtaacttactatcatgagtatctttgtgctcagaggagacatcaggctgcctagtttactagatcttcatttattccttctaattttgtggtcgctctgctagtaacacattgtaaggtttagactcaatctaccccaggcttatttaaaattaaaacacgagtatatataaatattaaggttatatgtttaaaacttaactgctttggcatataaattgcatctataaaaatattaaatgaaaatttggcttaaaaatgtaacctaaatatagaccttgtaagtttaaaataatccttgtcctcaattttctttaccaagtttccaaatatttacatcatctttaactttccacggggccccaattcgtcaatctcaactccttgagttgtttttttggattttaagtgctttgtacaaactcattgatgagtggaatggagccatgctctctggtaccttgcttgctctagggtctgatctctctttctcacacttcgtggagtaacaacttccccatacacttactgaacattggaaattaccactttattcccactccatggctctactcaacccaccacattaccatcaactcagattcatagattaggtgccatattaaatgatatgatacagcaggaacagaaaacagacatgccttcaaggagtttactatctagctggaaaagtagaggcaagacagtaacaaagatctggatggcaccctcactttggaaattggcagtcattcataagacacagatatattcggagtaaggagagggaagcaactgggaaaatatcctttccagtaataagcaaaaagcaagaggcaaaaagaaatgttaactatttaagtcacatacttgccaatctatgtagctttgcaggattaaactacaatttattattattattatacatttctatatggttttgaaatggttgttccacaaaggaagggtcctccagaaagtttctatagccttctttttgggtaatttttgcctaccaatatttgaggctaccagatgaaagtaatttctttttcaaagcaattggattaatttttacaagtacacggagtcaattcttgaacttctgattctctatctagacattatcataaaatatctgctatggagcactcatgatgctttcatatgtgttatttaatttaccacaatggaaatacacaaccccacatcttttatttttttcttttttgagacagattcttactctgtcacccaggctagagtgtggtggcacaatcacagctcactgctgccttgacctcctgggctcaggctatcctcctgcctcagcctcccaagtagttgggacaacaggcatgtgacaccatgctctgctaatttttttttattatttatttgtagagatagggtctcactctgttgcccaggctggtctctaagtcctgggctcaagcaatcctcccacctcggcctcccaaactgctggaattacaggcatgagttaccacatctggcccacatcctctttctaacagccatgatttcttttcagacaacaacatatttataattcatttgcaacacttcaaccaaactagacatacagaggatgtgggagacataggtttctcacttcattactagcatgcaacccatgcaatcaaacatctgtgccagaagtagattttaggttactttgttatggaaatgcattctccattttagtagcattttttttcttaattagaggaagtgctttcagaaattgcaaattacataatgtaattacagccattttaatgaactaaagcaagtaaacatcaatataattttaagatatttaaaattctttatagttttttgcttatctttctaagttagggctagtagtaataactacctaaataatttgaatcccttgagaatgcaaatgtattaggcttggttttctgttcacctgagtcaaaaaacctgtggatcagaaataagtctggtagctaaaattcctgtggaagttataaaagggttgttttttatcaaaatataagattatctatgtaaaaaggaactaatcaactggttaagtatgttaattggaatttggaaggatttgagaactggaagggagagaactaaaattgttgactagtaactttgtaaagccctagacaacaatcaacccatttcatctttacattaaaaataattatcattaactgagaatatactataaccccaggcattctgcaaaaaatttcacatgcgttaactcatttaactcttccaaaccctttcaaagaaatgtgtattatctattttttcatattttaaataaaggaaagtaatgtatagaagagataagtaatgtgtccaagaccttagaacttttcagtaacacaactgattattaagcacaggcctataaaactccaaagtccttgtttgtagtcattgcttcatgttatatgtcacttagaatgatcctttaatgaataactacattaaaacatagaactgataaataaggcaccctccccccaaaagattactctctatctctctctctctctctatatatatatgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatacatatatgtgtatatatacgtgtatatatactatttgtacacatatatgtgtatatatacatggttttctagatatatacgcatgacagtgaattatctttgaaatttaattattccattaaaatggaatatatgcttataaatctttctggattttgtaattttgtcttcatttattttgaagaatgccttaaatccaaacccccttttgctagagatttatgcctttttgtaaaagatagatattgtcaaacctagaccagaactatatttgggaaagagggtttgggaatggatctagaaagtgtagatccatcatattttccactgtcatccctggggattttcaaggattccatcaaaagttactcactggagtccaagttgtcctaaatgttctcaaaacatatacagtttatgaaaataaacatgcaataaataaaatctccctgatttcttcgaattggttaatgaatggcagaagacaatcttctcatatatattaatacctccaaaatttgtataactagaggtcattctcaaagtgaaacaattttcttgtgtgtataaaggtggtaccatatccctagatagatggcatattaagccctagggtattggaacatattgttatagtggctctttggctgaattttgcctgcagataaattttgttttggcctagccaacaatttttaaactttatcatttgaatacattttaagagtgagttccaactttgctatcttttctaccactccccatcttcttatacccagctgtcctacccactgatattacctacctggtccctaaaagtgtttacatttgtgatgggcatcacagctgtgagcacagaagaaatagctttcatgttgatactccacattcacccctgtgctaacaaaggtcctctagccctctagaaaaagtacactcattttcccctaagtacttctagaagtcaccagtggttctctcgtgtgatcatgagcaaatcaattttcatcatgcactgctgcaattattctgggctttcatggagcacacatgtatccaccatcacccgtcatcattcatagtatctgctgggcattcatcatctaccactgggcatccatcatctcccatttggcattcatcatctcccactgggcatccatcatctgccactgggtatccatcatcatttgctcggcatctgctgagtaccgccatgtctgttgggcatccacagtctcccaccaggcattgtggtctccgctgacgctttgccatttcgccaccggtgccttccatgagaatgctggttacttctccagagtgctgtcacccggggctgccaaatctacaaaccctcaagataccaggtgtgctgcatttgcgtcagtattcattgtacttagctgtgttccttgcataaattaggaaaatgcccctttataactgtggcacattttgttatctaaacattgaaaaagcaatacttgtccctgtccccttcacaaagtccctctgtaaaacagctatctctgttttatctttctttgttacttatggttatcatccacagggcttacgtattccacagggctgatcttgagtctatacactgatgccttaattcctgtcctcaggcattcacccaaaaaacatccctctgaaaagcttagcaggtaacttgtcagccttgtgtacttgtatatacctagcatctactcctatatctggtctttttttttttaatggatagatgaaggcctccttcctctttgcaaatcagttcatgaggtgatattcttggaaattcccaggcccacatatcttcacctgtgaatcattactttgggtttgaaatgtcttctcccaatatcacttttccctttaacaatatccttaatcacttcactgcgggatctttatcctagagaaaaaaatttctttaccgggtaagtttccattctaaatacaaaaagaataatggtatcagtatatttaaattataatgacatatgtggaagaatacagtccagaggtcctgatttttgttcttatatctagagtcttctacctctggttatcctttgctgtttctctcttctatcctccttagaaatgtacaactttggctgggtgcggtggctcatgcctgtaaccccaaccctttgggaggccgaggcgggcagatcacctgaggttgggagttcgagaccagcctgaccaacatgaagaaaccctgtctttactaaaagtacaaaactagctgggtgtggtggcgcatgcctgtaatcccagctactcaggaggctgaggcaggagaatctcttgaacccaggaggtggaggttgcgatgagccgagatcgcaccattgcactccagcctgagggcaacaagagtgaaactccatctcaaaaaaaaaaaaaaaaaagtaaaagaaatgtacaacttttacatattaattactggtttaattccccaataaatgcacaaaataaataaataatgtaattgtagttaacattccagttctggttgcaaaaataatttcactacaggcagataggcagcactgtcaaagctaaataacaacggccaacacttgagtttttgctcagggccagacattgttccaagtattatacatgtactatccctatttaatacataaagaaaacaatgcaccaaaagtttaaatgctatcagtattctactgccaacaatgggacgcacctcctacgttttcttccttaagaggagacatcctctgtcttctcaagaaagattagaattccctctgtagtgtcaagttctggtgatttgaagattctcctcatttttctttttcttcttaaatctcactccttcatggaatcaatctttctttctttctttctttctttctttctttctttctttctttctttctttctttctttcttttccttccttccttctatctttcttccttcctttcttccttccctccattcatcccttccgtccttctctctctctttctttctttcttttttctttctttctttttttttctttcctttcttttgacagagtttcactgtgttacccaggctagttgtgaactcctgggctacaacaatctacccacctcaggttcacaaagtgctgagaatacaatcatgagccaccatgcccagccttggaaactttcagtgatttttatattgtctgctaatgtgccaattcctagagagctaagttctcagtccttacttcatgaacttttccctcaaagcctgtatgtctatgccaagagccttttaactgggttgaatgatggtggtgaaggaagctattataacaagtactataatagctaactttaattgaacacttactctgtccatttatcttattcaatccacacaaccaacatataagtatttttcccactttacagatgagggaaattgaggtatacaattttacctcattttagggccacaaaaggctaatatccatcctcacatcactggtattaaaggtcccattctcccagctagccagagtgctatttctgccaccaacccatggaaatgttgaacatactatgttcctgaaaaacaacaacaacaacaacaacaaatattgattcttgcttgatgtcttgatatggctctagagacacagagtaacataactaaggaaatagtcttttgtatatttaagggtaatttctccaagccctaccataatactaatagttaatagttattgtgtacttattagtactgtacatggtcctagctgatacacactgttttagaaccatagctttactcaaaataattttatttcagttcagttcagactctattaacacctgcctaagacagtttgaaggcccagattgcaatgcctctgctatcatgcaattagaaatggaattaaggagaaatgggaggggtcatgatatatcttcaaagacttgaaggattttcatactcatacgcttccaaagacaaaagcaagataaatggtaaaagatacggaaagaatcagcttagggttcaataaaagctctgtctttcaaagagaggacaccaccagccatcactagtggttatgcaaagaatttgtgcctggaataagagcttgaactagattttttttgaggttgtcttttatgtcttaagattctataattaagatacctagttatgccactttgaacaagttactcaaaatctgaaagtatcattatgaagttagaagtttagtgcttttgtcaatgatagggagatgaaaataagaacttctatttcatacaatagtgttaatttcatatgtgcttttatgttcctatgatctttataatcagtttggttagtcccagcaagagatcatagatgaaaaacctagtcattaattatacattattttaatactcagaagacattttatccttgttgccatctaagtgaacataaaagaaaatttgcttagaatgaatggactatatatccataatcctcactcttaaacattatgcgatgaataagaatagcctacttagcttttatcttaaagggcagtaactctatcttgaaagttgtctttcatatgctgaatagaatatattacaactatggatcttaattgttcgcatttttctgtatgtactcctaacagagtgcttgaactgtgtagtaaaaggatcattgggctaatcattaaaagttagtttctttcttttcctctttagtcaaatttccatattccttgtgtgctgaagtttgttttgtatttcaaataaaacctatcaaaaatctaaaatctttgccatctagttattctgcattcaaaatgtagtaaagacaagctgcttactcaatgctcatataacattaagtccccaaagtaaacttaatgaattaagttttcccatgacccaatgccattgtttcttttaaaggaagagcatcaacaagacaatcaagtttgaatgaaattgattttctaatggagttctttttactgagaaatatttagtaacacagatattggagacagaatttttattttcatcctgtttatttctgtttttattctgtagtaacatgttatgggatatataagagtttttatgggagcatgtacaattgcaaattagccaagccactgaagattttatattgctgttttttatgtaattgataagatcatgacaaatgtggttttttgccctatttagaataaagcagaaagagtattctgagttcgtacttagagtatacatgggataattagaacaggctgtcttctgcagagcaagaggtttccttattctagatcatattcattcttggaacccaaaagcttgcactggctaagaaaaaacctattttctcctcaaaattctgtagaacaaaactttaaaggggaattaatttagaggcatttgatattcattaagcacttattcattttctattttactttaaccctatcttataccccatattttactttaaccccatcttagcttaatatctcctttatattgatagggaggaaaaagtttctggatttactattttaagagcaagtacaaaggacaaagctgaatatgttctattaaactaatagctgaagctaacttttatgtatttaattttgtatgaaaatatattcaaaatagaaggtatataaaatatatataatgaaatatatatataaatcaaatatatttaaaatatatataaaataaataaatgaaatatataatgaaaagtaaattccctgttgtttgaagtgtttcttgtgatggaagaaaatgaagtgtctaattttgaattcctcataaacctgattacaaactctgtgtatacatgaatttcaccagtgagtggcacatataaaccgttgtaatcaacctcagtgttctgttgaagggcaactggagtaaaaaataaagatgacaaattatttccactaaacattatagtataatttgtttggttactaataaaaaggaaattgctcaatagaaaattacataaaagctaaacattgataagttaatcatatacatatttaaatttgatagtttatagcctttagcattaattctggctaagaaatactcttttttaactaagtctttttgatcaaatgactcttaagtaatgttatattagtattttgattttggtaagtcactggttatctctacaaactagattctcttttataaatgacttttactgtgcatctatcttgataagtattttaacctacagtatctcacttagcatctgcttcacaggtatttgtgaatattaaaagctgaatgtgaaaatatttagtaaattttaacttactatacaattttaaggttatcattatttttagtattacattaaaccaaacccctatttacaaacaaaaagatattatgcatataaaaatgtaaattatgtattttcacgtgtaccaaaacaaatgttctagaagtagtatattggttcaaatataatgtaatataatataacataacataaatatatattttctcagtttaaatacaatggagtaaggtaagcttcttgttatttaagtggaatatgaaaattaaatgaccatttccccaaacttatttcattgaaaaatattaaggcaatttttgaagaccagtgtttcataaataaactttttagcgtgtattactatgacaagttactcaattggcttttactctgggttattcaactaaaagtttcattttcagtgactcataatattgtttacacataatttgtaagctctatttaattacttatgtaaatgactaaacaaaagatggcaaatgcagtgaatctaagactgtacttaattctggtgtaaactattctaacaatgtaattaagagctgtccaatttacactttgaagtaaacaaaagatcttacaagagattgcaagtgccatcatatgacacttctagctttacctcatgttcccttgcagtttttttcagacatgtgttaaaactatttgaaaaaaaaagcagttaatttaacagtacacaaaggtgatagttaataggaaaaataaaattgtaaataaaaaagtagtgaaacagcaaagttaaacctagactcaccttactttcttacctattgctattatttattcaatgactactacagcaaagctgtggccttgaggaaatgattttatgctatgaatacaataacaataacaaaaataaggctaataatacatataggtacagtatattggattccagctagatgccaagcagttaagcataacaaaattaggaaaggtagttattattattcattaaattcctttttggatttttttcactatgtttttattttattttatttacttaaaaatagtattagtgtttgctctggggcttacaatatacatcttttaatttttattcctttttaaaattgagatataaatcttataccataaaattcaccctttaaagtgtacaattcagtgatttttagcatattcacaatgttaggcaaccatcaactttatttaattacagtagaatttcattatcccattttcagtcactccatatataatatgcatcttaatttgaaacaatcttgttaagattaacattaaacttcaatagtatgtagacatattgctccaatatacttccatttcttcccccttctttgtgatatcattgtcatgcaaattacatttttatacattataatgcatcaaaatagttttgtgttttttttcatggagttgtcttttaaaccatttggaaagagaaaagagttttcattcatgtggattcaagttaccatctaccttttcatttcagttgaaagattccctttggtagatataggttaggtatgctgactacaacttctatctatttttttattttgaaacatctttctctttcatttttttaagaaatagttttactggaaatagaattcttggtagacagtatttttctatcagcccttcaaatatgtcatcccaatgctttctggctctcacagcttctgatgaagtcaactgttaatcttatttgggtccctttgtatatattgagtcatttatctcttgcttcttccagaatttgctctttgtcattgcctttcaactatttgactatgaagtatctaggtttgtatccctgagtttatcctaattggtgttcattgagctttttgatgtgtaaattagtgtcttctatcaaatttgggaaaatttcagccattgttttttcaaatatcttttctgtatctttctaacctatccttctggactcccattatgcataatttgatggtgtctcacaggcctttgaggctctgttcattttcctttattctctctgttcttcagatgggataatctcttttgacttatcttcaagtttatcttcaagtttattgtttctttcttctgcctcctgaaatgttctattaagcctatctaatgaatttaccatttcagttattgtacttttcaacttcggaatttttgttcttttaaatattaaattaatttgtatatctttactgattttctctatttagtgagcattatcatcatagttttctttaattctttaaagatagtcttctttagttctttaaacatatttatatagctgatttaaactccttgtctgataagtccaacatctaggccccctctgtacactttctattgacttctttaattcctgcctttatgccatactttcctgtttcttttctcttttctttctttcttcctttttttttttttttttttgaggtagggtctcattctgttgcccaggctggagtgcagtggcatgacctcagctcactgcaacctccgcctcccaggttcaagtgattgtcatgcctcagcctactgagcagctgagattacaagtgcctgccacgacacccggctattgtttgtatttttaatagagacgaggtttcaccatgttggtcaggctggtctcgaactcctgacctcaagtgatccacccacattggcctcccaaagtgctgggattacaggcgtgaaccaccatgcctggcatacttccctgtttatttgtatgtcttacaatttcttgttgaaactcggacattttaaataatatattgtagtaactttgaaatcagatctactccaacctctagtgtttattgttgtttatgagattttgtcctcattgctgcttgcttcagttactttcctagaatacttctatagattctgtattccttgcaatatgtggctgctattttctctggtagcatttttctttgatatttgtttttatttttaatccttcttaagagttgcccctgaatcagcattgtttgtagtcagctaatgattgttcagaatattctgttaaatgctatgagccagtttttcttttaccctgttccaaggagatttttgtgggaggtcacaccttcaaatttcagagaatttacaagtcaatattagcttttacttcctgctcgagtccagcatcaaaggtagctagagatgagttgttggtgtcctctctgagttttcttgggcatgtgtacagacatacacatttgtgcagccttttagatttcctgaaatatgctggagcattttagaatcccttatgttggtccttttgccattaccgatgtattccttttacatttttagccaacttcttgtttgttacaactgagttcacaggcttaggcaactgcaatgttattaaatccagctcatgttattgttttcaaaactctggagataaagctttttctgaagaactgaactcagagtcaggacaaatagcccaattacctgggaataatgtgtttcaaaggaattattgtaaatattgttgaaatattgaaagtgttctaaggatggggctttacatgaagctccaaaacaaatcagtccccactcaactggctggttactgtgctctgttactgtggtgagaggggaatgaaagtagccccaagtgaaaacaacatagatcccactgttctaactgaagttcagtagactgtttttaaatgaatatcttttaagccaaatctatacctttagttaatttccaagattctaaaacagttgatttttgtagttttgcaagtatttttatagcttttgtgagagaaagaattcaccaaggttgccattctgtaagttctgttctcataagtacttctttatacaccttgaattataatgacattttaaacataatagcataaaatgattttactgcataaagttaaaatgattatttcatatcatctactacctaatctgtattcacttttaacaaatgactcaaattaggatataaattagttgctttatttaaattaggtttccaacaaggttcacattttgcatttgttttttatgaaactagatttttgtgtatgtgtggtggcggggcggggcgtggtggggggggccttgattctgacctttaggagaggaaacatttttcagagggagacaaaaagtcaaagaagtacttcaattgttggggagacttgtacatgtttatgggatcaagggaaatcactatactttctggcttaagaaacagccctattcatgtcttgtccaacaaaggctagtaattccaggttagcctagggcccaagagatgaagcaaaagctgaaactgggaaaagaataaatttagaaagggacaaggtcaatgaggagagttggtagggatataatattattaagcaaatcatcaataatgtaacttggatttactttgggatgccagactcttggtggattactctttcttgtgaactatttcaccattctgcatttttacattttccttcagttggttaaaactacgggatggtagagtactgaagtcctagcttcaatttccagcttttccagtaactgtgtgatccaggttcagccacatggcttctttgagcctcctttgatttgtgaaatgagaggactgggttagatgtctctaaacttgattttgtctccaaagtatgatttttctaagacctttcttaagcaggtatatgcaataagtaaaaactgtttttagtaactgagcttaacatttttgctttcctcaccctgaaaatcaggtacacaagaacttctttccccctttcccattataacttgttttatggaaagaatcttaaatcagaattaaaaactggtaaacacagtattaataagatagaaatattaccctttcctcccactcaaatctcaaaataaagcaatattactgcaacaaggtatacttcatttttgtagtaagagccagtttcataagtgaaactatatgaaaaaataactatgggagttaaagcaaaatagcgtattgtgatttggaatagccaaatacattttatgcgtcagttttccaaaagttaaattttaaagtaatcttggttaaattagaatacagactcttaaataatctacaaacagacaatttttcagataccatggaatcataccttttatcaagaataacagttgtttgtcagtgcactttgggatattgagcagatattttggagatcacttatgctgaacaatatgatgcatttattccaaaaattacaattgcatattttttgtattacatattttagtcagcaaataaaacaactgcaaccacagaatctattcaggaactagaattaaacaagttcctttagaaactgattaaataaaccacataatttccaaaatgcctttcactttgtgcacttagctttggtttctaaaccccttctgaaacagatatctaaatgaaattaaaatctttattttacacagaggcttcccatcccatcccaccctgtgtccaaactccatcatctttaacactttaagcagttattatgaacccagaagccactaggatagagatgttctaacaaagatcaaagaaaacaaaaatcattgttaaattattataacccgtgggtcaaaccacaatcaatataaagacacttattgagtatctgctctttgtcagcactgaacaaaacacagtgggatgtcataatatattagtcccaatccctgcttatgagggagtttataatataattatgtgtatgcatatgtgtgtttgtgtgtgttggttggaggcagaaatttatgtaaaaaataatgaacaacatgaggttatgtgctaatgatggaatgcatcgaataaataataggtggttaagaagttcagaggaggtacatgtctccctagtcaattggtaagaatagggctcacaatggtgcaatttaaattactataataaagtaaatgggatattttcccagctcccaaattaccacatagacgattgttttcatacttattatatatagtcataacgtcaacccaactttgaagggaaatagagaaacccaattttattgtagttacaccttcaggattgcattttgctactaataatttatacaaaatgtaagtgcttatatctctgtaacttttagagatatattcttaacgcagtgttaaactatatatttttgtgccaattttaaatagttttatttaagacattgcattttccacttacagtacagtgcttataaagtgcaatgttatttccctcccctgtgcacatgttgcatattcaagtattgagaattcctagtaacttactacagcagctgaacttttaaacactgccacagaatttgctacaaatttaggtccttcaatgttttaaatgtgtggaacaatgctacatctatatttatgttggcttaatcaacctcttcagtgatgggccttgaggaagcaccactagagggaggagctccaccaccagggaatcccccaggcattcctccaggcatgcctcctgcactctggtaccgcttgctaatgatgagattgcagactttctccagctctgtctgctgatgttcaaattcttccttcttagcagcctgattcttatccagccatttgataacttcattaaacttgtccagaatcttctgtttgtcctcaccattaatcttaccttgaagcttctcatctttgactgttgctttcatgtggaatgcataggactcaagtgaattcttggatgacactttgtccctctgcctcttatcttcagctttgtacttctcagcttaccggaccatatgttcatgtcttccttgctcaaacggtgcttgtcattagtggtagtaatcgtgttctcttttcctacactcttgtccacagcagagacattgaggatgccattggcatcaatgtcaaaagtgacttcaatctgaggaacaccatggggtgcagaaggtatgcctgtgagttcaaacttgtcaagcaggttgtcatccttggtcatagcacactcaccttcataaacctgaatcagcacaccaggctggttgtcagaatagataggctgtcagaaggtctctgtctgcttggtaggaatggtagtactatgcttgatgaggacaggaggacagtcatgactccaccagcaagttcaataccaaaggaaagaggattgacatccaagagcagcaaatcttgaacgttttcagatttgtctccagataggatggctgcctggacagctgcaccataagcaacagcttcatcaaggttgatgctcttattcagttcttttctattgaagatgtcttggagaagcttctgaatcttggggatatgagtataaccaccaatagagacaatatcatgaatctgtgacttgtctagtttgacatctcgaatggctttttatacagggccaagggtgccatggaacaggtcagcattcagttctttaaattgggcacaggcaatggatgtacagaagtcaattcattcttagagagaatcgacctcaatactggcctgggtcctggaagagagagtatgcttagtgtgttcacaagcagtacagaggcgtcttatagctctcttcttctcactgatgtctttcttatacttatgcttgaactcagcaataaaatggctgacaattcggttgtcaaagtcttcttcacccaagtgggtgtctccagatttgacctcaaagattccatcctgaataatgaggattgacacatcaaaagtgccacctctcaggtcaaagataaacacatttctttcagctccaacctttttgtctaagccgtaagcaatatcagcagcacttggctcattgataattctaagtacattgagaccagcaatagttccagcatctttggtagcctgatgctgagagttattaaagtaagctggcactgtgaccacagcattggtaacagtcttcccaaggtaggcttctgcaatttccttcatctttgtcaggaccatagaggacacctcctctggatagaagattttggtctctcccttgtattctacttggaccttgggcctgtcagtatcattcaccatcatgaagggccaatgcttcatatcagactagacaacagcatcatcaaatctgcatccaatcagatgtttggcatcaaaaaccgtgttggtggggttcattgcagcttgattctttgcggcatcaccaatcaatcattcagtgttcataaaggtgacatagcttggagtggttcagtttccctgatcattggtaattatctctacttttccatgctggaaaacacccacacaagagtatgcagtgtcaagatcaataccaactgcaggtcccttcgacatggttgctggcgtgtagggccggctctgactacaaagaaagacacagaaacctccagaactgtgggcgcattcaatgagctatatttacttcttgaaagggaaaatagatgtaatttaaaatttcatagcaaatactatggaacaaaaaaatgatgtcaaaaacactacgattaaaaactcactgatatgctgacaaacatattacctcaactatcatctgctgaattaaaacagcaccaaagcgtaagtaaaatgacaatgaataaaatgaccaataaatgtactaatgcccttacaagggctccctgtagtacttagtaatgacaattaagaagtattgtgattaggtactaaaaagttgatctatttccatactttttctgaagattttcctgactgcccttttctgcatttatatttcatctacttctagtccagttagttttatatttatgttctaagacatgctttagtctgaacagttcataaggtctaagaggaaaatgacctttgaaggcactttctgggataatgtgtcaaaatttcaggccaccaaatattattgaatgcccattctgtgttaagcattgcacttggcattatggaatacagagatgtgtaccagggccctagcctccaagaaaatgcttcacttttagaaatatatttaaataatttaaaagggttatatagtgtagaattttctaacttggtgtgactagataaaatatctaattttcaacatcagctttgaataacttgtggagaattttctattggtatttatttattcatttattaagacagagttttgctctgtcacccaggctggagtgcagtgacacaatcttggctcactgcaaactccgcctcctgggttcaagcgattccccttccgcagcctcccgagtagctgggattacaggcacgcaccaccacacctggctaatttttgtatttttagtagagacagggtttccctatgttggccaggctggtgtcaaactcctgacctcaggtgatccacctgcctcggcctcccaaagtgctgggattacagggtggagaggtttttaaattagtattgtccaaattcagtgactctgactaatggtagctaatggaaagctgaaatgttcagttccaacgaaaatcctgaggcaaatagtggttttgttacattctttaagagacagaatgaattcctgtagaaatgcataatgcctatatttacataacagaaaatgtttggcagaaaataaagtgctgtcattgtacgagttagtatctttctttctctgaagatattttttaataatgaaagtagaatgtactggaggtgccatgtcagttcatctgtcaataaacataaaataccattaactcaatggtattttccgaggtgttgtagtgaagtagaacttgagttttggtatcacatgaacataagtttaaatccctacaatctcacctttttaaatgacctcttatttctaaataaacattttctcacccacattagcagggaaatagcatggtattgagggttagaggttaagctcataaagtatctggattttagtacatgtgatattttaattattaacaaaattattcttaggaattgattttattagaacattattttagaagtgatcaggcaaattatattgaagttcacatggtagaaacttctgagaatctgtcctagttgagtggtaatacagtaggatgagataaagcaatgaggaaaaaaaggagaaaatcagccttttccaaaaaaaaaacaggcaaaaactgcaatatctcataagtcagcttacaaatggaagtgccttccagaccacagtacagtattggattagtgtttttgtatgctacatatatgtcttagtgaagacagaaatgattatacacaattcatttcccatttttcatgtaaaaaaaaagtttatgtctgccattatattatagaaacagagctatctagataaagcctcatctgtaagagataatgtctgaccttcaggacacagatggaaggctgtgctattgggccaggaaaatttgctattccaagtcagcaatagaaaacattaagttcctggctagtagtccagttcccattttaattctctttactatctttttgaactcttcataaacaaaagaaatgaagaatagatatatatagggccaagtgattaaacagaattaaaagttccgtatataaatcttatgttcttaattatagactgactaggctccccaggattccattttagaagatatttggcaaaacatcaaattgccacttggtgcaacatcattttttaattttctttaattgtctagacctgaatttagctcagtacagtagatatcaggacagtggaagcgcaggcagttaaagtttgtcatcttggggggaggctgcagctgatatcttaaatatttgacatattcataatatcttttgaatatatctctgaacaaccttgtaaagtgaataaaataggcaattttctcaaattttagacaggaaaactagattttgaaattacagatagtatgtggcagaacaggtactaaaagaagacttctttcccccttacctacaaccattacaaccacagaatatgttttttctcttgtgtctttcagagtgtacctgttaacagtactgatgttttccatataggttggtgcaaaagtcattgcagtttttgcagttacttttaatgacaaaagctgcacctccaatgcagctttttattctaagtaaaaatccttccaactcaagcagggtaactctttcacatggacattagggtcttgagcacattcagactcaacattgccagtactctggaaggccacagggatattttcgtagtcaggtactagcagctatctcaaacaacaagcctatacttggattacaacatctcttcagctcagattcttgttatcttttgttgcatgtcaacttatttgtaggaggattggagacattgggtacaagaagatactttgtaagtttatgaatgaattctgctctatgtaagatgatagactaggtttttggaggtaacactatcaaacaagtatattggatgtatatgtatatgtgtgtgtgtgtgtgtgcatatgtgtatatgtgtgtatatactgtcagccttttgcatctggaagttcaaccaaccatagatcaaaaatattttaaaaacaacgaaactaacaaaacaatgataaaaaataatacaaataaaaacaatacagtataacaagtattcacataagatttacattgtattaggtattataagtaatctagagatgatttaaagtatacaagaggacgtgcatcagttatatgcaaatattatgttattttatgtaagggactaaagcatttgcagattttggtatctgcgggtgtcctggaaccaatccctcatgaataccgggaaacaactgcgtgtatgtatatacactcacacacataggtatgtatgcatgtatgaaagtatcaaagagctcacatgagagtaaggaattagagagtaaaatctatatgaaggatggaacccagatgtgggcagctcaggactgagcagctattgtcttgtggaaatttgcttaacaagggaatttttaagtatgcagacaaggattcaaatagaaggttatcctcctttaagctgacaccctaaagagctataccataagtataaggataaaacagaggtaaacatgaaccacaacctcacccttagggtctgcaagaaaaggtgccttagaattgaggggaggagtaaacctgtccctgatcattttaaaccacaagccagaactcacagtgatttgtcatccagattcatatcaactgggttgtccagaaatctcaagctataaattttgttgataataattttggaatgtatgcccctaaaggtctcaaagaagcaaatgcaaatattctctgaaaagcaaccccattctaaaaataattttccaaagagaataagtagctccttgggaaacagcaacaattaggcacgcacaagttcaaagtaccactggtaagaggcagaaaaacaacaaatataataaatatacctgaaaaacttcaggcattgtatcatcagacattattgctatcaataaagaaaaaaactataagatgaaaaatttctacagggaacaacaacatctgttgttctgcttttaatttttagaagatccactttgttctttttcagataatccaggccatttttatagtaatttgtagagtaaattaagagcagtttaggcaaagctgaagagagaattcataaacagaaaattatcagaagaaagtgtcaaaaatgcaaaagagagggagatgttgaaaacataagagaggttaagaaatatgtaacataggctgggttcagtggctcatacttgtattctcagcatgttggaaggctgaggtgggaggatcacttgaggctacgattttgtgaccagcccggataacataacaagacgctgactctacaaaaaaattaaaaaataaaaaaattagcctggtgtggtggtgtgtgcctgtagtcctacctacttgagaggctgaagtgggaggatccgttcagcccaggagttcaaggttacagtgagctctgattgcatttctgcactctagcctggatggcagagcaagaccccaatctctctctctctctcttttttttttgagacaaaatctcactctttcgcccactttggagtgcagtggcgtgatcacagcccactgcagccttgatgtcctcggctcaagtaatcctcctgccccagcctcctgaatagctgggactatgagtgtataccaccacacccagttaatttttaaattttttgtagagatagtatctcgctatgttgcccaggctggtcttaaactcctgagctcaagtgatcctcccgcctcagcctctgaaagtgctgagattacaagcgtgagccaccacatcccagtcaaccccgccgtctaaaaaaaaaaaaaaaagtaacatacagtgagaagtaaccaaatgtctaattgggattgaataggaacagagaaagagattgggttagaggcagtatttggaaacaatatagttagaattttctggagataatcaaagacatcaaagacttaagaagaccaatgattacccaagcaaaacagataaaaataaatctacacctagatatgtcacagtggaactgcagataaccaaagacaaaattaaatcacaaaagcagtctgacaaaaatgcatattactcaaagggaactattaaactaatagctgacttctccaaaaaaaaaaaaaaaaagccaaaataatatattcaatatgttaaatgaaaataactgccaagttaaaattctgtatttagtgaagttatacaagcatgggtgtaaaataaatacagatgaaaacagaggaactttctaaccagtaattcctgtttcaggaatttgaaaaggaagtatttcagtaaaaaggaaagtgaatctagatagaaggtctgaggagcaaaaaagaatgaagagccaagtaaatgatgaatgtgtgaataattctaatgaaatattgacttataaaacaaaattaataatattctgggtgggcatggtggctcatgtctgaaatcccaacactttgggaggccaacgtgggaggaatgccttagcccaagagtttgagactagcctgggcaacataggaagaccctgtctccacaaaaaaattaaaagattagctgggcatggtgatgcacacctgtggtcccaactacttgggaagctgatgtgggaggattgcttgaccccacaagatcaaggctgtagtgagctgtgattgcaccaacgcactccagcttgggtgacagagtgagaccctgtataaaaaaaaaaggtgtcaaaatagtgtcgtaagtgagtacatattttaagaagataaaatacaaggcaagaataacataattcaaagttgaatttaaatgttctaaattcattgtattgtccaagaggaaagacacttattaacttcagactttatgaaacacacacacacacaaacacacattaatttaatttataaaataaccagtaaaagaaaaggaaaaatgtgtacaactttgaaagagaggcagacagaaaaactgagatgttaaaaaatgattaatataaaaagggtaagaaaggaaaggaaacaaaaaattagcagaataagtagactgcattaaataaaagagtagctataaacccaatgatatcagtatttacattaaatgtaaatggtctaaaatttcaggaaaaagttttcagactgggttaaaataacaaaataaaataaacataataacaagacaaaatgaaataagacaaaataaaaatgaaatctaaatctacaccatctattataaatacgtttaaagcataggatacagaaattttgacattaaaaagacagcaaaatacaccatataattagtaactgaaagaaagatggtatagctactgaaatagataaaatagctaagagagtaaaagaacattactggagacgtagctgttaacttcatagttatacaaagttctattcatcaggaagatacagcaatttgaaacgtgtatttatgcaatagcatgattaccaaatatataaagtaaaaactgacaggaatatgaaaacaaatagataatttcactaattgatagaacaagctggaaaaaaaatctaagtttataaaatatttgaaaaacatgactgacaaaagtgaaatgactatataatattctgcacccaaatgtagaatacaaattattttcatgcatacagggaacattgacaaaagttgactatttactaggccactgagaaagtttcaataaaattaatgaaatttaattcatacaaacactgttctctgaccgtaaacatataagttaaaatcatatataaaatgacaactagaaaattagcaagtatttggaaattactaaacattttgaaataatccatgaatcaaaaatcatattgaaaattagaaaaatttaaaaaactgaactataacaaaatactagatatcaaaacttgccagatgaatctaaagcagtgtttaaagcaaaattatcaggcttaaatgcatacattgtcaagaataaggctgaaaattaatgagcaaagcataccctcaaaaattaggaattgcagactaaattaaacctaaggaaaatagaatggagacaatgataaagacatgagcagaaattaattaaataaaaacaaaactgtatcaaatcaaaccaaacattggttctctgaaaaaaaaaaaaagacagacaaaccactgactagattgattaatagagaaaaaaaaaagaaagagaaggcaaaaacagtgaatatcaggaattgaaacaaaaggatatcactgaaaatgctacataaattaacataacaaaaggatattataaatgattttatgcccaaaattgaaaagttagaaatatgtacaaatatctagacaaacataacttgacaatactggcagtcgtagcttgtgaggtctttccaaggaaattaccacacattcgtggcttaaaacaacagaaatgtattctctcacagtctggaggccaaaagtccaaaatctaggttggttctttctggagtgtctaaaggaaaaatcatcctagcttgtggtagttgccggcaatccttgacggtccttggcttgcagatgcattacttcagtctctgcctccgtcttcacatggccttcttcttgtacatctcctgcttgcttaagttgccttcctttttttttttctcgctctgtcgcccagggtggagtgcagtggcgcgatctcagctcactgcaagctccgcctcccgggttcacgccattctcctacctcagcctcccgagtatctgggactacaggcgcccgccaccgcgcccggctaattttttgtatttttagtagagacggggtttcaccgcgttagccaggatgatctcgatctcctgaactcgtgatccgcccgcctcggcctcccaaagtgctgggattacaggcgtgagccaccacgcctggccaccttcttcttataaggagactagtcatattggattttgagcccaacataatccaatatgacttatcttaagtaattatatctgcaaagactgtatttaccaataaggtcacattttgaggttctagatggacatgaatttgaagggacactattcaactgagaacactgacttaatgggtcacagaaaatgttaatgcttttataatcattaaaagaaccaaatttctttccactatggcaattccagaagtagatggctttatgtggctggagagtgccacaaaacattaaggaaccaaaaatgtccaatcttatataaagcattacaaagaaatgaaagcaaaatgtcactcccaattttatgaatatagaataaccttgatattagtgagaaaaaaatacaagagtagctcagttatcaacatacatgcaaaaaatccttaaagaattagaaaattggtctcaaaaaattagaaaattgaaggaagcgacttatgaaaagaaaaatacattattaccacattaggtttatcttaggaatgcaaagttgatttaacattagaaaatcaattagtgtatttacagctttaacagattagatttgcagattgatatggagagaatggacttttccataagtggctctggaaacacagggtatcaatatggaaaaaaaatcaggccactccctcatactataccccaaataaattagagttgcattatagacctaaatataaagtacaaaactatgaggatttcagaaaatgatataggagaatatttacatgatcttgcagtaaatgaaggatttcagaaagcagcaatttaaagaagcaataaatctgactacattaaaatacagaactttggttcatcagaaaacaccctgcagtgaatttttatggaaattatacttcaataaaagatggggaaaattcaaaaactgtatgacacctggcagggtcaaaaaacaagccacagaggtggcaaacatatttgtaatacaagtacccagaataagagtagtaaccagagcatataaaaaacattgataaattaataagaaaatagcaaacaatgcaatttgagaaaaggacaaaggatttcaaggggcacttcacaaaagaaatgcaagtggacaattaatatttgtaaagatgctcaaacttagtaatcagggaaattaaaatcgcaattaaatgccagttagtagtcaccagactggcaaaaattaaaagtgtgacaatacttatgttggcaggcatatggagccataggaactcttatatacttcttgtggaaatgtaaattgatacaaactatactaaaaagcaatttagcattatatagcagtagaaaagtgtgaaccccatgatccagaaattccatgcttaggtgtatagcctacagaaagggttacacatgagcaccaagatccatataaaagaattatttgtagcagtattgctagtaattatcccaagctgaaacaacttctacattgtaaaagcagcagcaaaaaatactgaaatttatgcctttagtaatacaatcaagtattgtgcaggtgaagaagctgaggtgcaaagaaatgcaaatgtttaccccaaatcacaataattaagtgacagaggtaaccacttaattgtggctgcaagcaatctaacaccaaacctttagctattatattacactctgctgcctctcatgaatttgttatgggtggaaaggaataaaattaggttgaggtatatgaaattgatatttttgaaggttagggagttgaatattagcaatttgatatgactcagactaatagtttaaaagttctgagcccaattggcctgaaatcacatagtccagtgtaacagcctacttctccttaggggtctcagtttctaagttgtgttttattagtttaaaaaaaggtgggatttttgtttttttgtttttgtttttgggtgttttttgttttgttttgttttgttttttgcttttttcccctaaaagccatcattgctaagtattctggttgattctttctcctggttttcattttattaagtggctgtggcacaaaacacaggcgactgaagtgaaagcaattacaattttcgacatctgccaagaaatatagtctttggcatgcatttgtactagtcacccacttttgggcaacagagagtctttccaaattcaaagacccagacgaatctttttctggaccgcattatatcctgaataagaaggagccatctgtccttgggcctggttccccagaggactatatacaacacaaatccaccaataaaattgaaagagccttccaagatgttacagaagccaattgttgtagtacacattgcatcagtttgcatgcaataacacattgcatcaattttcatgcagaaaaatatctaccagaactgtattttaaggttttaagaaggcagtagaacacagaggagtatgaaaagcaggtcacgaaaaattgggttccagaaaatatttatgatttcacaagtcagaaatctgttgggtatggaaaaaatgaactgaaagtttataaatgctcgagagacctcatcttgaatacaggagattgaattaaatagcttagaaaaggaaaaatataaaacggccattcagttttgccctaaatggttctaatggttgaaagccagggttttcttttcatgcagaaataaagacatcaaaactaaattagaagtcttcaaaataggccaggcgcggtggctcacgcctgtaatcccagcactgtgggaggccgaggcaggcggatcacgaggtcaggagatcgagaccatcctggctaacacggtgaaaccccatctctactaaaaatacaaaaaattagccaggcgtggtggcaggcgcctgtagtcccagctactcgggaggctgaggcaagagaatggcgtgaacccgggaggcagagcttgcagtgggccaagatcgtgccactgcactccagcctgggcaacagagcgagactctgtctcaaaaaaaaaaaaaaaaaaagaaatcctaaaaaaattccctggaataatggggaaattaattttttgatacattttgagttcagataagggtttgaagaatgagaaaatcctgttaaagttcagggataagtcctgttgttgtttttttacccaatagtattaattaaactaagagaaaactaagtaatttcctgttcctacccctgcatttcctctcttctatctccggaccaactacagatttagactaaccatatacagtttggattctaataacgtttttacccttcatgagttcatgagtatggattcttttttatttttattttttgagatggagtttcatccttgttgcccaggctggagtgcaatggcgccttctcgactcactgcaacctctgcttcccgggttcaagcaattctcctgcctcagcctcccaggtagctgggattagaggtgtccatcagctgcccagctaaattttttgtatttttagtcgagatggggtttcactatgttggccaggctggtctcgaactcctgacctcaagtgatccacctgcctcggcctcccaaagtgatgggattacaggggtgagccacctcacctggccccatgagtatggattctaataacatttttacccttaatgaatataatcttcccaattcagatgaaatgaggtatagatacaagcaaagtcagggacatttttttcagacagtatcttgctctgttgtccaagatggagtgctatggcataatcacggctcactgcagcctcaatttcccagggttcaagtgatcctcccacctcagactcctgggtagctgggactacaggcatatgccaccatgccgagctaatttttgtattttttgtagagatggggttttgccatgttgctcaggctggtctcaaactcacagggtcaagcaatctgcctgtgtcagcctcccaaagtgttgggattacaggcatgaggcaccatgcccagtgggatatttttggaaaatattgtcaatatatctcatattcaaattttcatcttcctactttaacttaagtttggcatgaaatgactttattaatgtcagtcttttcaaagtaaactgaaagaactattcgaaaaattacagttctcaagaaagctgaggcctcctccttagtgacattatctcaagaagaaaattatttgcttcacacttttggcgcagggataattctataggaaagaatttgcaacagtttaattacccttttgtgataatttaaaaagaagactacttgagattttagctgtgccacagaatgccaaatattttagtgtaggtcttgttttgttactatgtaagagatttaagattaatgttttatcatactttacacttacaaggaacggaatatcctcgtgcttctcactgactgcaggcatacaccctataaaatgttgaggcagatattcccagggcttcaatttctcattggaatttaaagctttcgaaagtgtcattaattctttctcagttgattcctgcagggaggctgatctgttccaggcctttctcagaaagaaagaaaataattaactaattaacaataattagaagtgaccttgattgttaagatttaaaaaaatgttaacgacctctgaaaattaaaaaaaaagggctttgagcttagaacatagagaccatagaggtcacaaaaggaattattgctagcatacccacaactaaggtcaatattgataagaaggataagaagtttgtgtcttatccaaggactctcataaactcatgattcctcatctttaaaatggggatgatcatagtatgtgcctcacttgatatgcggactaaggcaccttaggtatgggatataaggaatcgtgtatgacgacaaagcacctgtaacagtgcctggcacatagtaagcaacatgtaagtattgcctactattattgtaaaataatatgtttagcattctaagaattttgttttatttcctatcaagtttttatatttatgtgcaggtacttaaagtgtcttttgaacaatatgctgagttaggtttgcacttctaagcgtttatattttggttacattttgcataaaataaattgtttattctgagatagactataagtggttgagtagtttgtgagagatattattgcattgtttttgttattcagtcatattagaacctaaaaatatctgtatggtacatggagttagatgtctgtcctctttttacagatctctagggacaagatcccatcccactcttctttttcaggataatcaaaaaccttatggtattcaagaagttccacaatagtttaaatgtgaatattcagttctatgtccttccaaatccttactcctactcattttattgcatttataatgagttttaaatgcaatttcttccctgttatatgcatatgtttgaaggaaataaagtttaaaaataccattacagtgaaatgttttacaaaatcaaaaagattcctaatcccagccaattaaccacttaggttaggtaatattgaagttgacccacctcattacagcaaaaataattttctactttatgggaattcattgtaataggatgtttgatagataaatagactttcattctatttgtaaaaattaattttagaagtttaaaaataagcacttaaaccaatgtacatgtctattagaggcatagcgtagaaaatgaataccccttttctttctctcatttagaaaatagcactgcttaacttccaacaatatattaaatagattatgacattttgtttcatctgcacttaatgaattacatgaagatttaatcacaaaaaagagtattttgcccatttcttcttattcacaagttttattatggaaaaaatataactattctttacgctcaagattatttagttcatcactggaacatttggaatttttaaaataagcaaatgagaggttgcaatgagctgaaatcacatcactgcattccagcctgggcggccaggggagaccctgtctccaaaaaaaaaaaagaaaagcaaacaaaatgtttcatatattcttctagcagtatcaaagaaaagaaattgccaagatccttttaaattctgaataaatatggctttctgaccatgccaattaatagcgccatgagcgcatcaaccaaacccataaatgggcttacataatacataataataattcaatcatattatagaattgatcataagatttgcagaaaaattaaatggaccaacacatttatcatgttctggtacgttaatctgaatgtgcttatgaatattcagatacaaacatataaatgagtataggaatgcatacttacataaaacatgtacaccaacacatcaaaattgacaaagcagtctatgcaaattttcttagtcggtctttaatccacaggaaatgaaactattattactttaagaagagataatccattgcattggtatgagggagagggagggtatggggtagaagaaagaagtgaattcttcctctcttctcagaaaacactggaaaatttcctcccactcccaagtttataactatttaattcaaaactataagcaggaaaatggaatagcttgagccaaattttcttcaatatttgccaattagagatcagaagttcattcattcattcattcattcagatactgagtatatatactaggtgctgggtttacagtgataaacaaaaagcatagtacttaccttaaaggaaattgaaatcttgtagagaaccacagacaataaacacacagacacacacacacacacgcacacacaccaaaagaactattatctaatgttttaattaaataattataaaatggctaaggaatttggtaaatttgagtttactagtccgtatttcccatacgtaaacttgatgcgtgatctttagatggccattttcattcattgtagtcacaattcttagaacatgaccatgtgcatcagaatttcttgatttttggatcagcattcaaaactcactgttccgtgtgatctttcttttagaaagacaaattctactactaagccccaaggtctatccattattgtccagacaaataatacttttccatttttggttttatttttattttaatttttttattttactttaagttctggatacatgtgcagaacgtgcaagtttgttacataggtaaatgtgtgtcatggtagtttgctgcacctatcaacccgtcacctaggtattaagcaccacatgcatcagctatttgtcctgatgttctccctcccctcacccacaccaacagaccctagtgtgtgttgttcccttcactgtggccatgtgttctcgttgttcagctcccacttatgagtgaaaacgaggtgtttggttttctgttcctgtgttagtttgctgaggatgatgacttccagcttcatccatgtccctgcaaaggacatgatctcattcctttttttggctgcatagtattccatggtatatatgtaccacattttctttatccactcaatcattgatgggcatttgggttgatctcatgtctttggtattgtgaatagtgctgcaataaacatacgtgtgcatgtatttttataatagaatgatttatattcccttgggtatacccagtagtggaattgctgggtcaaatggtatttctggttctagatccttgaggaattgccacactatcttccacaatggttgaactaatttcattcccaccaacagtgtaaaagcattcctatttctccacaacctcaccagcatctactgtttcttaactttttaatcatcactattctgactggtgtgagatggtatctcattgcggttttgatttgcattcctctaatgatcagtgatgttgagcttttattcatatgtttgttgtctgcataaatatcttcttttgagaagtgtctgttcatatcctttgccccatttttgatggggttgtttgtttttcacttgttcatttaagttccttttaaatgctagatattagacatatgtcagatgggtagattgcagaaattttctcccattctgtaggtggcgtgttcagtctgatgataggatttgtgtgtgtgtgctgtgcaggagctctttagtttaattagatcccatttttcaatttttgcttttgttgcagttgcttttggtgaattcatcataaaatttttgcccatgcctacagacatataatacttttctaaagatcatcttgttattgttttcatcatgatcccatacattaatatatttatctcagccagtctagaagacagagtgagattttgcaccatctttaaaaaaaattatttaagagtgaggctccttggaggacattgacgtgttactgatctaatctctatactttcagttatttgaagctatgcatcactgtcttctttttgtttcttggacataggacaattaacttttcataggaaatgttcctagatcaattaatagtcttcaaatagttttcaaatcaaatagtcctcaaagaataatcttttcattacatttattagctgtattatcctattcccaccctcctttaatgggagattattatggattttcatacttatctttctctttcattcatagggagtacgggattgaaagtcaggaaatctggtatctagatctggctctattattgaataatgcataaacacagaaaaatcagtaaacaacaccttaggcttttttttttatttattcatccatccatccatccatccattaattcagccaatatatattaagcacttactactttgtattatacactctcctaatcattgcagctagagtggtgaatataaacagacataaagcttatattcatgggagaagagagacaataaataaaataaaggagtcagtatagagtaagttagatgttagtgagtgctatgaaaaaaaataaaatggtgagaatagcgagtatcagagagagagagagaagtatgtacagtgttttgttagtgatgcctgtacaagatcacttgatcatgatcagtgattttagtatttgattagtgtttgtgacaactttaaaagtctatgctttactgtttcctgcctcaatcagaaaataacatgaaaatagcaaaagcttaaggaagactcactaataattcaaaccccaaaattatataaccaaaatgcctgcaccttatttctagatgtgttctttgttgcttgtgtaaaaggcaggcaataataaacacctattatgcttgtttttgctaatttatggctacctcttttaagcagcagaatacaatctggtaatattctaaggatgtgttcttcttcaatttactgttgagtttagccacatgtctttttttattttattattattatactttaagttttagggtacatgtgcacaacatgcaggttagttacatatgtatacatgtgccatgttgttgtgctgcacccattaactcatcatttagcattaggtatatctcctaatgctatccctcccccctccccccaccccacaacagtccctggtgtgtgatattctccttcctgtgtccatgtgttctcgttgttcaattcccacctatgagtgagaacatgcggtgtttggttttctgtccttgcaatactttgctcagaatgatggtttccagtttcatccatgtccctacgaaggacatgaactcatcattttttatggctgcatagtattccatggtgtatatgtgccacattttcttaatccagtctatcattgttggacatttaggttggttccaagtctttgctattgtgaatagtgccacaataaacaaacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaaaagtgtaaaagtgttcctatttctccacatcctctccagcacctgttgtttcctgactttttaatgattgccattctaactggtgtgaaatggtatctcattgtggttttgatttgcatttctctgatggccagtgatgatgagcattttttcatgtgtcttttggctgcataaaggtcttcttttgtgaagtgtctgttcatatcctttgcccactttttgatggggttgtttgtttttttcttgtaaatttgtagattctggatattagccctttgtcagatgagcaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattacctagcttttcttctagggtttctatggttttaggtctaacatttaagtctttaatctatcttgaattaatttttgtataaggtgtaaggaagggatccagtttcagctttctacatatggctagccagttttcccagcaccatttattaaataaggaatcctttccccatttcttgtttttgtcaggtttatcaaagatcagatagttgtaaatatgtggcattatttctgagggctctgttctgttccattggtctatatctctgttttggtaccagtaccatgctgttttggtgactgtagccttgtagtatagtttgaagtcatgtagcgtgagtttagccacatttctttgaaatgtaagaggctatcctggatctacgtcaaacagaccaactcaccacaaatcaaagatctatgttccagactggaaggatttttctcatatttgttgtgctgacagagagctgttgtttctcagctaagaatactgggtgttgggattgaaggaacataataccttagagctaatgttgttgctgttgttttcccttgagttttcttcttaagatatatagcatatatagatatagagataaacttggataccttcctgccaagatcttaggatacttatttacaaagagagaattttcgggaatggcctaagtagctgcaaacatctgagagatgcaatgaatgctagaggtgtgatttgctaattattgccacttttgaaattctaattcacataaagattaagtgttaggtataggaaaaccgcagaaaacttcttggatttgtagaagtgtctgtaaagtctgattcaaacaactcaggacaaataaaaactaaaaataaatttgcagaagctcaggattgggtattttacatgtataatctctgtagcacataacctggcagtgtgaattccgttttggacaggtaaggctgttaaatgcagcagaggtcgctgaaaggatctgcatttgacactttggagatggatatgcatggattctgatcctaattcctgttacttaatgtctatattactttaatcagttcttaaacttatctgaacctcaccttctaaaacatctataaactgcagaggaggcaaactgcatttagttatgaatagcaggcaccacatgctccacaccacagggccatctaataaatttctcagatataaatacaattgttttctttcatttggctccttgtgatgtcaaagggctcccattcagacaacagatctctcttctctttgtcttcctaagacctgatcttcttgactcagtaccttctgtgcctcactttccactacccagtgatcacgtacaagggcaaaagctactgttatctgaggatagaatgcccccgtcacctcactgaggataagtctttagttagttgtatctggtcatgcagatgcatattccaagaaaatgtgactctcatctaataacagcataaattaaattgttaaggagaatgtccactgtcgtgagaaatactccttggataaatgtgagatatccctaaaataattcatgctggtaaggttagtttcattgaaattggctccaaacatctgtttttgcaaatctgcagctggaaaaaggttgtgatgcagtaatttgtcttgaaagaagacattcttattaatgcataagccaaagttagttgacttcctttagcttactttcattatcaccttatttcctggccatagcttcttgcatcttataagcctttagtcaagcaacatttttttaaaatagtatcctgttctggtaagaccaatatgttgtcacctgaaatctatttggtaatatttttgtctctctatatcttgaattttgatgcctgtagagacattctttctgccaagttgtggatttctttactccaatctacctgtatttgtcctgaggtaaattcttgtgaataccatttaatatagggttttctaattattaagagttcagtttcactgattggtcaacactgtgtcttgaatttctaacctatgccacagtgtatataaactaaacatccatgggcacagaagtggccttcagattttacttcctggccttaaagtaattaaaggaaaaattccttgttgtgcaatcagggttaaatagggttagtgtctataaaggagcacattgttccataagtgttctcacttgggaagttggcaacaagtatttaatcaagctaaagaaaagtttgccaaggcagacagtgggtgactgaaataaccttagtcagactggaatgaagtctgttctcataaatggagtacctggctgtagccaagaacagtatatatgaaaaagaataattcctgggatttgaggactgaacgatcagcaattagggaacaggcaatgtctgactgggaaacaagagtaaaattaattttgtagttattacctacaccagatgttctggcgtgcatgtggtaaaatagaggtcttcggaaatcacaaattttggtaagaacatttgcttacttcatgtggtttcaaacaagtataaatataaatcttgctgtagattagtagtattagtattaacattgccctgttaatctcattgagcctataagaatgatttggacagctctatattcctcagataattaggaagacaattactagtttatactcagagtcttagaactagaagagaccttaaaattcaaagcgctctgttccttcattttgcagatctggaaaccaaggcttagtgaggtgaattgattgttctaatgacacagagctaagtattatgaaagccaggagtggagtccatatccagggtttgtccactgaaccagaccacagtcctttacaatcaagagaaccctaggcacttagggcttctcaagaatacctggccttggttatgccaagaacttattaatctgataaattcacagtgtttggggtattaatgtcagaaaatcatgtaattattgattttccctaggatgtatgtattttagcatgctttaaacattcatgctttaatgtctaaagtgttcagttgcatgtaataatttttaaagtgtggatgttagcagaaggctgcataacttaacgggatttgactgatgtttcaggccagaagtaggttgcctacacaaagagaaatttcaaacagggctcatagtctttaaatttagttaagtgaaaacccattatgttttctctgcaatgttaaaaatgttatgttagttatcacataaaaatactacttaaccataatatgttattgcaggtcatagtaaagacaacacattatcttagcactgaataaaaagctttctcattctacacaaatctaccttatatgtctaaatccttgactcctaaaacattaggaaacatctcctgttaattaagtagctaattactgaataaagtattttgataaagttatttccataaggttaaacagcccagagcgcacacacacacatatatatgtacacttaggtgccccaggtacgagtgacacagaaccataacacatgattcctaaccttgatgtttccagaaaaaaaaataaaaagcaatgcagagtagtctagatcaagtgacaaagctataataagtgccatatgaagtaagagaagggagagatgactaagaattagtcatcagagagaggctttattgagacattatcaaactcaaatgacattttcttgaagttcaaagttaccactagtgaatttcaagggatggaaaacttttaactttatgttcaatatgttctcttaagataatattctgtagagaaacaatttctgccacaacccactaaaaccaaatgctgctcaaaattataaaataacagtaagataaatctcagcattgtgaaccctttggcatttgttatcattacttgtttcaccccttgtgagttacaaagagttagcatgaaccataagtccaaaggtcactcgaaatccctcctctctggaaaaaaaaaagaattactttaattacaaaaaaaaggtatttttagggatatttcaaaaattttagtacatatgcattcttaccacaatgggcagaaaaataagcctttttcaatatcttaaatatatactataaataattcattaactaaaaaggaataaccagtagtatagacttgaattcagcagtagatgtattcattcaagaagttagtactaagtaagacacttactttgaattacagaattttctaggttctagaaaataaaagtgaataagtccacgtcagtgttttcaaggaatcatataattataatttgtctatttgtatacaaatcatataatttgtcttatttgtatgtttatatatatgtacatattccactatgataatatttgataaatgctaaactagaggtatacacaaacttctaagaggaatatatcagttcagaagtctgattcattaatttgttcatttattaatttaactgatattcatttagggcccactatgtgtgaggcactgttctagatgtttcccaaaaaaggtgacttttgagtagggtcttaaaatgtaactgggtttttgagaggcagaaaagaggagataaggcttgattttatagacagtgggaatgacataggaattaatgaaaatgtaagagtgtgatgtcatcagggaacctagccctttgagtcaatgtcagaggaagctggaaaaggtgggtagatgttaaattataatatgctttgaatttcaactgaaattaaagtaaatttggagattattgtttggaccatagaacaccatatttttcctgttaaaactttttgaagctataacagaaataatatgatttctattttagaaaaatacattttgtgggaatactggattcaagtagaggaagactgaaggcatttatcttttacccacatccatcttttatacattttctcaagccttctcaaatcatcatcctatctgaaggacatttatgccccggaagtaactcgtggcatcagactgaccttggccacacttcagattgatggagaatgtaagcattagcatttaattcattggcacttctttggctagccatatatattttttcttggctgtccttatttttctcatatattatgccaaagagcatctcagacatcagtagctggtaataagctgaaatagctccatgtgtcactgcaacatttacgtaaaaatagatattactagcagaatctttacagtgtggtcctcgcctttgcaataaagacaaagaccaatctggcttagaaatcaactcacagtattggtgatcatataatatatactgacttatcccataggaacaagtttctttagcaatttatttagctgtcttctcacagaagcaactcacatttcacaataagatatgactcaatagtctctctgcgcatgcgtgtcagccaataatgcttagtcagaagaactcaagacagtctatgaagcagtagggaatataaggcagcagtgaaagaacttagagagcccattaataggaaatggagagcatttggccgtctttattgggagtggggagaagcagacctgtatattcacatagctaccaaggcctaattcaggatttttttcctcaaatgttatttctgatgttaatatttttcctctggcttttctatgttgcttaagcatacagtattaacccgtaagcatttaaaaatacttgtctagatcacatggaagaggttccactcagaattgtacatgttctcccaaggttcatccatcatcagtgtatccaagaaaatgtaagcactaatttacctggaatctaaggatagaaagaaatgcaacatcattcattagttgctatagatagatgtggtatcctgatgtggtaaaataaactccaatcaggagtaattttcgtgcatgactctgactattggggatgtatctgcctgcctattaacgtggtgtactttacatagatttttttaattttgtgagttagatcttagaaaataaacactggctccttaatagaatttgagcatttggggacagctgtaaccaatctgacaaattctatcaaataacttccttgtcaggaaagcctggtttgaatacacatattataaaggtattcaattgaataactttaattgattcagtctttaaaaaatatttttaatatttgtgggtacatggtagatgtgttcgtttatggggtgtacatgagatcttttgatacaagagtacaatgcataataatcacaacagggtgaatggggtatccatcacctcaagcatttatgctttctttgtgatacaatctaattataatcctttagttatttaaaaatgtatgataaattattattgactgtagtcaccctgctgtgctatcaaatactagatcttatttgattcaaacttttaatcaaatggtttaattaaatcattttaatttgaatgatttaatttaaatattaatttggttacattttcaaaaccacaaagaaacagtctctgatgaaagtagtagtgcaatgagatacaggggcaacaaagaattctcccccacttcaaaaaggtccatttatgaaatttcttgcatcattttttcaagagatctgcctaataaattaatttaaattgaggcaccgtaattttggaatcagcaacagggattttgtaatagaattatgggagccatttagcactggctatggtgtattcatatgtgattttaattgcatgaagttccaaatacaagatcatgaactttcttatctatctcttttacttaacagataggggcctctggaagctagctgcaaagttcaatctaatgatactgttagatactatgatgggaaatcatagatgagagcaggagcttttgcactgaatttctgtgccatttcctggcactcatattaaaattataaactacttaaatccaaaatgtagccatcttagaatgtgccacagagttttacaattttttctcagaaatatggttcagtatttccagagagctaaattaattgctagaaactcctctgacaacccaaccaaacacaagctgttatgaagcccatgatgataattaagacttaatgaaattttgctcatgatgatgcctttagctttatattttctggcctgattttattgccatgctatgcttagattctttctttctttctttctttctttctttctttctttctttctttctttctttcttattattatactttaagttttagggtacatgtgcacaatgtgcaggttagttacatatgtattcatgtgccatgctggtgagttgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggcgtatatgtgccacattttcttaatccagtctatcattgttggacatttgggttggtcccaagtctttgctattgtgaataatgccgcaataaacatacgtgtgcgtgtgtctttatagcagcatgatttatagtcctttgggtatatacccagtaatgggatggctgggtcaaatggcatttctagttctagatccctgaggaatcgccacactgacttccacaatggttgaactagtttacagttccaccaacagtgtaaaagcgttcctatttctccacatcctctccagcacctgttgtttcctgactttttaatgattgccattctaactggtgtgaaatggtatctcattgtggttttgatttgcatttctctgatggccagtgatggtgagcattttttcatgtgttttttggctgcataaaggtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctcttcagtttaattagatcccatttgtcaattttgtcttttgtttccattgcttttggtgttttagacatgaagtccttgcccatgcctatgtcctgaatggcttagattctttttgtccacatagctgaaaaaaatattataattcctctattttcactcttcctttaagaaaaataaatcaagccacttaaatattgcttattcacctgccttttcaaatatttaaaggaacacctaaattgtgctgagctgtgtgttgagtgctggagatataatagtaaacaaatgctccttcgttttaaggagttgtaattgaggaaactgacatggtagctaatcattttaatagaaggtgggataattgtaaagctggatctatgccagagtttcttgtgaatataaaaggaaaataactcatgaacgaggggacagttccaagaaaggatttgtggaggtggttacacctaagctactgatattctgtctcaaacttaggtttttctagtctcaaagtccacacttattccactgtatcacattatagtagaggctgtacaatgccgaactaacagctaaatgtggctgaacaataagtttcttaatctaataataatatgcttctatttctcataaggttgttgagatgacaagaatgaaaatcattaagaaatagttctctccaagatgatgtaatgctaaaattgcatatgattactttgtttctgcaaaatgttgcaatagccaagagactttaaagtgatcaaaagaaataaaataaaaattaaaaacccttcagctttagtatatggattctggagtaagatactgttatctactttttaagaaggattaaacaacattattaaaaacatttcaaatgaatgcttacaccagaagactgtagaatgctgaacaattatcagtgatcttaagtggcaagtaagctagtcttttgccccatagcatcctgtgttagtggtccatttaacaccttcagctagtatttccagggacttgttacagggacataaatttcaagcagaaaacaattcaaaaactattgaagtccttggtctggtgtctgcttcctctacattctttccctaggcaatacaaccactttcattttttatgctaccatttgttgatgacacctagatctaaaatccaggccacaggctttttccagactttcccttcaagtgttatgaagattttttatgccaagaggaaggcttatctttggtgaaaaagtatgtcaaagaaaaaggaaaccggtcattgtcctgggaacgaaatataaaagttgagagttaggtatatagccaaatagttcatttaatctgcaggaaagaagcagaacagaaactaggctctgccataggtacaaatggattaaatgaagcttttttgctattatgtttatgctggtgtttcccatggggtgccatgattgttctattttactctgtagccattttttcttgccctttttgcttttgtttctgcgtgcctgattctcaaactttgacatatgaccaatctgtttctcaggctgtagacatacaccttcattccttggctaaccttttttcttccttcaccagaactgaggcccttctcttgtgatagagtgccaaagtcaatccattattacaactctgcacctgtctccacccctttttttttttttttgccatttcctgacttcaattttaattgtgaagcaagattttatttcttttaaattttaaattttggtgggtacattgtaggtttgtagatatatatatgcaccatatatatatggtatatggtgtatatatatacacaccatatagatacacaccatatatatacaccatatatataccatatatatacacatcatatatataccatatatataccatatatatacaccatatatataccatatatatacaccatatatataccatatatatacaccatatatataccatatatataccatatatacaccatatatacaccatatatacacctatatatacaccatatctataccatgtatatacaccatatatataccatgtatatacaccatatatataccatatatataccatatataccatatatataccatatatataccatatatatacaccatatgtataccatatatatacatcatatatataccatatatatatacaccatatatataccatatatatatacaccatatatataccatatatatacaccatatatatacaccatatatatactatatataccatatctatacaccatatatataccatatataccatatgcataccatatatacaccatatatacaccatatatataccacatatatacaccatatataccatatatgcaccatatgtatacatatatacaccctatatatacaccatatgtatacatatatacaccctatatatacaccatatatataccatatatatacactctatataccatatatataccatatatataccatatatatacaccacatatatacaccatatatatacacaccatatagatacacaccatatatatacactacatatatacaccatatatatacaccatatatatacacaccatatatataccgtatatatacacaccatatatatatactgtatatatatacaccatatatatatactgtatatatatacaccatatatatatactgtatatatatacaccatatatatatactgtatatatatacaccatatatatacaccatatatacaccacatatatacaccatatatataccgtatatataccatatataccatatacatcatatatatcatatatatcatatatatcatatatacaccatatatacaccatatatataccatatatacactatatataccatatatatacactatatatactatatatacaccacatatatacaccatatatacacaccatatagatatatacaccatatatatacacaccatatatatacaccatatatatacacaccatatatatacacaccatatatataccatatatatacaccatatatatactgtatatatatacaccacatatatacaccatatatataccgtatatataccatgtatatacaccatatatataccatatatacacacaccatatgtatataccatatatataccatatgtatataccatatataccatatgtatataccatatataccatatatataccacatatatataccatatatatcacatatataccatatataccatatacaccatatatataccatatatacaccatatatataccatatatacaccatatatataccccatatatacaccatgtatatatataccatatatacaccatatatataccatatatacaccatatatataccccatatatacaccatgtatatatacaccatatatatatacaccatatatataccatgtatatatacaccatatatataccatgtatatatacaccatatatataccatgtatatatacaccatatatataccatgtatatacaccatatatctataccatatatatacaccatgtatctataccatatatatacaccatatatctataccatatatatacgccatatctataccatatatatacgccatatctataccatatatatacgccatatatataccatatatatacgccatatatatataccatatatatacatcatatatataccatatatatacaccatatatatatataccatatatatatatggtacataagatattttgatacagacatacaatggctaataatcacatctaggtaaatggggtatccattaccttaaatatgtatcctttctttgtgttacaaacaatccaattacattcttagttattttttatttattcattttttttttttgagacggagtctcactctatcaccaagctggagtgcagtagtgcgatcttggctcactgcaacctctgcctccagagttcatgcgattctcctgcctcagcctccccagtagctgggactacaggcgcataccaccacgcccagctaatttttgtatttttagtagagacggggtttcaccatgttggccaggatggtctcgatctcttgacctcatgatccacccgcctcggcctcccaaagtgctgggattacaggcgtgagccaccgcgcccgccccattcttagttatttttaaatgtacaatataaattattgttgactatagtcaccctgttgtgctgtcaaatactagatcttactcattcttcctaactatattattgaaactattaaacatccccacttctctctcccctcccccaaacccactacccttcccagcctctggtaactgtcattttaccctatctccatgagttcaattgttttaatttttttagctcccatttataagcgagaacatgtgaagtttgtctttctgtgcaaggcttattttgcgtaacacaattacccccagttccatccatgttgttgcaaatggcaggatctcttttttttatggctgaatatactccattgtgtatgtgtacattttctttcttcattcatctgctgattgacacttaggttacttccaagtcttacctgttgtgaacagtgttgcaacaaatatgggagtgcagatatctcttcgatatactgatttcccttattttgggtatctactcagcagtgggattgctggatcatatggtagctcaatttttagcttttggaggaacttccaaattgttcccatagtggttatattcatttacatttccaccaacagtgtaccaggcttccgttttctccacatcctcgccagtgtttgttattgcctgtcttttagatgtaaggcattttaaccggggtgagatgataccttactgtagttttgatttgcatttttctgatgatcaatgatagtgagcccctttttgtatgactgtttgccattcatgtgtcttctttggagaagtatctattcaaatcttttgcgcattgttcgattattttactagatttttcctatagagttttttgagctccttatacattctgcttattaatgccttgtcagatgggtagtttgaaaatattttctcccaacctgtggccaccaccactgggactgtactaggtcagacctgaggccaacacagaaatgggtctgcccaggtcctgcaatgaccactgcctggctactgtctatgtttgctcaaggcccaagggctccacaattatttgatgacaaatccagccaggcctgtgtccttcccttcagggtggtgagtttccttggccctgggcaggcctggagttgctgtctgggagccagggtctggagtcggttaccttaggaatctacctggtgctctagtctattgcagctgagctgacacccaagctacgggacaaagttcttcccattcttcccttccctttcatccagcagaggaatcacttcccatggccgccaccaccccatgcacgtgacgagtactgcctggctacccctagcaatcactcaaggcccatggggctcttcagtcagcttatggtaaatgctgccagtccagtgccttttttttgttgttttttttttgacagagtttcgatcttgtcacccaggctggagtgcagtggcgcgatctcgggtcactgcaacctctgcctcctgggttcaagcgattctcctgcctcagcctcccgagtagccgggcttacaggcgcccgccaccacgcctggctaatttttgtgtttttagtagagacagggtttcactgtgttggccaggctggtctcgaactcctaacctcaggtgatctgcccacctcagcctcccaatccagtgccttttcattcaggccagtgggctccactctggctcaaggaaggtccagaaatgctgtccaagaaccaaggcctggaaccggggaccccaagagcccacttggtgctctgccctactgtcaccaagctgttacccaagctacaagacaaaatcccctttactgttccctctcctttcctcaatcagaaagagtctctctccatgaccatcacagctgggaatgtgctgggtcacatctgaagccagcagggctctgagtctcacccaaggcccatggcaaattctgctcggctaccactgctgattattcagggacaaaaggttctttagtcaggaggtgatgagttcttccaggacttggtcctgcccttcaaggcagtgggttctcttctggcctaggtgtgttaagaaatgttatccaaaactaaaacctggaatgagggcatcaggactctgcctggtatcctattctactgtggtggagctggtatccagattgcaggacaaagtcctcaatcctctccccttttctctcctcaagctgagggaaggagtctctcccagagctgtgagctatggtgtcagggattaggggaggggtgatgcaaacattcccttggccacgccagctgatatctcactaggtctcatgcaccccaagtgcactggctccaagcccagcacagcaccaggacttgcctcatagcctagactgcctttcaagtttatttaggacccggggggcacttttgcccatggtggtggggcttgccagacagaactcaggttctgaccactgggatggacaatttgcctctagctagggctcatctaaatgctctctcagtgggcgctggctgatttctgccccatgttgcttaccagcactgagttccaatgcaaagtcccacagtcactgcattctccctccaacaagcatacagattctttctctgcaccatgtgaccactgccagaggatggggcagtggtggtggtgtaggcaattcaagactgtctttcctaccctctccagtgcctctttccttaatacaatgttaaaaccaggtactgtgatcgctcacctgatttttctttgtatgaaggtgcttttttttgtgtgtggatagttgttcaatttggtgttcctgtgagtgggggacaattgctggaggcttctattcagccatcttgctccacctccctgaagcaaataaaaaagctttagaaaaatttgtacccctcacaccaaagtgattaaatgatagtgatagtccacctaaaatgtatagtttctgatttttaaaaccagtttatatattttatatttcattacataaatgtacaccaataaaatggccaaaaatgatatagtaaggctaattatgtcattgaatggccagttgtgttctttgaaggcttggagttcttgaagttccaagaaagcctctgagctggtgtgatttggggggcactgctaaagttgtctttcccgcatcaggcaaaatgtcttgctatcacctgtcactctttatagtcccaataatagtcatttaactttaattcaaagtgcctaattaaaatataagcactattaatgggagaaagaggtttgaagtaaagaaagggcccaaaggccagtctttttttttttttcatggtttccctcagaccccacccaatacgtttttttggaagattaacatgctaatgtttatagaatgctgtaaagtcttcgtataacaaaagagatctacatactccaatggcaatagtaatacagtataatgttcaaagaacatatagatgtcacatatgtggaatattcctatcagggaaacccttacatattccctctgttacctttacatggcatttcttcttctattattcctggcaatgtctgccttagtgaaaagacaggggtcaagccaatatgttcccattgcatgcactcgttacaaagatttaattcgctgataaacatgttaccatattaaatctgcagcttgcctaccaagagtaaatgttttgtgtgagtgtgtatctaaatgcatagtctgaaaagaagatagggggcaagttattgcaggaaaattcttcgtgggaaactattgccttctgatgagctactatctgttcccagcatgtgctttcattagtcatccattaacaaccaccagttcatctcctaaacattcagggttcctcatggtaaaataactgtttcttcctagtgtcacgtttttcctactgtgctatgcagccataatttttgagattttttaaaatttttatttttaagttctggggtacatgtgcaggatgtgcaggtttgttacataggtaaacatctgccatggtggtttgctgcacctatcaacccatcacctaggtattaagcccagcatgttttagctatttttcctaaagctctctctccccctacccaccccccacaacaggacccagtgtgtgtttttccctccctgtgtccatgtaatcttattgttcagctcccatttttaatcttgctaccttctcttctgctcccttactattctatgagtgattatctacctacctaaattgtttttcagtagaaagaaagcattatatagagtggcagccatcccaaaactctgtggttacccccaactttttccccaccctctacatgggttataaacttaacaaacgaacattatgaaaaccaggctatattccatgaagacaccctccagtagttcagacagagcaagaatgtttaagcagaataatgaaaaggctatcttgggccgggctcggtggcttacacctataatcccaggactttgggaggccgaggtgggtggatcacttgaggtcaggagttcgagaccagcctggccaacatggtgaaaccccatctctactaaaactacgaaaattagccgggcgtggtggtgagccctgtaatcccagctacttgtgatgctgaggcaggagaattgcttgaacccaagaggtggaggttacagtgacccgagattgcgccactgcactccagcctgggcgacagagtgagactccatcccaaaagaaacaaacaaacaaacaaacaaaaaaaaaaacaaaaaaacaaggctatcttgttaaacccaaataacctggtagtgaattgaagtagctgatagtaattttcagttttcctctgagtaataccagtttataaattgaattattatggtaaatagtggatattttgtcaagtaaaaataaaaatataaaatagtataataaacatttgcatgtatttaccagacaagtggccctttaatatttacatttacgattaatttttaaaaatataacatagacttatgaagtagaaaaggactttacagttttgtctaattaaattatttgcactcataaaaatagtcatgccaccccacttataaatatctacccccgcaataaaatccttatatacaaccaaaatatatttcacaatgtcctttattaatgcataacacttaaaagtcttcccttgatgattaaataatgtcaaaaacagacttaaaaaataaggatttggaaatttttgataacaatttagtgggggcgatccatcaataacttcataaatttcttccagagtaggataacatagttgaaccacaaatcctgttcccatcttggagtctcactcagacagttgaattcaaattcacaagtctaaagtaccaagatacagtccaaattggagtacctggagagtccaagaaagctgtttgtgatgtcacatgaggtgtcttcaatagtgttgatattcaatcctgagagaagatgtaacccaggcgaagattttaatgtagaggaatctggaactgaggtgagatctggaaagccaaatgtaggtactctgctaccagacagaagtaagttttgtctctggtcagacaacgatctctttctgtagcaaggacgctgtaacagctaggctttaggaacctaagcagtgagaccagctgctaaacagcccggccacagagggcaagagtcatttgagaagagcttcttatatactactaggtcttctctcattggttgagagtctgggtggggctgattatgtcaataatcaggtgaattgtgatatcatagaccatgtaagtactgacatatatgttattatattaaccaagctatgttgtacattacagagtacaagggcagattgtaatgtcataaagtttacagtgtaccaggagatataaacagaaaattacaatacaatatatatgctaggatacagatatatgtaaggtactgagagaagacatagcaaggagtaattaactctgtgtgtggaggtttagaaagggcttcccagataaagtactgtctcagctgggtctttaattatgggtagacatttgcctgtgtgtacaggaaggaggtttgaaaaaggggtatattacagatgtcattctaggcaagacagacaaaagtatacaaaagcacagaaaaatgaaagggaaaaaatagctggagatgaggctggagtagaaagcatatctcagacctcaaagtaacctaattcttcatgatatagtatgcctttttagtcaagttttattcttaatgaaatgaggaaatatttgtgtaagaatacttacaagtcatcaccaatgttgtatttccctaaaagctacagaacataatctattaaaatcctatagatttactttaataatgcaatgctgtcatcataaggactttcctgtgaagtcatggaacctaaaactataatttgtatacatctatccagtgttaacaatttgtagggcatcagaccaggaaggaggtttggaaagttagtagcaagtcaaaatgtgacttcagtactactaagaaaatagggtgatattagataatcaacatttataatgttatggaattattaatagaatatcaaaatattaatgaaacataaattgtcctgatccaaaatggaaccatgcattattcaaattatttactgaaagaaaacctgtgttcatctaccaagtttcacagaacatctatcaagtttcacagaacatctaatatatagtatatatattatagtatatataataatattatatagtatatatcatatagtatatatcatatagtatatatcatatatactatagaatatatattataatactctatagtatatatgatatatactatagaatatatattataatattatatagtatatatcatatagtatatatcatatatcatatatactatattatatattatagtatatatacatataatacattatatattatagtatatatacatataatactttatacatagtatattgtatatcatataataaatggcattctgctttataagcatttcttttccctgctaaaatataattttactcatcctcaacaggttttcctaggaatattgagtaaagtgccttttctgtacctctttcatttttctctgcttttacttgtcagcatctctttatttcaatctatttgatcataggttttcaaaatcaatgtattatgtttagaagggctgaagtgttatttggatgatgactagaaagagatactgctacttctaacaaataggcacacctttctttttgatcctttcctccaaccccaggccacaactaaaactgcttcttttgaattaccttcaagtaacagagtatgtaaacgtggtggagactgttcttaaaatcttgtgcaaatcctgtaaaaccaaacagaaaaaaatctaaagtcctaccagaaattaatgagcactgaatacatggtagaattttgaagcatttgtaaaaactacattgaagaaactagagttagaaacagtaccaaagttctgcctcctaagccaggatgaggacatggtaaaagaatatcttgatgacctccaaccatcgtgcctaaattattgataaattaaggaagctggaggatgagaaaatctgtaaatctgtattaacctaagaaattggcagaggagaaagtatagtatatagatagagtgtatgtcaaataaggcagcaataaatatttttaaaagcaaaaccatctggcaaatttagaaactatatgacttttatggctactcttagaatttgccaaagattaagaattgcccctcctctgtgatcagttttctgcttctcaatgtaaagttcttccttccagcttttcaacacttttattcacaaatatcattctatgacatcattactgatctccttgacattttcgacaaatctcttgcttcctccaaacttcactctcttccctctccagcctgctttgaaaaagcttatctcataagcttgaagagaattaagtatatcatacacagtactcccagaacatcatgtgtactgcctctgtcatagaatttacaatgatgtactgaaatttgcttgcatgtctgtctctctactacacagtaaattcctacttactaatatataaaaattcaaatgaaatataatacgaattgtatgaccaggatggaatcataactttgaagatgagagatgatagatagataggtagatagatagatgatagatagatagatagatagatagatattcaaatccaaatgaccaaccgcatcactttgggcatttaatattgccaaatctcagtttgtttgtttgtttctttttagttttaatctgtaactactttataaggttgttgtgaggagtaaacgagataatgtaaagtttcccagaaaaaaaaaatagttaactcatgctagtttcattcatctcatgattttaggggttgttcaatacattatgaaatatataaatatggtactgcagtaggttaaacaccataaactatagttcatcctggtagaagctgaaaatcatttaataaacttcaatgtatatttataataaatacatttcaaatatgaaaataggaaggccatcccttactatattacaaagtaacaaccagtataattataataatgtgtggctataggattaggaagattaagcataaaaaaattacagcaataagtcctactatgagtgataaatgaagcatcaaaatcaatgataaaagaaaacatgttagataaattcagcttctcatctcatctcacatataaaagtaaattctgggaagatgaaaatgttgacgatttaaaacctattcaaagaaaaacaagaataatagaatagaatatttatccaactatgtatttatccagcatctaagattaaaaaaaaatagatgattacacaaatgagaagactgacagatttgcatgtaaatataaaatgtttatctatgataacttttgttaatgtgaagtggattgggattaaataattgcagcaaacataaacataagcaaaattaaaagataaagactggcataaaatatttgagacaatttttaataagttagaatattatatcataaaatgtgtctgtaggttttttttaggacagtgtataatgcacctcctatatactggaaaatgaatagaaatgtaatatttacatattctcatttataattcttttcaaaaccaccattgtctacattactctaaattagtaatatgctttcattgtacagaattttctacaaatgcaatttctaaactctgtgagattatagaagtataaaatgtgttcataacacaaaacttacattggaggcatcagcaaaaatggctaagtactttcaaaattctctccttcataaaagcagtaagaaaatttacagaaattctctgaatcaactatttcgggactttgaaaattaactaaatgcttgcagcaacccagaatgtgtttgtttaagaaaatggctgaatgttgttaagaatagcaatctccgtgacattttaacttgtcctattcccattcccccttcaagtgccatggtagccttaaaaaccaacatcctacaatcatgttgaaaacctgcagcctggcagctactggatgggggaagggaaggggtagaatgaggttgcagctccttcagagcctcatttccagagaattttcattatttgacttgtctggtagttccctggaagcattaacaccaatccttcaaaaactaccaaaaaacaaaaatgggaagaatatttcccaattctgtttatgaggccaatattatcctgatgccaaaatcaaacaaggacatcacaagaaaactacagaccaaaaccccttacaaatatagatgaaacaaatcctgagcaaattactagcaaactgaatccagcagtatataagaaagattgaacactgtgacaatggtgttatctcagaaatgcaaggttgtttcaacatatgaaaataaatcattataatacactatattaatagagtgaaaaacataaactacctgattacttaaatggacacccaaagaaaccatttgagaaaatccaatacactttcatggtaaaacaacaaactaggaatagaagggaacttccacaacctgatcaagagctttgtgaaaagtgaggctttgtgtaaagtgaaggacacacgtatatgagtttgttgtgtttatttgattagagaaccttcactactactgaaaatagaggatctcagtatctaatgaaattaaacttcaggtgttcaagttcctcatgaaattttcttagtggtttgagtgaattgctttttaaagccttctctctttcaaatagtaatgtctttcatgaaagctaatgactatccttatcaatatgcttattctatgcagctaaagcagataccttttgtgtgcctggattattttttcaattgtaccctaatatacatagcatttgctctatccctgatcacttcaagcaacagcattgaacataagaataaatcatctccatcaatcaatacatccaccacatctcagcttcacccttcctagctctctaggtcagaggtcagctaaccacagcccatgggccaaatcctgctggctgcctctttggtaaaaacaggcatactagaataaaaccacatccattattttaaagattgtctatggctgatttcatcctgcaatagtagagttgagtagttgcaatgaagattgtattgcccacaaagactaaaatagatactatttggccctttacagaaaatgtttgctgttgtttggcctaagatgcagtgtttttatttgttagttttgttttatgtgtgtatttatttatttattttgctttggctttcttctcttaattgctgcaattttttaaatgccttttctactccaatgtgcatttatttgcccaatttattatttaactaattttgaccacataatactcctcactatattataaaaccatgagaacaagtataattttaccttctgaatcattatctccttctgcccagtagattttaacaactaaatatttattaaatacataaataaatgctacatgggtaaaatacttcaaatttattttggaataacaaagagaataaatttattaaatactccagttctcctaaaacccatttcaatattgttctaatcatactagcaagttgaataatttactactctgaaaatgacatttctgttattaaatatagtagttactgtcaactgaaataaatgcatacatttagaaaaggagagaaaaaaatttatttcttataaagggttacagcatttggaaggaggaggtgtgggggtaggtgctttatgatgaacaggttagctaaacatacatattcagcagattacaggatgatctgtgaatattcatgaaaggggttgtgacacatgcatattgaatacacatgcatataacatatgacccatgtttactttgggatgaagacttaacttttacatgtattacaattaggccctctatatcaaaaggtcttttcaggacatgaaggtgcacaagtgcacaatctccgtaagccagccagaaccagttcatagtcagtggtcttatctggagaaagctaatgaaatcagtctcttgtccagtcagagctgtagttatagcttgtggaacacgggctgaggatcagcctagtcagcagctggtggaactgaaaattgttttaatatcacttgttttgagaccagtgcttgtttagctgctagagaaaaagaaaatccttgtgacagttagaacatagtttattctttaagtgcaggaatgtgtgatttaacctttgcctggcatgtccttagataatgtttataatctaatatcttattgtcacatagagtctgttctgtcagccttttaatctctattttaacattaatgctggtcagttgttctgtccaaaccacaaaatggagggggtgtaacaaggtgtgtctgaccttccattctgtcatggctgggaactcagttttaaggattttctgcgttcccctttgccaagagagggtctgttctttcagtggggggcataggattttatttttaaattttaaaatttttaactttgttttctttggggtacatagtagatatataaatattataaaatattataaataaatattatggggtacatgaaatgttttgatacaggaatggaatgtataatagtcacatcatgaagaagggggtaggagttttttttagtttacattactttaatattggacccctgaaacacactgtcctttgtttaaaaaagtaaatttgaaaaacttttagggaaatcttaaaaaatggcaataatttaattttaaaccacaatttatcagtcatatatacatgactgatatatagagaacacagctttatatatacagtgtttagctattgatatggtttggctgtgtccccacccaaatctcaacttgaattgtatctcccagaattcccacgtgttatgggagggacccagggggaggtaattgaatcatggggcccagtctttcttgtgatagtgaataagtctcatgagatctcatgagtttattaggggtttccgcttttgcttcttcctcattttctcttgctgctgccatgtaagaagggccttttgcctcctgtcatgattctgaggcctccccagccatgtggaactataagtccaattcaacctcttttacttcccagtctcgggtatgtctttagcagtagcatgaaaacggcctaacacagctgtgaagttgtatatcaatatcactttctggttccccttagaaccctcaggagtttctcttttctgttaattaaaatttcacagtcacttttaatctattatcattattctgcagagtgaactgtttgaatagagaatcaattaaaagcatagcacagtaaaacgtggggatgttttgcaacttgggcatatgaaaagtagtgaataagaatcattttcaacctatgatatgaaagaagggagatcctgggggcatccatagtcaaacacttggttgtacacttggagatgttttttcaagccttggattattactaacagtaaacaagaaattcactaactagagaaagcagatatgagtacgtacagactatcagatcacaaacagcagttagtaaggtgatctaactaaaagctgtagatggtgtctctttgaactaatgctactttgagcggtctaaaagcatgattgctacatgatgctttaagaaatctgcctagtacctgacagcatattgttcatactagtatctgtagctgtaaatttagattttaataattgtttggtacatattaatatataattttaagataaaaaggaaattgattttataggttatatcctatatctttggcttaaaatatattgtagaaaataatgtatcccatcaaattccatggtaaattagtgagtcacagcgaaagttagaaacactggcctacaacttttaatgattaattacttggccatgaataagccatacattatttagatgtatatttaattttaaagaaatctgcattttaatatttctgaatatgtcattagttattaagaagattactataaaaagcagtattcaaaaatatattttacagtttactttagtttttagtgaacattagaatgatagcatggccatgttgtttatcactgaagcacctaggagagttagcaaatgttaatcctgctagtgtcatcaagactaaacaaattataaagactaaatatccttttttttttttttttttgagatggagtctcactctgtctctgaggctggagtgcagtggcacgattttggcttactcctacctcagcctcccaagtagctgggcttacaggcacgcaacatcacccctagataatttttgtatttttagtagagatggggtttcgccatgttggccaggctggtctcgaactcctgacctcaggtgatccacccactttggcctcctaaagtgctgggattataggcgtgagccaacatgcctggcaagattaaatatacttttaaaaaattatatttttttctattgacttagaaatcactctacattaatgacatagtcaaagagattttacttttgttctcttgtaaataaaataccagattaaaggtatgcttaatgtgataaagtaaagccaaaatccaaaccagaaaatctagagtcataaagttaaagccacaattatatcttattctcttacctactcatttctttttccccactactgagaggatagagtcacatagtacaaatcagcagaagtcctcattattatattcttgcttaggcaagaattcatgattgcttctttgtccttatcccttttccaccactcaagatccatacaatagaagaaatagagaatcatttaataaagttgtcttccattcaactctgaagaaaatatcaacagagaaatggaagtcttttccatgcactcataggtaaagttttgagatcagcttgaaaggaggtagctcaattggaaattacataaaaaattccaggaaagatgggttgtgagactatctcagaagagaaaatctagggtttgtttgtttgtttgtttgaagatattgtagattgtattgaacctctcaggtgtcaggtcctgatgaaattgtaggctcacaaaattttgcagataggaaagttcttggtgctgagagacttgagatgagcaagtacataatgcagaatttgctaagctaaatgaacagggctgattgaatttgtccttagctaagtttctttattttgtaatgtggtggtcacattgcagagccgcagagcctaggatctcatgatgcttctaggcctgtgtttttggcaactaaattgtgatacatctgggatagctttggtaaaaagtgtgtgcagcccatctggggtcttccagccatagaattcctctactgtcatgtaagaagtctgtttatatgatttagaagcaggtaatacaggttgactaaattggaagtggagctgggcagtgtttgtaacccagaaaatatcttggtacctataagtgtcaggagatttttctccttttatttaattggtgggaaatgatatttttgagataaggggtttaagttcaagtaagagatgagttattggttgacaagcttttggatcatttaggctacttgtaatcacaaccagttcatcaggaaaagaccaccaggccagaagaggctttcatgacagcatttacacagagaagcatcaatcaatgtcaagcctttcagcagaaactggaacttcatggtgcagcagttcatcttcgcatgggccgggaggttgaacatcctgcatagtgctgccaggaaatccctatttcatataagagggggctggctggttgcatatgtaggatgtcccatctcccagcccacttcgtcatgacagacaccagaaacaccactctgcttcactgaagaacaataaaatctgcgtgtcatggaaacacagatgctagagctgcatcactagaaaggcattctgacaaatgtatttagaggagggtagagtactgactgctatgaccttggctcataagaggcagtgggtatgtgagtggatctttaagctcagggccagtagatctgcattaaaccatattagcaacaacactggccacacagataatgcctccagaattgtgccacctactctcagagctacaccgaattagggagattcaatagttgggcatatttatttaggctagccagagccaaatacctagaggtagagagaatctaattcttaattatagaaaaaaacaaagattatatcctgaaaagcagcctagaatttcaagtctgagggtcaaggtaagatagtaaattaaaaaatatgtctcaaagtcagaagaaggatatttgggaggagtattccagagaagaactaacaattctaaattgagcagaaacagtctattacactttgaggcaagaatcaagttacaaggaagtaggtgtgattgcaaagggagaaagttagcggcatgtccctacaaatatttcagagatataatttctgtcagctgcagtatccaatcatatccagggaattctgtcaaaagcaaggtgataggaaatatcgagagcagggcccagctcttaaaaacatagggcaggattaaaagtaatgcaaaatccagccaatcctagcggcccttctacttctggattggtacaggaaggatataatctcagaatagaaataagccatttaaatggaatatatttagctttataaataattggctgttatacataattttccattttcactttagactgctgaaatttcactatggatctttatatgaaaatgactaatctgtaggagatgctactggcagagaatcaattatgtcaacagcacaaacttgagttgtatcctgggatgctatcgagttttccactgactttaaattagggtcaagttaaacaggccatctccaaagactttggggttctaaaaaatgttgatttgctatgcattcgaatctgggatgagtttctagtcaaccatcctggctttggcattcttcacagtggatggtaagtgggccaatcttaggctgaaaaacaggctgatttagggtttgggatttagagcatttatatctctttattttcctcagcagcacagactctccattggaattaggggcttagtgaatagttcaaaaaacgtatggtttcatatacaaggaccccaaagttccatgcaaatgtatgagcatactgttatgtataatacccatgtaatttctgtagagtctatagagatatcacctctttgatcactgataattgataatgtgtggcttctacctttaattcttagtcgatctgttgagaggtttatcagttttattgatctattcccaataaagtgcagcattttatttcattgaattctcaatattatagtattgcctaaattttattgatttctgcttttatatttatttatttcttctggtacttggatttcatttttccttttttgcctagcactttaattttggaagcttagatcatggatttgagttttcttttctaaaataaaccattaacgttagaaaattccctttgagtactactttagcaccatcagacaaattttagtacgttttgttttcattttaatttacttcaaattattttttaacttcatttgccttttccttttgaaacatgaattatttagaattgtgttatttaatttgcaaatatttgaacattttcaagatatctgttttatttgttttcaggttaattctgttatactcagacaacacacgttgtttgattgcaaccattttaatttcttcaggtatattttatgagccagaatatggtctttcctggtcaattttccatagttcttgaaaagaatgtgtactttcctgttgtcaggtggtatgttttatcaatgtcaattaggtcaagtttgttggtaatgctgttcagttcttttacctcagtgataattttctgtatgcttttctgtcaattaactgaggaaggggtgttgaaatcttgaagtgtaattgtaattctacttttgatttcttctttctgctctaccattgttgtgcttcatgaattttgaagccctgttattatattttaaatgttattatattttaaatgtattataaacgtttaggactgttatattccctcgatgaattgacacctttatcattataaaatggtctgtgttacctctggtgatatccgatgatctgcaatttactttatctgttattaatataaaaattctagcatttgtttaattagtgtttgcacagtatatcttttatccatacttttattatacaggttgagcatctctagtcccaaaatctgaaatctgaaataatccaaaatcaaaaactttttttttttttttgagacagggtttttctttgttgcccagtctggagggccatggcacaatcatgcagcctcaaactcctaggctcaggtgatcctcctgcctcagcctcctgagtagctgggaccacaggtgtatgccacgatgccgggctaagtttttaaagtatttgtagagacaggatctccctatgtttcccaggctggtctcctgggttcaagtgatcctcccacctcagcctcccaaagtgctgagattacaggcatgagccaccatgaccagccaaaatacaaagctttttgaacatctatatggtgccacaagtagaaaatttctcagctgacctcatgtgactggtcacagtcaaaatgccatcaaaactttgtttcatgcacaaaattatttgcaatattgcataaaattaacttcaggccaaaaaataaatgaatttcacgtgtagacttgagttccatccccaacatgtcttattatgtatatgcaaatattccaaaatatcaaaatgtccaaaatctgagactcttctaatcccaggcatttcagataaaggatgctcagcttgtacaactatctatattattaaatttaaatttgtagagtttcttatagacagcatataattgtgtcttgtttatttttattctcaattttaatccaaaatcgctatctctttccttgaattggtgtgtttataccatttagatttaatgcaattattgatttgtttggacttatgtctaccgtgttttgttttctatttatcccttgtcttttccactcttttatttcctataggaatgggaaacattcttttgtttcctaattctgatttattatgtttttttctttttatttgagtatttcaattttattgatctattggcttttttactatatttctttgtacagtttttttgtttgttaagtgacaatgctctgaattaaaatatacctgtatattataagtatcccttatccaaaattcttgggaccacaatgctttggattttgaattttattagattttggaatattttcattatagttaacagttcagcatccctaatccaaaattccaaaatccaaactgctccaatgagtatttcccttaagcattatctcagtgctcaaaaagtttagattttggagaatttgggatttcaggttttcagattagaaatattcaacctatatatacatattttttccaagtttcttacccttaatattttatcacatcaagtgaaagataaaaccatatatgctcctttatcctcctttttttggtcttagttgtaatatggattacatctacatgcattgagaaccttatcagacaatgttacaaaatttttgcttctgagaatcatatgtattttaaagacttaagaaaaattattatattttctaagatatttaccgtttctgttgttcttcctttgttcctgatgttttcctttagtgtaattttcctttagtgtaatttcctttagtgttttcctttagtgtaatttccttctgcctgaaaaacatcctttaacatttttagaccaagtctcctagtttagagagacttgttttagagcaatgagttcctagtttcccttcacctgagaatctctttatttcacattcatttgtgaaatatatttccactggatatggaattttgaattgatagctcctttctttcaggcttttaaatttgtggttacactaccttctggttttcatggtttctgatgcaaaatctgaagatatgcaactttcaatgtttttgtctttatcttttattttgaccagtttgattatgatgatctaggtatgattttttttttggtttaaacatttgagttttacagaacttcttaaatctgtaaattttttccccccaaatgcggcatgttttggaccattatttcttcaaatagtatttcttcatcaatttttctcctctccttataaaattccaatgatacaaatgttaaacatatagttattgtcccacagatccccactatgttcatttatttttaattttttcacactgttgttcagattatataatttatatggatctaactttagttttcatgactctttatctgtcatctctactcttctattgagtccattcaatgatcttttttcaaatattgtattttttgagctccaagctttcagttggttctttttaataaattatactcattatttgagaactcctacctttctattcatttcaagagaggccgccttccttcactgagcatgattagggtagctgccttgaagtctttgtctacaaattccaacatttgcgttatcgaagggttgctgtctttgattctctttttccttaagaatttttgagatttttctaattctgtgtatatttggataaaacattttgtatctttgacactttgaatattatgtcttgagatctggatcctttattattgagataaaattcatataacaaaattaacaattaaccatttaaaagtatacaattctgtggtatttagtacattcacaatgatgtccaaccgtcatctctatccagtaccaagatattttatcactacttccaaaaaaattccatatccattaagtagcttttctacattgccccattcctcagcctctggaaaacactagtctcctatctgtctttaaggatttacctattctgaatatttcgtataaataaagtcatacaatatgtgatcttttgcatctggcttctttcacttagcatgatgctttcaaagttcaaccataatgtgccatgtatttgtaattcactctttttatggttgaataatactccattatctgaatatagtacattctgtttattcatctgtcagttgatagatatttgggttgtttcctccttttggctatagtgaaaagtaccactataaagagtcatgtcaaatacttgcttgagtatctataaatagaattgctaggtcatatggtaattccgtgtttggcttttaaaggaactaacaagctgttttccacagtgacggcaccgtttcactttatcaccaacaatgtatgaggtttccaattttttctccacatcctcaccaagacttgacatttctcattttgtttttggttttgtgtttacggtcaacctggtgggagtgaagtggtttctcatggtggttttcatttatatttctctaatgactaatgatgctgagcatattttcatatgcttgttggccatttgtatatctcatttggagaaatgtctattcaagttccttacccattttttatttgcaaatattttcttgcattctgtgggctgtttttacactcttctgatagcactctgatgcagaaaaaatttttaatttaatgatgtccaatttttctatcttttctgctaatgctactggtgtcatatctaagaaaccattgccaaatccaaggtcactaagatttacccctgtgtccttttctaagtgttttgtacctttggtttttatatctggatctttggaccattttgagttaaattttgtgtatgttgtgaggtgagggttcaacttcaatcttttgcacgtgatatctacatgcaattttcccagcattatttgttgaagggactgttgttttccattggaaggtattgtcacaagtgtaaaactcagctgactgcagataaataggtttatttctggcctctcaatcctattctattaatctatgtctatccttatacttgtaccacattgtttgattataatagctttccagtgaatcttgaaattgggaattctgagtcctaaaatttttttctccttttcaagattgttttggctattcgagatcccttaagattaaatatttattttaggattagcatttccatttctgccaacaaacacattagggttttgatagggattgcattaaatctgtaggtcactttgaaaagtattgccattttaacaatattaaatgttccaatccatgaacatggcctaactttcaaaattttagttgcctgcagagctcctggtgtatagtggtgttgccactatagatgggcaatttaatgatcgatgcttgcctccttttatgccaggatagaaaaagtgaagcaaagaaatctctctgttttatgcctgtcctcttgtcccctgggaagacagtatttttcttggaggtttctttctgcacatccactacacagtttgaagatttcgggccgtactaaaatctaagccaggaggtaagggaagtgggaagggaaaggaaaataattcttttattggtcattgtttaacttttattgtcttgcccaattagtctgctgttatttatttttcacatacctcagttacttgttttgggtatatgtgcacaggttttagttgtaatctataggagagataggatgaaatgtgcttacttcagttttgccagacctgaaagacttttaattggtaactttttatttttttatttatttattttttttagtttctttatattttattttattttttttaagagttaaagagataaactttattttatttttttatggagagtgctgttttttgttttttttattattatactttaagttttagtgtacatgtgcacattgtgcaggttagttacatatgtatacatgtgccatgctggtgcgctgcacccactaactcatcatctagcattaggtatatctcccaatgctatccctcccccctcccccccaccccacaacagtccccagagtgtgatattccccttcctgtgtccatgtgatctcattgttcaattcccacctatgagtgagaatatgcggtgtttggttttttgttctcgcgatagtttactgagaatgataatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttagagttctttgggtatatacccagtaatgggatggctgggtcaaatggtatttctagttctagatccctgaggaatcgccacactgacttccacaatggttgaactagtttacagtcccaccaacagtgtaaaagtgttcctatttctccacattctctccagcacctgttgtttcctgactttttaatgattgccattctaactggtgtgagatggtatctcctagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgttggagtttattgtagattctggatattagccctttgtcagatgagtaggttgcgaaaattttctcccattttgcaggttgcttgttcactctgatggtagtttcttttgctgtgcagaagctctttagtttaattagatcccatttgtcaattttggcttttgttgccattgcttttgatgttttagacatgaagtccttgcccatgcctatgtcctgaatggtaatgcctaggttttcttctagggtttttatggttttaggtctaacgtttaagtctttaatccatcttggattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttctttccaattctgtgaagaaaggcattggtagcttgatgggtatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttgtctctctgtttgtctgttgttggtgtataagaatgcttgtgatttttgtacattgattttgtatcctgagactttgctgaagttgcttatgaccttaaggagattttgggctgagacaatggggttttctagatatacaatcatgtcgtctgcaaacaggggcaatttgacttcctcttttcctaattgaataccctttatttctttctcctgcctaattgtcctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacaattattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcctttttggttgtgtctctacccggctttggtatcagaatgatgctggcctcataaaatgacttagggaggattccctctttttctattgattggaataatttcagaaggaatggtaccagttcctccttgtacctctggtagaattcgcctgtgaatccatctggtcctggactctttttggttggtaaactattgattattgccacaatttcagatcctgttattggtctgttcagagattcaacttcttcctggtttagtcttgtgagagtgtatgtgtcgaggaatttatccatttctgctagattttctagtttatttgcgtagaggtgtttgtagtattctctgatggtagtttgtatttcggtgggattagtggtgatatcccctttatcattttttattgtgtctatttgattcttctctctttttttctttattagtcttgctagcagtctatcaattttgttgatcctttcaaaaaaccagctcctggattcattaattttttgaagggttttttgtgtctctatttccttcagttctgctcttattttagttatctcttgccttctgctagcttttgaatgtgtttgctcttgcttttctagttctttcaattgtgatgttagggtgtcaattttggatctttcctgctttctcttgtgggcatttagtgctataagtttccctctacatactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgcagtgtggtctgagagatagtttattataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttgatgcaaggctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttaaattgatccctttaccattatgtaatggccttgtttgtctcttctgatctttgttgatttaaagtctgttttatcagagactaggattgcaacccctgcttttctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgggtattttgctcgttagttgatgcagtttcttcctagtctcgatggtctttacattttggcatgattttgcagcggctggtaccagttgttcctttccatgtttagcgcttccttcaggagctcttttagggcaggactggtggtgacaaaatctctcagcatttgcttgtctgtaaagtattttatttctccttcacttatgaagcttaatttggctggatatgaaattctgggttgaaaattcttttctttaagaatgttgaatattggccctcactctcttctggcttgtagggtttctgccgagagatccgctgttagtctgatgggcttccctttgaggataacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacaccaatcagacctagatttggtcttttcacatagtcccatatttcttggaggcttttttggtttccttttattcttttttctctaaacttcccttctcacttcatttcattcatttcatcttccattgctgataccctttcttccagttgatcgcatcggctcctgaggcttctgcattcttcaggtagttctcgagccttggttttcagttccatcagctcctttaagcacttccctgtattggttattctagttatacattcttctaaatttttttcaaagttttcaacttgtttgcctttggtctgaatgtcctcccgtagctcagagtaatttgatcgtctgaagccttcttctctcagctcatcaaagtcattctctatccagctttgttccattgctggtgaggaactgcgttccttttgaggaggagaggcgctctgctttttagagtttccagtttttctgttctgttttttccccatctttgtggttttatctacttttggtctttgatgatggtgatgtacagatgggtttttggtgtggatgtcctttctgtctgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgtgagaaccactgctctcttcaaagctgtcagacagggacatttaagtctgcagaggttactgctatctttttgtttgtctgtgccctgcccccggaggtggagcctacagaggcaggcaggcctccttgagctgtggtgggctccacccagttcgagcttcctggctgctttgtttacctaatcaagcctgggcaatggcgggcgcccctcccccagcctcgctgccgccttgcagtttgatctcagactgctgtgctagcaatcagcgagactccgtgggcgtaggaccctccaaaccaggtgcgggatataatctggtggtgcgccgttttttaagccggtcggaaaagcgcagtattcgggtgagagtgacccgattttccaggtgtgtctgtcacccctttctttgactcagaaagggaactccctgaccccttgcgcttcccaagtgaggcaatgcctcgccctgcttcggctcgtgcacggtgcgtgcacccactgacctgcgcccactgtctgttactccctagtgagatgaacccagtacctcagatggaaatgcagaaatcacccgtcttctgcatcgctcaggctgggagctgtagaccagagctgttcctattcggccatcttggctcctccccctcggtaactttttaaaacatgtcattttatcattgtatgttgttttatgaaaacaaaattgattgatttttttcagatattgactttatatacaacaacctttctaaactcgttaatgctcaacatttatctgtaaatttttttatgtacacaatcatgttttcatttttccttttaagtcctgaacatttttactttcataacacagtaataagtaactctagtacaatgcacaatggatgttgtgatggtagactttcttgtttttttccaacatttaattattaaatatttgagagacatactttagtttaagaaagttagaatcttagtttgctgaaatttattcaacttgaactacgttgagttatatttaaaaatgtgtgcctacattgacttactcacataattttctccttatttgtttactgtgatacatcttcaagctttattttcaaagttatactggcctcatgaagtatgttgggaaataatccccttatttattcaaagaatctgtgtatggttgatgttatttttttcttacatagttgatatcacaagtaaatacatttggatctacattgtgccatccaaagaatatagtatgatataatatctctttagatgtagatttatatttttccataagatttggtggttattttgttgttgctgtttaatctttctaattttaaattaagagagtacgtgtgcaggttttgtgattgtattttcatgtaggacctgtaattatcttgttaaagttttaataagatttttaatgaattttgtcactgttgcaaatagactattttccctttttctatctctggcacttgttcttggactagttaaacctctagattattttatatttatcttgtatccagccagactattatattctctcagtaaatccagcatagtttttagaagagtctcagattcgctagtcctacagtcaaaaaaaaaaaatcaccgataaacaagagatcattttataccttgttttccaaagttatacaagttagtttatactcttatcatagtgaaaattaataacataatgatgagtaatggggtaaactggcatcttgtccaatttctaaatttaatgtaattgaaatacatttattgtattgctatttataatatttgttgtaggttcttagtaagttatctttatcaaaattaagggcactgcctttatcccttcattattaaaattttaattaggaatggcttctgtatttaatcaaattactcttcaatatctattaaaagaccaaaaatttcttcacaaatgctaatatcagggattatattggtagatttcatgatgataaatcgcctttgcattcctggaagaactcttgttttttctgatgtgttattcttttggtacttttttgggctttatttgttaatattttattttgaactttgaatctataataatgaatgctattttctctagtctcctgttttagtgtttttcaagttttgctattgacactgtattgttttataaaatgtgttgaggaatttttaaactttcatggctattcatcttttcatatatgttaacttagagattgattataattttttgtttccaagtgctagctttgggattacttcacagttgtccccacattcccatacatcttaattaaattatcagaatactgaacttttattcttttctcaaaggcaaaaattgtctacattacttcatgaaaataaagtccttttgtattttctttgaacagaagagctgaaagattaatgtcttgtattcagtctttgcctttttttattattggtggggatacctgtgattgctggagtcattaaaaatcatgtaacatttgaatgaatgaacaaacatataaaaatgtcttatgaagcactatacacaattttttcccctgaaaataagatttcatttcactcaactatgaattggcctcccctatggaaagtgtgctatagcctcttggctattcaactcccttcaaaccttttacatattaattgtataaaatattgctggctcacataattccacacattgttctatgctctatggataatggaaaaataaacaataattactgacccaatggagcttatgttctaatggttatggcaacagaattctccacatagtgataatcaggatatacttgtgcatttgaagcacaattggaaacataatttctgcaagtgaaacatgtcaaggagaatacaaaaaccctccacatgatcaacttccatggtggatacaatctgagggagttataggaaaatgatgaacaataatgaacttttggttagaagaacttctcatgatgtatttcctttccttattgcactggttgaattctaataattggtagtttgatttctagtatggccatataagcacttctattgttaaccttttggcaaataaaagctactaacttggaacaaaacacaaagaacaactaccttaaggtattggacaggaatccaaaacagagatattggcaatcacaacacttggaaaaaagaaacaacagaggttgagtttccaactttcaagacttatagcttaagaggaagatgcaatttctgccagaagaggtggctaaaactccaataaaaaaatctttagtttttttggttgggtgtgggggcttatgcctgtaatcccagcactttgggaagccaagacaggtggatcacttgaggccaggagttagagacccacctgggcaacatggcaaaaccccatctctacaaaaaatacaaaaattagccaggcagggtggctggtgcctgtagtcccagctactcaggaggctgagataagacgattgtttgagtctgggaggtggagattgcagtgagctgaaatagtgtcacggcacaccagcctgggtgacagagccagatcctgtctcaaaaacaaaacaaaacaaaacaaaacaaaacaaaacaaaaagtcttcagtttttatggcctgaagaacctgaggaatttgcaactggaaggtgaaggagcacctaggaaaaggtaaagatagagagaaccacaaattcttctctgggaaactataaactctgcctaaatctctagatgacatttaaaccgtgcttgcctgggatatcctacaagcaacctaagaaatgataaatgaactgaattgacatttgagctgtagcccaaatgaaagagactgcagtttgagtccaaccaagctgattgctggaaaaacaaaaacaaaaacaaaaacaccaatactctttggagcaaaagaaccaaatccagcatctcaacgacatggcattcacaatgtttagtttacaatctaaaatattttactttaagaagaaacagggaaagacaactcattcacacacacactaacacacacacatatatacacacacacaacttttaagagacctatcctgagaatacccagatgttaaaattcaccgagaaagattttattgctgctattatatttatatcaataccatcaaagaaaatatgctcataattattgaaaatggaaaacctcagaagataaataaaaacaacaaaaataattgaatggcaatttgtgggctaaaaaataatatatgaaatataaaattatcctggatgagtttaacagtataatggagatgacagacaagaaaagccagtgcatttgaagatagatctatagaaatcgtccgaaattaagatcagagcgaaacacattgagaaaaaaaagaatggactctcaggaatctgtgaaacaatatcaaatgctctaacatgcatgtgatttgagacccagagaatgagagggaaaatgggaccaaaaactatttgcaaaaaaataaggactgaaaaattttcaaatttggtgaaagccgtaagtttatagactcatgaagctcagcaaataccaagcatcataagtataaattctgatgattaatctaagaaaattttactatccaaatatgtataaataattcatatagattgaagcagcaccatttataatggaaaaaacaaaaaatggcaattttactgcctttaatagacatctaagaacttgttatatactggtgaaggttgagcatgtcgccaacctaaacaagagtattataaaagaacaatgagttatacaagatctcttactaatggacaataatgttcacattaaaagtagaggggtttgatcgctgcttcattattatcaagaatgaagcaccagttcatcagtctgtatcttgacatatccttcagcccattctggaagaaaccaaaaatgtccaaaggaaggatgctggttaaccttccagaatatttcaacagccacatttcaccttacttttccttacttccccaagaaaacaagattctgaattgtttatttatcctgtaaggtagtcatgcctactaaggttgcataggagaagagcccagtatctaagataattctcactaacaactccagcagactagaatatgacacatcgtaaaacaattcaccaacagcagatttacaagttggttttttgcctgattcagttgctagattctagatgccaatgtcattacaaaaactttaaacttttaatgatgctccaatatggaaactttaacactactgaaaatagtttagatctcaagttttcaagtaagaacaccaatgttaaaaacaacttacttgcggctgggcgcagtggctcatgcttgtagtcccagcactttgggaagccgaggcaggccgatcatgaggtcaggagatcgagaccatcctggctaacaaggtgaaaccctgtctctactaaaaatacaaaaaattcgcctggagcgatggtgggcacctgtagtcccagctacttgggaggccgaggcaggagaatggcttgaacccggaaggcagagcttgcagtgaggggagattgcgccactgcactccagcctgggtgacagagtgagactccgtctcaaaaaaaaaaaaaaattttacttgaaatgttctgctaatttcggcaccagctcaaagtcagacttaatgccacaccagagactatcatgaaaatggcaacagtaattcatctggtaactgttaaaagtaaaaataacaagagtttctgccacttattaatctttacttctagtatctaacaaaatgtttggcatatagaaaacaaatagctaacatagggtaaattaaggaataaataagtaacgttaaagtaatttatatgaggaggaactttattgttctgtctctccaaaagagcaagaaaatgacctggaaatagttgtcagaatcaactattatgaaactcaaacatcaaatcaaaaatttaaaacaaacaaggtaatgctaaatgaagaagaaacccactgctttgcagtaagggagcactgtagggttttaagctgcctgctaccatatcccatttccagatatgcagctaatttgaggatgaaagcctgcactcctgatgcaagttgctagtgccaaagaaatacagatcttttcctcaaagaaatgtgcttgtctttttagacttctctgatggccccctgaaggactgggacagtaacttcctttgttttgcctgactcagagcatttccagggctcagatgatgttctggttggagtttgccaaaagtattaaaaggcacaagcattgtttgcaacagactaggacaagtaacactagaccacacaaacaagaaacaggctgaatggcctgggaagaaagaggttgggaatggagatacgttgggaaagaaaactttatttttaaggaactcaaatataacagagaatggaaaaagctacacatggcgtgcctaaggatgtcagaatgctcagaagaagcctggaaagacactattcttccacctgtgaccgggctgtccatcagcctctgagattctgctgaagtataaagttgaggctgaggcagagttataaacaacctcattaagcattgaaggaaggtcccaaacagacccaacctgcaaaaagtaagaaagcattcattccttttttttctttgcctaccggtatttaagaaacccctgtaaaagtgctaggtaaccaccaaactaacaggatgctgattttagctgccacagaagaccaagaaaaaagaaaacagactttataaaaatagttttgaaaaatcactaaacagtcaaacaaaatcagtccaaaacaagtagcaacaacttcaggaagggaagaaaatctgatttacagatctgccacattgtaatattaagatgtccaagttttaccaagattaaaaagcatgcaaataaactaggaaatatgacctattttcagaaaacaaaatagaatagaaactgatcatgaggaagcccaagcattggacttaatagacaaagactttacatcaactgtctcaaatgtactcaaagagctgaaggaaaccatggagtaagaattaaagcaaaccagaagaacaatgtctcaagggatagagaatataattaaagggataaaattgtaaacaaaaaacaatggaaatatggcagctaaaaattataataactgaaatgaaaaattcacatgagggaatcaataacagactttagcagacagaagaaagaatcagagaacatgaaaacaggtcaattgtgattatccagtccaaggagcataaagagaaaataataaataaaaatgaacaatgcctaagggacctttgagacactatcaagtttaccaatatatgcacaatgggatttccgggacatgagagattaaaaggatcagaaaaaaatatttaaagaaataatggccacaaactttccaactttgaataaagacatgactataaatccaggaagctcaatgaactctaagcaagaattactccaaaatatccaaaccaaggtgcagtataatcaaactcttgaaaggcaaagagagaatcttaaaagctgcaacagacaagcatctcatcaaatacaaagtatctttaacaagataaacagtgaatttctctacagagaccatggaggccggaagcagtgagatgacatatttaaagtgctgaaagaaaaattgtcaactaaatgctctaaatctggcaaagctatccttcaaaaatagagaaattaaaacactcctggtaaaagagcaaaaacaaaaacaaaaaatcagaaggagttaattactagtggacctaccctaaaaaaaaatgctaaagggagtccttcaggatgaaatgaaaggacgccaaaaagtaccttgaaggcatataaagaaataaaaaacaacaaaagtagctacaaagcaaatataaaatccagtggaattgtactatgggtttcttacacctgttttgactttctatttcctttaaaaggcaaatacataaaacaataattataaatctatattaatgagcaccaaatgtataaaaaatgtaatttatgaccaatagcaacataaaaaaggatgaagatgtaaagaagcaaaatctttgtatagtattgaaactgagtatctataattaaaacttgattgttatggaagaaagattataattgtaatccccaggttaaccaaagtaaacaattaaaataatacaaagagaaagagacaagaagagaatccctacaaaaaaatcagttaatcacaaaaaaatcacttaatcacaagtgaaggcagtgacagaaaaaaatgatagtatatgttatagataaaatggtgcaagtgtcttttctttactgtaattactttaaatgtgaaagaattaaattttccagttaaaaggcagacactagcaaaatggataaaaatacatgatccaattatatgctttcaataagagactcactttagacataaggacacatgtatgttgaaagtgaaaggatggaaaaagatattccatacaaacagtaaccaaaatagagttgaggtggctgaacttgtcagacaaaatagaacttacaaagatagttgttgtgaacaacatcaactaaaagaagaacatcatctattgatttcaagccatcaagaacatataacaattataaacatatatgtacctaacaacagagcccaacaattatacgaagtgaaaaataaaagaattaatgggagaaaaaggtagatctataataatatttggagatatcaatactccattttcaataatggacagaacaacaagacagaaaatcaatgaggaaaatagaggacttgaacaacactataaaacaactaattctaacagacagatacagaacattccatctaataacaacaataaatacattttttctcatgtgcacatggaacattctctgggatggaccataagttttaccacaaaacaaatgtcaatacatttaaaatattattattatttaaagtatcctaatacatttaaaatattattattcaaagtagaaatcagtaacagaaagaaaactaaaaaatttacaaatatgcaaaaattaaacaatattaaacaaccaataagtgaaagaagaaaatacaaatgaaattcaaaaatattttgagaatggcagaataaaaacttaatataccaaaaaattatgggatgcatcaaaagctgcgctcagagggaaatttatatctgtaaatggctacatttaaaaataaaatgaactcaattaatgacctaactttataccataagaaactagaaaagtagagcaagtttaacccaaactcacaaaataactgaaatgatgaagtttagtggaaatataaaaaataaagaataggaaaaatataaggacaattaataaaaccaaacgttttcctttttttgaaaagatcaaaaaagttgacaaatctttagatagacagactaaggaaaaaagagaagacacaaattacaaaaatcagaaatgaaagtgggggtattactactaaccttacagaaattaaaaggattggctggccaatcctcctggtgtggtatctcatgcctgtaatcctcgcaccttgggaggccaaggtgggaggattacttgagcctatgagttcaagagcagcctaggcaacatggtgaaaacccatctctacaaaaaaaaatttaaaaattagacaggtatggtgccacatgtttgtggccctagctactcaggaggcttagttaggaagattgcttgagcccaggaggttgagactgcagtgagccattattacaccactgcaaactagcccagacaacagagcaagatcctatctcaaaaaaaattaaaaggattataaaacaatacaatgaacaattatacaccagtaaattaaataacctggatgaaatgtaaaaatttctaaaaacacacatactaccaaaagtgactcaaggagaaataatctgaagagtcatataaaaagtaactacattgaatcagtgatcaaatacctctcaacaatgaaagctcaagacaagaagttttccttttgaatttcaccgaacatttcaaaaattaacaccaattcttctcaaactcttctaaaaaatagaagatgaagaaacattttgtaatatattctattagactggcattatcttaatatcaaagccagctaaagacattacaagaaaattatagattagtattgtttattaatataaatgcaaaagtcttcaataaaatactagcaaactaaattcagcaccatattatatacccattactaaatgggatttatctcagggatgcaagagggattcaacatacagaaactaatcaatgtaatgtatcacattaatagaatgaaggtatgcaaaccacatgattatgtcaattgatgcagaaaaagcatttgcaaaagtccatcacttttttatgataaaaaaatgttcaacaaactaggaataaaagaaaatgtccttgacaggcatttataaaaaacaaaaacaaaacccagtcaatagtgaaagactgattttcctctaagatcagggaaaaaaggcagaatgcccaacttcattagttctatttatcatggtactgaaaattccatgtagagaaattaggcaaagagaggaaataaaaggcagaggaaaattggaaaagaataaatcaaattatttctatttgcagaagacatgatcttatatatggaaaatcccaaagagtcaacacaaaacatagctctaataaatgaattcagcaaagttgcaggacatttgtagttctatacacagtgatgaacaatccatgaaagaatttaagaaaacaattctatttacaacagcttccaaaaaaacctcaattgataacagcatcagccacaaagaagaattaagtattgatacatgctacgaaatagataaacctcaaaaacattagctaggtgaaagaagccagacccaaaaagtcacaaattgtatgattctatttatatgaaatatccaaattagttaaatccatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacactgcatgttctcactcataggtgggaattgaacaatgagaacacatggacacaggaaggggaacatcacactctggggactgttgtggggtggggggaggggggaggggtagcattaggatatatacctaatgctaaatgacgagttaatgggtgcagcacaccagcatagcacatgtatacatatgtaactaacctgcacattgtgcacatgtaccctaaaacttaaagtataataataattaaaaaaaaaagataaaaagcaaattagagattgccaggagctggttgatgggagaatgggaagtaactgcttaacggtatgcagtttccttttggagtgatgaaatgtttctgaactagagacagatgctagttgcacaatattgtgaatgtactagatgccattggattgtacactttaaagagattaattttatgttgtgtaaattttacctcaataaaatatatgtcacgctgaaggtatcattatcatgatcaccatcatcatccctatagaaaataatgcttcctaaatttcactttctttaaaaggtttagattatgagaaaatataagcagactaaaatttgagactatagtcagtacaatttggatgacgtgttcttgtcttctctctgttctctttcagattatgtctggccactacctagatatttgtgccccgtctggatttctttagatgttttattttcaacagcgtccatcatgcacctctgcgctatatcgctggatcggtatgtagcaatacgtaatcctattgagcatagccgtttcaattcgcggactaaggccatcatgaagattgctattgtttgggcaatttctataggtaaataaaactttttggccataagaattgcagcggctatgctcaatactttcggattatgtactgtgaacaacgtacagacgtcgactggtaacatttgcgtttgatcgggttcttttatttagtaattattcttaacctatttatctgatatttaggttaacaataatgaaaggaatgtaatgtgtattaatatgtaaatataaagtttccatttatgctgctaaattattttatgcattagtatgccaatgaattctgcaacacagatacaaaatgtttgaaatatttaaaatgctttgaaaatgagaaagacataaagtctaattaaagtctaaattttaaaaatataacatttcaatcttatattgaaaagttacatgtatcccagaatattaaccttagtatttttattctaaattcctatccttttcagtagaaaaattaataatgcaatctaaatcatcatcaagtaaatatgtctaaatttttgttgctatgacacctaaaatgtactattttctctcagttttaattgtcttcttgaattctgggtatacaaaaagaaaaaaaaatttgtttctttaaagatttgtagcagtttaaagggaaagaaatgatcatttattgcttatatttgaggtattcataaatgccttaacagtgctaatattaaagccaagaaatttaaacaattggactttaggggttttactttcatgtttttttccttttccagttggtgtaaataatttttcttcatatttatgtttttgtaaagattgaggtaaagtgtgcaacaagatcaagacttctatttaatcttcactaatatcatctaaatattttgactctgggtttattgatcaaatacatttaagttttaagattgttctattgtagattgttctgcctgtgtatagcatagacacctttgaataaaaagtcgtgaagcttgtcccaaaagacaaaaatgaatttacgtaagtttgacttacaaattcaagagttcacagattttgccctagccatcacaaagagttcatctaaaaagatgccagcttttatggtgcttacaaaggaaatacacagacagaatattgttgcatcagcttctagtaatgaaagactgagtaatttgcaatgactcttgtgctaaaggcaaataaacacatggataaaacactaaaagccctaagaagctaatgaaatagaaattgctattggctaagatccagaaaaagacaaaaacccaagaaaaatgattatgacttctagttcacttttgccaatgatgcattataaacctgaagatatgactgacaggtggagacgatcatttcagactcgcaagcaatggaggactagagtaggaatacagagtctggcaagggccaaccaacctgaatttaattctgggatcacaaaaaaaccagacactaggaataaggatcgaccaggattaaatcaccatagacatggaattcagccctggttcaagtcatctatgtaaatgagagaaatcttgggccttaaaattggattaagatgatttcgtattattcaggtttccaattttggggcataaacaaacaaaaaaaaccccataatcctagatttcaacttatttctttcaataattttcaaatgctgtcactgaaatacaatgatatgcagatatatgaggagacaatacaacatgaatcaggtatgggacaataagagataacagaaataaacttacaaacacttcagataattgaattatcagacatacactttaaataatcatttggaatgtgcacatggaaattacatgctgatcttaaacacttcagcaagaaactgcaaactataacaaatgacattaagatttgagaaacacctagaaaatatggaacttaagcataatatgaaaaactaagggccaggcagtgtcttacacctgtaattccagcactttgggaggccgatgcaggcggatcacttgtggccaggagttcaagactagcctggacaacatgatgaaaccccatctctactaaaaatacaaaaattagccaggtatggtagcacacgcctgtaatcccagctacttgggaggctgtggtgggaggatcacttgaccctcagaggtcaagtctgcagtgagctgagatcatgccactgcgctccagcctgggcaacagagtgagactctgtcacacacacaaaaaaaattaattaattaaaaaatgaaaacctaagaactctgtggcagattagagatggcgaatttccaaatttacagaagattattataaaatattaaaaattagctgggtatggtggcatgtgcctgtagccctagctactcagaaggttgaggcaggagcatcacttgaactcaagtgtcttgaggttgcagtgagctatgatcgtgctatgacacttcagccttgatgagaaagcaacactttgtctctacaaataaaagataaaatgaaataataagataaatccaaaaggagtcaataaaagatagaaaaatataaaacgtatactgaatggcagaattaaaaccaaatatatccctaattatatgaattactaaggattctaagactgtcatataggctttcaaaaaaataagacaactatatgttacaagaggcatatataaagcataaagaaagtaaaaggataaaaacaaacaaaaaaattcctccatctaaacactatccaagagaaagactgtatagctatattaatatttgtcaaaatagacttttcggcaaaaaacaaatactccagtgaaagaagattacttactatgaaagatttaatacatctggaagacataaggtaataaatttgtatgtacataattatatgtagatacatatgtaatatacatagtatatacattataaagtaaaagaggacagaacttcagggacagatagacaagtctacaatcatcgcataagatcttagcacatccttctcagcgattgtatgaaaacaattaacaaacctgaactcactgacaagtgaagaatacatattcccatcattgcacaagaaatatttatcaaaactgaccataaagtaattcctcaacacattccaaagggttggaataaattgtttattctttgactgaaattcaaaagaaatagaaatgacttcaaaatagtagaaaaaccttcgtatatttggaaattaagaaattgtttcccaataaactttgacctaatggatttcaaatccattgatgattcttccctaagctatctattactaaggtgatacaatgataatttttctcattttattattcttcctgcctttatttgttggtattatactgtaaggaagtgttttccctccaagtctttgttatttattagttcatgttggtggagactcctggattcttttgtattcagtgtaatatatatgattcattattgcccttaattattttgatgctcaaattgtctcatatttttctaataagaactccttttcatatatcccatcagcttttgagcatttgccagactcaccttttactttccatgccccagttccgaaattagccatttcttacaagaaacccttttagtgggcaatggttttataaagcaggatgcagaagctcagtatgctcattgctaataggatatcattgctcctatatatcaatacctttaatcccaattcacgaacacaggactcttgctactttccaattctttatttttcctcatttttctcacagtgagtaactttgtccccaaaccattgatatatttattatttatattttctatatcctaccatacaagaaattaatttcagaatttctatacccataccactaccaataaatgaaatgcaatgtttaaaatttcattgcaattttatctttagaatgttttccaccaatggcatatagtcaaagcattgtcttcaaaatgctaggattagtttgaattttttttctctgtggttctgataccaattgttcacatttagggattttgttttgtttttgcatgtattccccaaccttgttgactttattttttaatatgtaaaactttaatatgatgctccaacagtcaaaactaggcaaataaaatactcagagaagagtcagttcctcttctattccgtggttaacccattcattagtttctagggcatacttcttgaatttatttttgcaaaaaaaaaaaagattatacacaaatacacgtattgttatttttccattcttaaattaaaagttaaaatgctacatacaaattaatactttgttttgctttgttcttttacttggaaatatgtcctggaaatcactctatcaatttgtaagatgatagatatgcacccaactttatcatgtaaatggcctaaatactccaattaaaagctaaattcattctattattttttacactcactaataatagattgtgttgatatactttatttaaccaatcttctgtgtataatcaggtaagttgtttccaacatttggaagttgccaataattctactaagaataattgtgtgtgtgtgtgtgtgtgtgtgtgtgtcctttgtgtgtgcgtgcgtgcatgtgtgtctgtcttgtgtgtttgtgtgcgcgcgcgcgtgcatgtgtgtgtttcatattattggaagtttaacttttaaataaattcttgctcaaatgtattcagaatttatcttctaaataaattcttagaggaggagttgattgatcaaagggtacatgtagttaggagttgaaccattttgcattcccaccagcaatgcaagaaagcctctgtttccccaaagccttgctaatgaagtttattttcaaactttttagattttgcaaatcccataagtgagaaatgttacctcagtgtaattttaatttgcatctattttatttggctgaagttcatatgattaaatgtatgaaaaccacttcagtgccattgctaaatcagttttaagtgtccttttgctcattttttctgattttttttcatttttatttcttaatttaatagctctttataagttatagacactaaccatttaacatgttataaatgaaaatattttctgtttgctatttgatatagctatggtattttgccatacaaaattattttattttcatgtagttcatcttgtcaatcagatttcctttttatgttgagagtaatggcaacaaattctttcccctaactcaggttggacaataaatcacacatatttttctcatttttacatttagacctctgatacatttggagtttattcttgtacgttgtgacatacacattcaattttagtctcttaaaactaattcttccattgtctcatgctatttatttaaaaagtccatctgtcctgtgatatgagatgccatctttatagtatattaaatattcttatatgcctggacatgtttctgaagttcacattttattccactacactgtctaatcaaatgccaatttcacacttttaattataaatgctattacataaatgttattatctgatatggttagtccctattcattaggcattttttagagcttgtgtagacattactgaaagtttaattttccatattaacgttaacattaacttgccttgttctattctaaaagcctggatattttgacagggatctccttaaatttataatttaatttaagaaaaaatgaacaactgaattttaaaaatgctttctctaatctgtatactaatttaggtggtggccactctgtcttccaaactttactgccaaacctatatgtcactctcatgtcttccttatcaacatttataatgtatctcataagaatcaattttttagctttaccacaaaccaaatctgtcttctatgcattcactagtgactacttaattgtttaatttatgaattttcaaactttttggtctagtgatctctgtatactcaaacattattaaggattccagagagtttgcctttatatgagctatatccatcagcatttaatgtctttgaaattaaaattgaaattttaaattatttttgtctacatttatttaaaataacaatagtaaatccattacatgttaacataaataattagctctattaaaaaaagctatattttccaaaacaaaatcaacaagaagagtgacattgttttagttttttctttttttgacttttataaatttagggggtacaagtgcagttttgatatatgaatatagagtatagtggtgaagcctgggcttttagtgtaaccatgactcggtaacgtacaatgtacccattaaataatttctcatccctctcaccatatacaaaaattaacacaaaatggatgaaatccttaaatgtaatatctgaaactacaaaaacactagaagaaaacctaggaaaaaactctgctggacaatggcctaggcaaaaattcgtgactaagaccttgaaagcacaaacaacgaaaacaataatagacaaatgggatttaaactaaaaaacttctatgcagaaaataaataatccacagagtgaacagataacctgcagaatgggaaaaaatatttgcaaactatacatccaacaagggactaaaatccagagtctataaggaactcaaacaactcaacaacaacaaaagacaaccccattaaaaactggggaacagacatgaccaaacatttttcaaaagaaggcatacaaatggctaacaagcatatgaagaaaatgttcgatgtcactaatcgttagagaaatgttttacagtttttcaaggtgctttaatcatctgacttaatagaagatagctagattctcatctctgtttttttcatccaatttattgcaacaatttgctgtggttcagataattgcggtcattcttatttgacagtgcactaaaactctgcaagtagtagtttcttaagttctgtggcaatgtacaatcagaaaccaaatcactgacttttttatatactgttacattaaaatccactaatgtatctagaaatggatatttcaaatgaatactttacttcagtacttcacatggatattttacccatgatttatattgtaacatcaggcataggtcattaagaaaatattggttcaccgagttacacatattttctcaatgttggtatatttcactatacaatgtcaaaaatcatatacgttgataatcttcatcaaccttaatggaaaaatcttaagatattgggaaagttcaatctcccagagatgaatagacattttccaaaaattacattattcacttgaaacctcagattttatcattggcagcaaatagcatctattttttgcttaacttgacaggctcaagtcatccattattgagaaagtagctgccaaatacccaagtctgaataactctagtgtgtctaacagtcaagtaaagatgttagtctatgaaaaaatacatggctagttaatcttgcaactctaacaattgcataggtactttttctcaaagcaaccatctttttttttttttttttttttttttttttttttttttttaccaaagctgtacatatattttaaacatgaagatattttggaaaatcaggtctaagttttctttctccaaacaggtatgtttaaattctttataatttttttccatacaagagaaactttttcatggtacaaaggatgaaggtaaattacagtcctgtaggcagtcctgttagagtgactgttctatacatattattgaacattttaaataaagggtattcaattaggaaaagaggaagtcaaattgtccctgtttgcagacgacatgattgtatatctagaaaaccccatcgtctcagcccaaaatctccttaagctgataagcaacttcagcaaagtccaggatacaaaatcaatgtacaaaaatcacaagcattcttatacaccaacaacacacaaacagagagacaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtatcaaagcaaccatcttatatcagtatgcagaagatgcgctcttcctgtacttctcattttcttacataggttgttaagaagatgtgtacccacatgttgagatttaataaaattaatattttttactacttcataaagtatattcttaagtaatagtggcttctttccccaaaagtacatagtgataaagaatacaataacttcttgtacagtttggtgtcatctgcttgattcatgccaaggcaccagcagtttcacccaccattacattggcattatcagtaaaattgtaaacacattgaaaatagcaaataacatattaatatttctatggaaatacttttgacttcatgaaactattgaaaaggtttcagagatacataaatgttcatggaacacactttaaaaactaagtttccggtgctagctccctttgtggtatttgatatagtcaatgatgttttgttcataattctccgattctttgctacctatgacacaattttcatttggtttccttttctcctatttctctgtctgctccaaatcattttcttcattttctgctttatccccgttcttccccaggattctgttccttccaattgcttatatacttttcctggcttgcatcatccacagaaataattaaaatctatctaccaatgactcttgaataattatttctattaatttctatctggattatatgcagatctatagcttgtagaaaaactcttagctcatgttccatataaaatagactacagaccagatttggccgatgaaccatagtttgccaaaccctggtcctaataattgtgttctggcaagtatatagtgacatctagtcctggtatttatctttaattccctactgactcataatgttgggcactttttgttatggtttttaagcatttcgacgtcctcttttgtgatgaatttttaacaccatttgcctattttcaattttttaattctagtgtttttttgtatagtctagataagagttctttgtcggatatgtatagtgaaaatattttttcccaatctgtgcatgaccttacactcgtttaaagttcaatttgtcagcgttttctttaatggccagtgattttttatccggtttatgaaaagttttctcatccagagttcaagaggatattcaagaggataacctcctctgtctttgtatttccttcctttcttaagtgtttgatcatcttagctttcacatttaggtccaggagccatcttaacttaatgtatacgtctgatgcgagctagagattgaattttttccctatgtgaatatccagttgactcagcatcatttattggaaagattattcttgcctaccgaattacaatggcgtcattctcataagtcaggttaccttatatatgttgtttctcctgggctataagttctgttctattgatctaatattctgtccttgtactagtattacaatgtcctaattactatagctttatactaagtcttctaatctagttgagtaagtctgtcagctgtgttcttcttcaaaattttctgggctagcctaaggccttttcattttcatataaaactaaaattagcttgtcaacccccaaaacaaaatatgctattgttttaaaattggtattgcattaaatctataagtcagctaagtgaggatttgtcttaacaatactatggcttccaatccatgtacgtatgcatatgtacatgtaaataatctactatttatttaggccttctttaatactctgttatgttttatttaatttagaggtcttgcacatctttgttagatttatcgttaggtacttgatttcctaggatgctattgtaaatatttctagttgcttgctgctagcatataaaaataaaatacatttgatatttttgcatttactctatacccagctatctaaattcacttaacatttcttggagtttgttaaaagattcattggaattttcagcgtacctagtggtgtcacttgtgaatgacgacagatgtatttctttttcttctatcttaaaaatttttttaattaattgttcttgcttgattgcactggtaggacttagaaaatagtgtttaatacaagtggaagtagtagacatcttttttttttagtggaaaactgctcagtatttcaacattaagaataatatttgtaagttttgtaaaatgtctttcatcaaattaaattcccttttattctatattttctgtgtcttttttatcataaatatgtgtaacttttccaaatccttttttctgaatccactgagatgattataggatttatttcttcctttattctgttagcatggtaaattgtatacatttttgaattatatcttgcattcttgaaataaatcccactttgtaatgggctttttttttctatatcattggattattttttatattttagttaggatgttttaatccattccaatgagagattttgccttgtcattttactttctttagtggtatccttgtctagttttggtagcagggtatgcaagcctcataaaatgagtttgaagctgtcccttttgacctaccttatatgtttgtgtaaagtttgcatctttttattttaaaatgtttggaagaattaatgaatgtagtcatttgatactgtcaccatctgagcctgcagggtggtatgtgtctgtgtgtgtgtgtgtgtgtgcgtgtgcatgcatgtgcacatatgtgtaaaggttcttaattatagattcaattgcttcaacatgaatggcaatattaatattttcttttgtgtgtgttagttttggtaaattgtaattgtcaaagaatttcttctaaggtttctaatttattggcatcaagtggtgtaattaccatccttttaatgtctatataatgtgtagtgacttcctgtttcgcccagagaatggttatctctgttttctctctttttgtgtttagtttactaagagtttataatttttttttaacttctccaagaattatcttttggagtcatcaattttctccattgtttgtccattttctatgtcattgacatctaattttacctccttctttctacttactttgggtttcattttctcttttttaacttcttaaggaagaaagttaagtcagtgactctgggccttacttgatttctaatatacacatttaaatccataaatttttctctaaattctactttagctgtatctcataactgttgatgtgtattttaatttcagctcaaaatatttactaattcccttttttaatccatggattatttggaaacttgtagtttaattttcagacttcaggaaattttcaaggtatctttcttattgagttgtaattaatgccacagtggccagggtatatacactttatgtttccatcatttgacttttattgtcattgccttttggccagcatatggtttacagtgataaatgttctatgtctacctcaaaagactatatatattatgatgttgatagacgtagtaacagaatgtgtgttttgtaacttttctatgtgtattttctagttactgcaagagttgtgttaaaatctctgacaatcatcatggatttgtctatctctccttttagtttttttaacatttgttctataaattttgaggttatgttatttggtttctttaataaataagattatatctttccataggattgacacttttatagttatgaaatattcctctttatctctcctaatactttttgccctaagaactaatttttatgatatatcagctttctttcagttagtgtttccatagcataacattttctatatttttaaaacaggctctgtctttatatttttaaataattcacttataaagagcatatagttatttcttaatataatctgaaagtatttcatttttagttgaagtttttaaaccacttaaacgatatactttagtttacatctattaatttttgttagttttttctttgtttctttattattctttcttttgtaaaaagattcatttaggtaaatttgatgtaagataacctgcactttttaaaatgtataatttgacaaatattacaatgtgcataaacccatgaaaacatcaccacactcaagatcataaagatagccatccccatcaagtttcctcatgcccacttgtaatacttccctccctcaatcatacttcactgtccctgaacaatcactgatctgctttctgtcactatgctctagcttgcattttctaaaatgcaatacgtatactttaaaaatatatatttaaggtatacaacaggatgttatgagatacatagagatagtaaaaaggttactatagtgaagcaaatgaatatattcatcatctcatatagttacctatttttgtgtgtatggcaagaacagctacaatccactcatttagcatgaatcccatacatagtataattttattacctatcgtccacatgttgtacattagatctctagacttgttcagcctacatatctactactttgtactctgacctgtgtctccccatcacccaactcccactgttttattctctatctctgtatatttcaatttttctttagtttccacatagaagtgagatcatacaaaatgcttctttctgtgtctggcttatttcatttagcatgtcttccaggctaatccatgttgtagcaaatggcatgatctcattctgttttagggctgaacagtattccattgtgtatacatatgtgccaccgcttatttatttattcattcattcatggattcttagattgtttccatatcttagctattgtgaataatgctgcaatgagcatgggagagcacatatctttacaatgtgacgatctcatttctatttctaatatttctaaaatattaattttgaagaacctccatactgttttccatgatggctgtactaatctacatccccacaagcagtgtacaagtgttgcctttcctccacgcatttgccaacacaggttatattttgattttttataatagctatcctaactggtatctcataacggttttgacttgcatccctgatgattaattgatgttgcgcacctctacatatacctgttggagatttttatgtcttccacagagaagtgtctattcttgtcttttttctaatttttaaacaggatatttgtttttccattattgtgtgaacaagttattgataaattttggatattaaccctttaacagatatatggtttgcaaatatttttttctcaattcataggaaccatttcatcttgtggattatttccttcactgtttagaagctttttaattcgatttaatcccatttatttatttttgcttttgtagcctgcacttttgacatgatatacaaaaattcatttccaagcctaatgtacaagagcttttcctttatgttctcttctaagagatttacagtgtctagtgttgtatgtaggccttttatacattttgagttgatttttgtgcatgatgtcagataagggtcaaatttcattcttttgcatatggaaatagagtttttacagcatcatttatttaagaaattatccttttcctattgggctttattgatgcccttgtcaaaaacaaattgacaatttgtgtttggatttatctctgggctctctattctgttttactggtctgtgtgtctgtatttctgcctggaccatacgatattgattactatagttttgtaatactatcttaaaaaaggaagtatgatgcctccaacttcatttgttctcagaattattttggctatttggggtcttttattattccatacaaattttattattgcttttgctatttctgataaggaaggcatcgggatttttaaaagggttgtgttgaatctctatattgctttgggcagtatgaacattttaacaatattaattctttatgtatatataatagttgtacatatttttctttatgtatatataatagttgtacatattttgtcacatacttgtgacattttgattcttgtgtagaatgtgtaatgagcaaatcagggtaactgggatatccaccacctcacatttatatttgttttggcgacgttacaattcttctcatctagctattttaaaatatacaataggttattgttaactatagtctcccaactgaactatcaaatactagaatgtattccatctatctaactgtatctttgaacttcttaaccaacttctcgtcatctccctcaactcccctacccttctaagcttctggtaacctgtcttactatgcctggcttatctcatttcacataattacctctaggtctactcatgctactgcaaatgacaggatttcattcttcttatggctgaataatattccaattgttgtatatatcacattttctttttccattcatctgttgatggacacttaggtagatttcatatgttggctattataaataatgctacaataaacatgagagtgcagatatctcttcaatatatattaattttcttactttgagatacgtacccagcaatgggaatgctggattatgtggtagttctatttttagttctttcaggaacctccatactgttttccatagtggcagtactatttcatctccccaccaacagtgtatgagcactcccctttgatatgttgtgtttctattgttgtttgactcaagatattttttagtttcccttttgacccattggttgttcagaagcatgttctttgcttttcacatgtttgtgcattttctaatattcctcctaatattgatttctcgtttcgtgttattgtaatctgaaatgacactagatatgattttagtcttcttaaatttgttaagacttattttgcagcctaacatatggtctatcctggagagtgctccatgtgtactggagaggaatgtgtattctgctgctgttggatgtaaagttctgtgtatgtttgttagatccatttggtcaaaagtgcaattgaaatccagtatttccttattatttgttatctggttgctttattcattgttataagtgggatattaaaatctcctactattattgtattgctatccattttgttcttttatgtccattaataatttttgtatgtatttatgtgctccaatgttgggtgcataaatatttacaatggttatgtcctcctgatgaactggctcttttaacattaaataatgtccttttttgtctcttgcaaaaatttttaacttgaagtctacgttaccagatataagtatagccacctgctccctcttttggtacatttgcatggaatatcgtcttccattccttcactttcagcctgtgtatgtctttaaagcataagtgagtttcttgtaggcaacatagttggctctttttttttttttccactcagccactctgttttttgataagagaatttaatccatttacattcaaggttattattgacagataaggacttgctactgccattttcttgtttgttttctggttattttgtagctattttgttcctttctttctcttttatagtttacctttatgaattgatacttttctgtagtgctaagatttgattgctttttctttagcattggtatatctgccatagatttttgttttgtggctaccgtgaggcttatataaaacatcatatagttataatctactattttaagctaacaacttaacttctgacacatacaaacactctaggcttttaccttccttcctcacaatttacatttttgatgtcacaacttttgtcttgttatattgtgagttccttaacaacttagtgtagcttccattatttttgaccattgtgactttcatcttcatactagcaatgcgtataatttatacagtattgaagtatcctggatttgactatttacctctaccagtgagttttgtatttacctctaccagtgagttttgtatttacctctactagtgagttttgtactttctttcatatgtattcatgatggtaattactgtccctttgtttccacttgaagaactcccttaagtatttcttgtaagtcaggtttcatggtaataaattccctcagcttttgcttgtctgtgaaagactttatttctacatttctgaaggacagcattgctgtatagagtatgcttggctgacagttttgtttgcttttttgttttgggggttattttttctttttctttttcttttttttttttttgctttcaacacattaaatatatcattccattctctcctcgcctgtaaggtttctgctgagaaatgcactgataatctaatggggattcccttatatggactcaggatcatgaaaacatccatccccatcaaaagtttcctcaagcacatttgtaatactcccctccctaatacttcactgtccctaggcaatagctgacttgtgttctgtcactatattctagtttgtatttaatgaaatataggatatactcttttgtaaatggcttctttcacttaacatgattatttgaggctaaccaatgttgtttgtatcaatagtttgtttttattgcagcatagtattccactcatggatatacaatttgtctaaaaattctactttttatagacgtggtttatttccagttgttggatgttatagaaatttatgtacaattctgtaggtgggcatatatttttatttctcttggataaatacttaagagtagaatggcagggcttgtacaataggtgtacatttagctttttaagaaactaccataattttccaaagtgattgtaacatttaatattcccactagcagtatgtaagagttacagattctccacaacctccccaattcttggtatagtcaggcttacaattcttgctattccagttggtgtatagagatcaccgtttgtggttttaatttgcattttcccagtgacttagggtattgagcatttttttatgagcatattgatctttatataatctagggtaaaagtgtctggttgattatttttctcatttttattagattgtttgacttcatattattgagttttaattgttatttgtatattcttggtaaaaattttatttgatgtgtttatttcttattttttattgtatttatttatttatttattttgagacagggtctccctctgttgcccaggctggaatgcagtggtacagtctcagcttactgcaacctccacctcccagattcaagcgattctcctgcctcagcctcctgagtagctaggattacaggcatgcaccacaacagcctggctaacttttgtgtttttagtagagacgggatttcaccatattgatcaggctggtctcgaactcctgacctcaggtgatctgccttcctcggcctcccaaagtgctgggattataggcgtgagccactgcgcctggccccagtgcgttttttaaaatattttcattgtcagtgacttaaccttaaatttcttaatagtctctatggaagaagaaagtttttaattgtcatgaaattcaaattattaagaatttttctcttatgcttcatgcttttgagtcatatttaagaaatatttgccaaacctatggtcactaagattttctcctatattttatcatagagttttatacttttagctgtaatatttgcttctaaggtttaattatatatatatatatttaatttttttaggtacacagtaggtacatgagatgctttgaaacaggcatgcgatgtgaaataagcacataatggggactgggatatctgtcttctcaagcatttatcctttgagttagaaacaatcaaattacaccctttaagttattttaaaatatgtaattattattgactatagtcaccctattgtgctatccaatagtaggccttattcattctttctatttttttttgtacccgttaaccatccccatctctccccccacaaccaccaactactcttcccaccctctggtaaccatctttctactctatgtccatgggttcaattgttttgatttttagatcccacagataagtgagaacatgtgatgtttgtctttctgtgcctggcttatttcgtttcacataatgatctccagttccatccatgttgttgcaaatgacaagatctcattctttttttgtggctgaataatactccattatgtatatataccacattttctttatccattcatctgttgatggacacttaggttgcttccaaatcttagatattgaaaacaatgctgcaaaaacatagaagtgaagatatctctttgatatattgatttcctttcttttgggtatgtacctggcagtgggattgctggatcatttggtaactcaatttttagttttttgaggaacctccaaactattctccatagtggttgtactaatttacattcccaccaacagtgttatgagggttcccttttctccacatccttagcagcatttgttattgcctgacttttggatataagccattttaactggagagaaatgacatctcattgtagttttcgatttccatttctctgatgagcaattacgttgagcacttttttgtatgcttgtttgtcatttgcttgtcttcttttggcaagtgtctattcaaatatttagcccattttttgattggattattagactttttcctatagagttgtttcagttccttatatattctgcttattaatgccttgtcagatgagtagtttgcaaatattttctcccattctgtgggttgtttcttcactttgttgattgtaccctttgttgtgcggaaggtttttaacttgatgtggtcctatttgtccatttttgctttggttgcttgtgcttgttgggcattgcttaagaaatctttgcccagaccaatgtcctggagattttccccaatgttttcttgcaatagtttcatattttgaggtcttacatttaagtctttaatcgatttgatttgatttttgaatatggtgatagacaggggtctagttctattattctgcatatggatatctagttttcccagcaccagttattgaagaaactgtcttttccccattgtacatccttggtatctttgtgaagaatgagttcactgtagctgtgtagattcgtttctggtctctgtattctgttcccttggtctgtatgtctgtttttatgctagtaccatgctgttttgtttaccttaggtctgtagtataatttgaagtcagacaatgtgattcctctagtttagttcttttgcttaggatagctttggctattccaggtctttttggttccatctaaattttagaattttttttttctatttctgtggaagaatgtcgttggtattttgatagagattgaattgaatctgtagattgcttttggtagtatggacatattaacaatattgatttttccaatccatgaacatggaatatttttccattttttggtgtccccttcagtttttttcttcagtgttttatagttttcattatagagatttttcacttctttggttaattcttagatattttatgtgtggctattttttaagaaaaacttatttattttaaataatttttagataataatttctttttttctttcttccttgccttcttctcctctccctcctcctttttgcttccagggtgactcatgtcaaaaacattgtggatgtccctttccagtttcctattgacttgtatattaccttacagcatttctccccattcagctgtccctagtagaaatccataggctaacctggtactgccgattcgttgtctttaatggctgaataataacccacagcaggaatgtgctaccatgattgatcctgccatctgcctactaaagggtgttcactttgtttccaggtttttgccactggaataactttgcattcaatgcctcatgcataaatatgcctttatctactggtgctgttatttcttcgggacagtccaaaatcttatgatacatgttaaaatgtatgtatattttggaaagttaaaatctctagccatagagctttccaaaaaggctgtgatacttgcattcccaccagcaatacatgagggcaccatttttcttggattgtcattcagcagatgttatcactttttgtattttttttttattatactttaaattctagggtacatgtgcacaatgtgcaggtttgatacataggtatacatgtgccatgttggtttgctgcacccatcaactcatcatttacattaggtgtttctcctaatgctatccctcccccagccccccaacccctgacaggccccagtgagtgatgttccccgccctctgtccaagtgatctcatcgttcaattcccacctatgaatgagaacatgcggtgtttggttttctgtccttgtgatagtttgctgagaatgatggtttccagcttcattcatgtccctgcaaaggacgtgaactcatccttttttatggctgcatagtattccatggtgtatatgtgccacattttcttaatccagtctatcattgatggacatttgggttggttccaagtctttgctcttgtgaatagtgccacaataaacatatgtgtgcatgtgtctttatagtagcatgatttataatcctttgggtatatacccagtaatggtattgctgggtcaaatggtaattctagttctagatctttgaggaatcgcctatgtgtggctattttaaatgagattactttttatttctttttcacattgttcactgttggcatatagaaatgctaccaatttttctatgttgattttatattctgcaactttactaaatttgtttatcagttctaatagttctcttgtggagtctttaggtttttccacgtatactataatatcatctgaaaacaagcataatttgacttatttctttccaatttggatgtcctttatatctttctcttgtctgattgctctagcatggactttcagtactaagttgaataacagtggtgacagtgggcatccttgttatgttccagaccttagaggaaagactttcagtttttccccattcagtatgatattagctgtgggtctgtcatatatggcttttattatgttgaggtatgttccttctatccccagtttttgagggtttttatcatgaagtgatgctgaattttatcaaatgctatttcaacatcaattcaaatgatcatattgtttttgttcttcattctgttgatgtgatgtatcacattgattgatttgcatatgttgaaccatccttgcatcctgggatgaatcccatttggtcatgatcaatgatctttctaatgtattgttgaattttgtttgctattgtcctgtagttttatttattattattattattttttttgagatggggtttaactcttgttgcccaggctgcaatgcaatggcatgatcttggctcattgcaacctctgcctcccaggtttaagtgattctcctgcctcagcctcctgagtagcttggactacaggcatgcaccaccacatctggctaatttttgtatcagagatgaggttttgccatgttggccaggctggtcttgaactcctgaccttaagggatctgcccacctcggcctccaaaaggactaggattacaggtgtgagccaccgcgcccagccagttttattgttttgatgtgtctgtctttttttggtatcaggataatattggccttgtagaatgagtatggcagtactccctcctctattttttggaatagtttgaataggattggcattagttctttaaatgtttggtagaatttatctgtgaagccatcaagtcctggggttttctttactgggagacttttttttatcatggctttgatcttgctatttttatgggtttgttcaggttttggatttcttcctggttcaatcttggtaggttgcatatgtctaagaatttgtccatttcttccagattttccaatttattggcaaatagttgctcatagtagccactaatgattctttgaaatgctgcattatcagttgtaatgtcttctttttcatgtttgattttatttatttggatcacctctctttgtttcttagtctggctaaaggtttgtcaattttgtctaacatttcaaaaaaactaccttttgtttcattgatcttactattttttaatttcaatttcatttatttctactctgatctttattatttcatttcttctgctaattttgggtttggtttggtttggtttcctcttgctttttttagttctttaagatgcattgttagattgtttatttgacgtttttcctcttttttgatgtaggtacttatagctataaagtgcctctttttgctgtttttgctgtatcccataggttttggtatgttgtatttccattatcatttgtttcaagaaatttttcaatttccttctaaatttttttattgacccactggtcattcaggagcatattgtttaattttcatgtacttgtatagtttccaaaattcttcttgttattaatttctagttttattctattgtggtcaaagatgcttgatattattttagttttttgaatgttttaagacttgttttgtaaactaaaatatgcactgtccttgagaatgagctatgtgctgaggaaaagaatgtgcattctgcagttcttggatgtaatgttctgtcaatatctattaggtccatttggtctgtagaacagattaagtcttatgtttctgtattgattttctgtctggaatacctatccaatgctgaaagtggagtgttgaagtctctaactcttattgtacttgggcctttctctctcattgattatttttgtgccagtaacaataaaagtactctgtctgtggcttacgatttttgtgacatcttcatctgtttttttttttgtatcaggataatattgatctcataaaatgagacaaggaatgttatcttcttttctgttttttgcaagaatgtttgaatgattgatgttaattcttctttagacattcgataaatttcaccaaaggtgccatctgaacttgggctttacttagtggaaagtttttttttttttttatgacaaactgaacctctttacttataggtattttcatattttgtttgtatttgtgaatcagtcttggtggcttgcatgtttctaggaatttttccatttcatatagatttccaaattatttggcatgcaattatttaaaatatccccttataatacagtttatttgtcatttcccctcttttttttccttaacttttattttaggttcattggtacatgtgaaggtttgttacataggtaaactcatgtcactagggcttgggtttgttgtacagattatttcattacccagatataaagcccagtacccaattgttatcttttctgctccccttcctcctcccatttattcacattattagtaattggtgacttcacactttattctagctaatctagttaaaggtatcaatgttaagatctttcaaaaaaccttttattgattgatttcctctattggttttctattctcaaatttattcactctgattaatttttgttatttctttctttttgcttactttggatttagtttgctcattttctagttttctttgaagggggagataaggttattcattaaagacctttcttctttttcaatataggcattacagctacaagtttttcttctaagcactgcttttactatatcccctaagttttcttctgcttgtggttttattttgtttttctcaaaatatttcaaaaatccctcgtgattcttctctgactcattaattattttgaattgtgttgcttaattctcacatattgcaaatttcccaaatttcctgttgttgatttctactatttttccattgtggttgcagaacatgctttgtataatttcatccttttaaaatcattgaggattgttttgacttaacatatggtctatgtggaaatgtttcaggtgcacttgagaaaaatgtatactctgctgtctagttggtttatagtattgttcaagtcttctatttctttgttacttttctgtctgtttgttaaatctgttcttgaaagctgggtattaaagcctccagctatcactgtggaactgtgtacttctcatttcaattatgttagttttgcttcatgtattttgtggttctcttattagtgaataaataatttctactatttggaaaagttgattttggcaatatttcccagtgttctcattgtttttacgaagaagagtattttccaatgtccttattccactattcccacttgtgtacctccagtgatatgatgttttactttaatctctttttgtcttcataatcaaagtgggtttcttatagagagaatataactgaatcttattcatttactcaatcttataatctctatcacccatatttatagcttttctatacaatgtgactattgatatggttgggtttaaaccgaatcttttgctatttgttttacacttgtcctatctgttttttgttttgttttcttttgatttttcttttattttaccagtttttcaagagtccatcattcctgggcctcctttattgagtttttcatcttctgatcagcagttgttgctttagggttttttcatatcttacagtttttaattgtatgcccagcattatggattttattttagaaaagcccttgattatgttatctttttctcatgagtactaaatattgttctaattaaaagttaatttatcagtacaacacctgaatactgtctcagactttgtttagaagaaagactattttagttttttcttacagatagaaaatattcctcactcttaaggcactgagtttctttttttattttctgtccagctttaagatgcaagcaacaaatttaaaaacttatatatttaaagtgtacactgtgatgatttgataaatgtatagatcatgaaatgattaccacaatcaagctacttaaaatgtctatcaccttacaaagttaccttttttgtatatgtgtgatgagaacacttaagatctactctcctagcaaatttcaagtatacaagtgttaactataattgccattctgtatgttagaccccagaatggatttatcttataacaaaaatttgtacattttgaccaatatttccccaacccccaaccccagccccagaaatacatcattctactctctgctcccgtgagttacactttcttagattccgcaaataagtgagattatacagtatttttcctatgtctgacctatttcatttaccataatatctctcaggtttatccatgttgtcacaaatgacagaattctcttctttttaatgactgaataattctcttgtgtgtgtgtgtgtgtgtgtcatattttctttatctcttcatccattgttggacacttaggttgattccataccttggttattgtaaatagtgcatcaataaacatgggagtgcaaatatctctttgacacattgattttattttctttgggtatatatcccgtagtgggattgctggatcatatggtagttctgtttttaagttttgaggaaccttcaaactgttgtcaataatggttacactaatttacattcctatcaaaagcgtgcaagtgtttccttttctccacatcctcaccaaaactttttatctttcatctttttaataataaccattctaacaggtatgaggtgacagctcaatatggttttgtattttttttttttgaggcgaagtctcgttctgttacccagacaggggtgcaatggcacgatctcggctcactgcaacctccatctccttgtttcaagcaaatcccctgccttagcctcccgagtagctgggattatagatgtgcaccaccatgcccggctaatttttgtatttttagtagagacagagtttcaacatgttggccaggctggtctcaaactcctgacctcaggtgattcgcccacctcggcctcccaaagtgctgggattacaggtgtgagccaccgcacccggcctcattatggttttgatttgcattttcctaatgattagaaaggtttagcactttttcatatacctgtctgccatttgtatgtcttctctggaaaaaaaatgtgagttgtatgaattccctctatattttggatattcatacctatatttgtgggttcaggctgctataacaaaacatcataaactggacagcatatagataagtaaaatttttttctcatagttctataagccaggaagtccaagatcaaagtacaggcagatttcagtgtctggtaagggcccactttctcatagtctgcaccctcttgcagtgtcctcacatggtagaagaggtaagggtttctctggggtcttttacgagggcattaatttcattcatgagggatctgccctcatggcctaatcatttcccaaaggctccatatcctaataccatcactttggaagttaggattccaacatgtgaatttgagtgggacacacattcagaatgtaacacctccttatcaaacatatggtttgcaaatatttttttccatgccataggttgccttttaattttgttgattgttttctttactgcacagaaacttctgtttgatatcatcccagttgtttatttttgcttatttatgttacctgtgcttttggtgttatatctaaaaaattattgccaagaccaatgtccaggagttttccctatgtttttttcaaaagttttacagtttcagtttttacatttaagtctttaattcattttgagttttgttaatatgataaggatacagtttcattcttctgcatttatatagccagttttcccaccaccgtttattgaagagagaaccctgtccccattatgtattttttatgcccctctcaaagactatttaactatatatatgtggactcatttctgggttttctgttctgttccattggcctatgtgtctgtttttacaatagtaccataatattttgattactataatatagtttgaaataaagacatatgatgcctccatcttgattcctcttgcttcttacttttttttttcacttaattctggctatttggggtcttttgtggctccatacaaattgtaggattagtttttttttttattttggtgaataatgtcactggaattttaatagggattgtattaaatttgtatattgctttgagtagtattgacactttaaaaatattaaatcttccaatttgtgaacacaggatcttttttcatttatttgtgactccaatgtcttttgtcaatgttttatagttttcagtgtacagttatttcacttcctcggttaaatttattcctaaatattttattcttttttattctaatttgaatgggattttttcttcacttattttttcagatagtttactgttgctgtatagaaatgcaactgatttttgtatgttgattttgtatcctgaaactttactgaatttattaattttaatagctttacagtagatactttagggttttacttatataaaatcatgtcatctgcaaacaaaaacaattttacttcttcctttccaatttggatgccggttatttctttctttctttctttctttttctttctttttttttttttttttgcctgcttacttggattaagacttccagttctatgttgaatagaagtggcacgagtgggcacccttgtcttgttcctcatcttagaggaaaaatttcacattttgtcattgagtatgatgttagctgtgggcttgacatatatagtctttattacattgaggtatattcctttgatacctaatttcttgagagttatcatcataaaagaatattgaattatgtcaaatgttatttttctgaatctattgagatcgatcatatttttatcattcattctgtcaatgtgatgtatcacatttattgatttgcatatgttgacccatcctttcatccaagggataaataacacttggtcatggtgtatgatacttttgatgagctgttgaattcagtatgctattttgtttgtttgtttgtttgagatttttgcacctatgctcatcaaagatattggcctgcaattttcttcttttgttttgttgttatctggctttgatatgagggtaatgctgactttgtaaaatgagcttagaagtgttctttcatcttgaattttgtgaacaagtttgagaaggtttggtgctagttcttcatgaaatgtttggcagaactcaccagtaacaccatgtagtcttgggcttctctttgttgggaggtttctgattactgtttaatctcctaactcattattggtatattcagatttcctatttctttaagattcagtcttgaaaggttgtatgtttttaaagaaatgtatccatttctactaggttatctactttgttggcatgtaattgttctagtagtcttttatgatcctttgtatatttgtggtgtcatttgcaatgtctgctctttcatttataattttatttatttgagttctttctctctctttctcttggttagtctaactaaaggtttgtccattttatttatcttttcaaaaatccaacactgtttcattgaccttttcaaccgtcttcccatctttatttcatttatttctgctctaatctttattatttcctttctttgactaactttgagcttagtttgttctttttgttctagttccttggtgtagagttatttatttgatgtctttatttttattaatgtggacatttatcactctctacttcctattagaactactattgctactattactactattgctgcatttcataagttttggtatgttgtgtttccatttttgtttatctgaatatttttttaaatttcttttttatttcttttttaacccattggttatttgggagtgtgtggtttaatttctatatatttgtaaatttttaaattttcctcccgttattaatttttagtttcataccattgtggtcagaaaatgtatttgatacaatttcaatcttcttaaattcattaagaattgtttttcaacctaacaaatgctctatcctggataatgttccatgtgcacttgagaagaatgtgtattctgttattgttggatgtaaagttctgtatctctctgttagatgcatttagtctctagtgtttttcaattccactgtttccttattgattttctattggttgatctatacactgttgaaagtagggtgctgatgtcttctatttaatactattattgtattcctatttctcccatcagttttggtaatacttgctttatatatttgtgcttcagagttgagagcatatatatttaccattgttataatcttttgatgaaattaaccctttatcattttataataatcttctttgtctcttgtgacagtttttaaagctaattttagacttacttagagttataaaatagtacagagtccctttatatctctcatccagcttcattaaatgttaacatattgtatacccgtagtataattatcaataataggaaatcaatattgtgaaacagtactataaagtataaattttgttcaaaatttacaaagtttttcattaatgtccactattagtttttatatcttatccagaatacgacattgtgtttggttgcattgagctgctttacaaccttccaataaatctgataaattatcttttgacttttatttaattccagataatttctaatttcccttgtgattgcctctttgacccataagtcactgaaaagtgtgtcatttaaactcctaatacatgggagtttcccaagtatcttgtgttaatgtctcatttaaatactttttgtctgcaacacactgtattttttcaatccttttaactttattaatactttaaatatctaaaccaaagatatttcttgaagaatgttccaattgcacttgaaaatatgggggctatttccagaatcttttgttattaatttccgacataattccacagttataagggaacagatggtatatgatttcaatcccttttagaacataattttttagaattgttttgcatcccagcatatgttccagtgtttcctgattaaaatgccatcgacacttgaatagaattgtatcttgctattgtataaaatgtataaatgttaactacgttcaatttgttcatagtactatttaggtttattatatattttttacttttctgtcttcattctattaatttcttagagtttagtattgaaaactccaattatatatattaatttatctattttttccatcaattctgtcagtttttgcttcatgtattttggggctctgttagtaggtgcaaatatacatttttaattactataccattctgcttttgacccatttatggttaaaaatatctctgtctttaataatattcatattattaaataaatgttgtctgaaattaatatacatactataatattttatgcatatgatttccatgtaatatatattttaattttttatttttagctataggttttttgtaattaaaatatattgtatgtgaggagcttagaattgggattctcttatgaaaactttttatctaatctgacagtacatttttcattttttaaattttttatttccataggtttttggaaacaggtggtatttggttacatgagtaagttctttagtggtaatttgtgagattttggtgcacccatcacccaaacagtatacactgaacccaatttgtagtcttttattcctcacccgcctcctatcctttcccctgagtctccaaagcccattgtatcattcttattcctttgcatcctgatagcttcgctcatacaatgtttggttttccattttttagttacttcacttaggaaaatagtctgcagttccatccagttcgctgcaaatgccattaatttgttcctttttatggctgagtagtattccatcatacatatatacaccacaatttctttatccactagttgattaatgggaatttgggctggttccatatttttgcaattgcgaattgtgctactataaacaagcaatatcttttcattagagtagttagttaacttacacttaatgtggttgatttgcttattttaggtgttcaattttgatactcattttctacttattttatatctttattgttcctctgttcttcctttcctgccttcgttttttgtattgtaatataattcatatatcataaagctcattattataaagtgtataattagtagtgtttagtatatttacaaaattatacaactgtcaacactatctcattacagaacattttcatgacactgaaaaatttaaaaatatatttattaggaaccattctccattttcccctctccccagctcctagcaacttctttatttctatagatttgccaattctggacatttcttataaatgaaatcatacaatatgtggccttttttatctgccttgttttaaatactataatgttttcaattttcctgtattgtagcatttactagtattgaattcgctttttcctttttctttatttttcattgtttagtgagatacaagtcacataactatacaactcacccattagagtgtaaaatttaatgatttttaatatattaatagatgaatgcaaatatgaccatcatcaattctaaaacattttcatcactgcaagacaaacattataccctttagctatcaccaccctacttacccagaacaccatgcctaagcaagaacgaattgactatctgtctctgtagatttgcctactctggcaatagctggaatttcatacagttgcaatcatgtaatatgtagtcttacgtgattggcatattcagttagtataatgttttcaaggtttattcatgttagaatctgtatctataattatttttatatgatgaatgaatactctgttgtaagaatatatcagaattttttttcattctgctgattgacctttggctcgtagccaatactttttatcacaaataatgctgctatgaacactaatcaaagattttgtttaaatacttgttttaattctcttgggtatataactagagaatttctgggtcacgtggtaactgccaaattgttttccaaatgcagggggattccaacttctttacatccttgtcaatacttgttattgtctataattatgactatgttcatcgtactgtgtgtaaagtggtatctcattgtggttttggtgtgcacttccctaatagctaatgatgttgagcatattttcacatacatataggccatctgcatatcttctttggagaaatgtgttttcagatcctttgcccaattttaattgggttatttatctcttactactgaattgtcaggattgtaacaaatattctggatgaaagacacataatgatttgaaattattgtctcccattattttagttgtccttgatggcatcatttgcagtgtaaaattttttaatttcgataaagtctttattttaccttgttgtttgtgcttttagtgtcatattcaagaaaacattgtcatagctggagtcatgaagatttagtcctatgttttcatctaaaagttgtacagtcttaccccttacttttaggtctttgaactattttgagggtttttttttttctgtgaatggtgcaagataagggtatgattttattgtttagcatgttggtattcagttatcctagcaccatttgttgaaaagactattatttccttcactgaattgtcttgacactctgttgaaaatcagttacatagaaaccatgtgtttacttgtagcctctcaattctattccatttatctatatgtctatatatatgtcagtaccacctggtcttgaataccactgctttgtagttggtttgaaaatcaggtagtgcgagtcctcgtactttgctcttttatctcaagattactattactctggctactctgagtcctttgcaatttcatatgaattttataataggcttgacaatttctacaaagaagtcatctgggatgctgatagtaattttgttgagtttttaggtaactttgggaagtattgtcatcttaagtatttcaaatctaatccatgagcatgaggatttatgtccatttacttaaattctttattttctttcaacaatgttttatagatttaaatatattaacacaagttttgcatttctttggttaaaattatccctaagtacttttattttttcaattatattataaactgaattactttattaatttaatttttggattgttcattgcaagtgtacagaaatataattaaattatgtatacttattttatatcatgcaaactttctgagttcatttattagttctaatactttttaagtggattccttagaatttctatatacaagacatgtcatcttctaacaaagatagttttaaattcttcctttccaatctagatgcattttctttttgttgcttaatttccctctgtagaacctctagtacaatgataaatgaaaggggccagactgaatattcttgacttgctccttatcttacgaggaaagtattgagtctttcatcattaagatgtctgctgtgggtttttcataaacgccctttaccaagttgatgagtttccttctatttctatgttgaggagtgacttttatcataaaagggaagtagatatgtttaaaatgttttttctgtatctattgagatgatcatgtgttttttacttctattgatatggtatattactttaattggctttcagatgctaaaccaaccttgcatacctaggacaaagcccacatgatcatggtgcataattttttatatgttgctggattcagtgtactagtgttctggttggtgtttttgtgtccatattcctaagaaatatttatccgtagttttcttgtgttgtcttcatctcattttggtatcagggtaattctgacctcataatatgagttaagaactgtttctttctctacaatattttggaaaagtttgggaagaactggtattatttcttctttaaactttttatatatttatataacttctaatatctttaaatttttatcactggtaaagtcatctttatggccataagttatgaacttttcattgtgcatagttttgggttagtggtcagtgtgtttacttggtatacgtccagtcacattgtctttttttgagtcatttttggtaggttgcacctttctaaaaatttgaccattttatctgagttatctcatttattgccatataatggttaataatattcctataatccatatttctgaaagatcagcaataatgtccctgctttcatttttgatcctaataatttaagcatctatctatctgtctgtcatctatctacctatctatccatccatccatctatctatctgtttatctatcatctgtcatctcttggtcaatctaaccaaaagattgtcaatcttgttgagcttttcaagagtcagctttattttcattaattttctgtattgttttaatattctctatttcattaatttctgctctaatctttacaagtttcttccttcagcttgctttatgtttattttgctgttcttcaagtgtcttagatggaagctcaggttattgacttgagactttttttttcttaatacaggcatttaaaatgataaacttctaagccctgtgtagttgcatccagtaagtttgggtatgctgtgtatttatgtttattcacctaaaagtattttctcttgtttttcttttttaattgaccaataagtatatatattaattatgtacatcatgtttttaaaatatgtatatgttgtataattactaaatcgagctaatggaaatatgcattacctcacatacatatcctttttgtggtgagaacacttaaaatctactctcttagaaattttcaagtatacgatacattgctattaactatagtcaccatgttatcaatagattcctagaacctatttccccttttttttaactgaaattttgtatccttgaaccagcatctattcaaaccatcctaacctctggcacgactattatactctctgcttctatgagttagactgtaattatagagttcacatataaatgagataatgcggtatttgtttttctgtgcttggcttaattcatgtagcataatggcctccagattcattcatgttgtcacaaatgacaggatttccttctcttttaaggctgagtaatatttcattgtgtatatattccacagtttatttattcatttattcactgatgaagatttagtttgattccatatcttggctactgtgaataatgctgcaatgaacatgggagtgcaggtgtctcttcaacatattgatttcatttccttaggatatatatgcagtagtaggattgctggattatatattagtcctatttttaattttttaaaaacctccatactgtttctcataatgaacctatggaatgggagaaaatgtttgtaaaccatacatctgataatacgttaatattcaaaatatgtaaggaactcaaacaattcaatggtaaggaaacaaataatccaaataaaaatgggcaaatgatctaaatagacatttctcaaaagaagacatacaaatggccggcacatataaaaaaaatgctcaacatcactaatcatcagggaaatgcaaattaaaaccacaatgagatgacatctgatacctgttcaaatggctattaccaaaaatacaaaagataacaagtattgctgaggatgtggagaaaaggcaacccttgcacacttttggtgggaatgtaaattagtacagctactatggaaaccagtatgaaggtttgtctaaaagtattttctaatttctcctttgatttattatttgttccattagatatttggagcatgtgatttaatttccacgtatttgtgattttctcagatctcattctattattgatctgtacttccatttttttatgttcagagaacatgcttcatattctttatcctttaaagtttgtcgaggtttgttttatgatatagcatataatccagcctggagaatgtgcgaggtgcactttagaagaatgtaacagacactgggccctaaccagaggagggagggtgggagaagggagaagatcaggaaaaataactaatgggtactaagcttaatacctgggtgacaaaataatgtgtacaacaaacactcatgacatgagtttacctatataacaaacctgcacatgtaccccaaacttaaaagtaaaatatgtatatacataaatataataaaaattatgtaaaataaatagtcatgaactatataattgtatttttactgttccttttctatgtttagatacacaaatattcaccattgtgttacaattgcctacagtattcagtacagtcacatgctatacaggagtccaggtgtgtagtagactataccatctagatctgtgtaagtacactctgtgacattcacacagtaacaaaatcacctaacaacacatttctcagaagatgtggccatcattaagccacacgcaactgtaattagattttttaaaatccaaatttaaatttttggctttatataaaaaagtttgatttaaaaatggatattcatttttgacattggtatcttgcactttaattttaatttttaatattttaaaagaaagaatttttcaaaactatatggaaataatgttaacttttaaattgtatgcttgttttaatgtatacttttataaatatattttcattttactcatttaggttattactgtcaattgaacaccaattatgtaaaaatctttatgaaatccatataattagcaatgtagctaaaaagaatgcaagaaaaataaattttatgtgacaaatatatttttaaaaagaatacatattctgttgttgagtagattgatctacagatgtcttttaggtctaattgatttatagagttgttcaaatcatctatttcctggtcgattgtttgactacttgttctttaaaatcataaaatgtagtattgatgtgttcaactattgttgaattgtctaattatcacttcatttctttccattttcacttcatgcattttggtgttctgttattggtacatatatgtgtataattgttatacctttctcatggattgaccctttaccattataaaatttttgtctttagtaaatttttgtttggaaatctattttgttagatattaattagtatatcctctttagctctcttgtggttgctctttgcatgattcattttccatcttttaatttcaatatatttgtatatagagttgtatatacattgtgcctcctgtgtacagcattagttggatcatgattttattcaatcttactatctcttcattttgattacatttttagtctaatcacatttaatgttattggtgatatagtttgatttaggtctgccatgttacattttgtttctatatgtctcatgtcttttttccttatatttttcttttactgcttgcttttacagtaagtggatattttctaatgtagcattttaatttatttaattatttctttctagttatttctttagtggcaactctagggcttaccatatatatcttatcagaatcagcttcatatatgtactaacttaattccattaagatttagaaacattactcctatgtaactctattcctttttcccctttctgaagtattatttatcatatattacatatgatacatatcacatcaatacattttacaagcacaataatatatcattataattattactttatgtaattttatgtcttttaaataatttcatagaggaaaggagcaaattcatatttatgtcttttgttatattaatcttatttcagattttttcctatgggttcaagttaccatgtagaatcatttatttagcccattatagctttgcccccacctacatctttttagctgtcattggcaaatgtgtttacatttctataaggtatatagtcaagcatatattatgtcaacttaaataacaaaccaagagaagctctctaaaagaaaagatgtttatttggggatacagcattgcaatgggaatatgcatgccatagtaaaaaatgtgcatatttaattagatgaacaaagacaaagtcttttaaaggaaaaaatcagacggattacataattgttttgaaatagttattcttgtctacaaagattaataacaagaatgatgccagtctgaggttagacaggtagttgctgggtagatgacgctgtagaggtatttttttgtgtgaagttgtaatgctttctgcagacttttgtgatagttgtgttatcagatataccaacatgagaacgctctcttcacggcctttcctggctctatttgtcagggtttcattaatattaatgaatccattttgattatggcaactttcacaattgtacacttttttatacaattgcttttaaaatcagccaagaaaggagaaatgtatgcatttatactgtcttctataattaaaaatttctttatagatattctttgtatttttatattggtattattgcctggggtcacttgccttcagctcaagaacttcatttagtattttttggaaggcaggtctgctagcaaaattctctcagggaatgtgcttatgttgcttttgtttttaaaaatagctttgctggatataggatccttggttgacattttgtttttcttcattaggcatttttgaatatgctatcccatcactttccaccctccattgtttctgattaaaagccagctgttggccgggcgcggtgcctcatgcctgtaatcccagcactttgggaggccgaggtgggcaaatcacgatgtcaggagttcgagaccagcctggtcaacgtggtgaaaccctgggtctactaaaaaaattagctgggtgtactggcgggcgccagtaatcccagctacttgggaggctgaggcaggagaattgcttgaacccaggaggcagaggttgcagtgagccaaggtcacaccactgcactccagcctgggcgacagagtgagactctaaaaaataaataaataaataaataaaagccagctgtttatttcattgtggttctattgtaagtgatgggccctttacccttgttgctcccaaatttttctccatgtatttggctttcagtattttgactagtttatctgtggatctctttgtatttttccaacttttagttaattgactttcctagatatgtagatgtgtaatggtgttcttctctctgagtagtagtcccaatctagaatttgagtgctaagtgaaagggctaggccgtagccataggtctttaggcttgcttctcttgacatgaacccctgtcttatcaggtgggaaaatggcaattcgggacccagtattttcagcagcaccatacccaagctggagcttctactgtatgagtagagatcaagtagaaaagtagagtgcccgcttctcagctacacttacccagatattatcctcagcagcaggtagctggtagtaggatgaaaaatgctgatgctgtgtctctcctaggaatataaatccttgactgggaactggggataaggggaaccttgtgcattagctctaccaatctgagtgaagtttccatcttcctgcattgggaatggggaggaacagaatgggttatggttcaaacaccatagactctcactgttcttactgagctctactagatttccttgaacaaatgtttcttcatattttgcatgtctccaggaccattttcagaaagtttaaattattgttcttctataatttccactagttttcgtggaaagtaaatctgtggagttcttcacgtggtcatgccaaaagtggacctcacttcatctttttttatgtcttcataatattcaattctatggatataccacatatttaccttcagttcattgaacgtattttaaatcacttatttaaagtctttttccagtaagccaaatatctacgttttcacagagacagtttctactgattacttcttttcctatgtaagagccatacattcatatttctttgaaattctcatatatttttattgcaacttggacaatttaaatattataatgtagtaactctggaaattagattctcatcattcctcaggattggctgttttcactatttattgtggtagttattgtttactgactttcctgaagtaactctgcagagtgtatattctttatcaatgaagtctcagctccattagcttagaggccagctgataattggacagagattaccttaattgcctggaacaaataaatctctcagttgttgctaaggagttctgtgttgctgttgggacacatcttcaacattcagccaatcagtataccattttgccatgggcttcccttacttgcacagagcctcaaggtcagacagaagtgagagcttaaggccctctcaggtctttcctaagcaatccgactgtttggggaatgcatacaatcctacacatgcaggtgtccttttagattatgaagaatcatgttggagcttttcaaagcccttctggacattttatttctcactttttccttttattcattttgcttagtctattgttttccccaactgtaaataatttcctcaggcagctggaatgttaaaacatttgccagtaaatgttttccagaaatgctcctcagggagaagtttttagcactggttgaactccaagtcagatgaaaggaaataagccttttgtgttggttcttccaggacaccactagaaaagtcaaataatgacaattttttaggtgcatggctttcagagatctccaactccattttgctactctcagtgccaggagggtcagctgttattttttaggactgacactgatctggagagcacgggatgggaaaggaacggttcttagtgatattgagacaattatcttgaatgaatgtttcccatgttgctgcaagttttgggttagtttttatagttctgatgatgttgaatctatttttccaatttttctgttgcttttatagagaggcaaatttttgaagggacttactctaacattttcacagatgccactctctgctttttcttgttttaaataaatttcttagtatgcaatttcaattccactattggcattttagatatatttgaattatttttaaattattgagctagaaaatatggtatgcttctataacttatcctattatactaaatgttcatctctacttacttcttagaacaagaaatataggaactttgaaaacgtatagttgcatttacctcttcccatcatttgtggattgttgtcaaatatattacatgtgtctacattataaagccacttacagaatgttgtaatttttgcagtaaatagcatctttgtaaaataaaaagagttttaccttgtattatacttaaccacatattcacttaccatttcttgttcccttcattatttctggttttcatgagttactatctcatgtcatttcctttcagcctgaaggacttccactaacatttctcatagtgcatatctgcaatcaataattcattttttgctatctacaaatattttcatttcaccttcaattttgagggatagtcttactggatatagaattgtttgttgactgttattttgtttcagcacttttaatttgatatttgagtgtgtcctgtccttcatagtttcttgagataagctgataattatataattgtttcctcatatgaaatatgtctcttcctacttctgctttttaaatattcttactctcttttaaattcagcagactgtgatgtttgtaggtgtgatttctcctgtttattctatttggaattcattcatctttatgaaaatgtgggttaaactttttcacaaatttgtgaagttattggccactatttcttcaaacatttattctgcttctttcctttctgtctggggcccaaattatacctatattaagccacttagtattatctcataagtctcaggcttaattcatattttgtatcattttattccctactcactgattcttctagccttcgaaattgcaattgtcccatcaagtgaattttttttttgctattttgataatttaattttacgaacattataattttcacttggtctttttataggtgtcatttcgttattgatattgttgtctttcctgtcattaataccatatttgcctcgaacttattgaacatattttaaaatacctgttttcacatttggatctttaaatcaaacatctgtgaccaagcatggtctatttatattaaattccccttttacagtttatgtttcccactttctgtttctttgtcaacttttgattgaaaactggatattgttatacattgacactctggagcttgtttcttattgtgaagattattgttttttatatctagtaggtatttaactttctggactcaaactataaaacctgtgtcccccacattgtgcaacagctgacatttcttttcagttttcttgacttctagttgcttctttttagtgtgttcctcccatctttcccttgtgcctatggagtttaaagatcagcctaggattgaggcaaaatttgtaatgagatttaggataggttggagaatgcattcaatcaaagacacaaattgaaaattagtaagggaactcaggaagaaagcgaaccacagagagatcgttaaatctaaatataaattcatgctgtatgtcctgatcataggaagagatccttcaatgtatcataatttagtctggcaatagctgtttttttttataagaatatatctttttatcaactggggaagtatctttgttcctagttttcagagaatttttatcgggaatagatattgacttttgataaatgatgttttaaattctattgagaggatctaatagtatacttttttctcttatttatcctattaatgtggataatttctttgactggtatacattcttgaaacatccttgcattcttgggaacaatctagagattaaacccccatctgatcatgatatactttttatatattgatggatttcaattcctaatatattactgaggatctgtacatctatgtacataaatgattttgttcaataaattacttatcttgcaaagtccttatcagcttttcgtatcagttatgctgaaatcataaaattggttagaaatatatcctccttttccattatctgacactgttcacataaaattggtaatatttctctcttaaatgtttgaccgaattcaccaatgaaggcatttgcatctgaattctttttctggagggggtttcaaatgtcatttagttaccttagtagatgaagagcaatttcaattttctgtttctttccattttgtttcactttaattcataggcaatacagtaaggcaaaaaattaaataaggaaaagtaaagaagactggaaagaaaacacaacttttttacctgaagataaaataattgtctatgtgaaacttaaggaatctacaaaaatgaaaaatttactaatatcaataagtaatttagcaagctttctgagtaacagatcgtataacacacaaacatagatggtatttccatatactcacaacaagtaattgaaaaattaaataatctgtatctatagtatcataaaaaatatagtacccttagaaaatatatgagaaccctctatacatataaacatagcttagagaaattaaagtggaataaataaatggaatgatattacatgtttttgaattgaaaatctaaaaattaaaatataatatattaatatatctaaattaatctatagattcatattaatccaaaaataatcacatcaggctagtttcagaaactgacaaactgattttattatttatttttatttttatttttattttttttttgagatggagtctcactctgttgcccaggctggaatgcagtggcatgatcttggttcactgcaacttccgactcccgggttccagcgattctcctgcctcagcctcccaagtagctgggattacaggcgcccgccaccacacccagctactttttttgtatttttagtagagacggggtttcaccatgttggccaggctggtcttgatctcctgacctcaggtgatccacccgcctcagcctcccaacgtgtgggattacaagtgtgagccactgtgcccagcctgattttaaaatttataaggaaaagtaatggacctaggagagttaaaataattttgaaaaaaaatctaggagcatttatctgatctcaagacatacaatatagctaaagtaatcaagagagtggttattggcacaagaataaagaaataaatcaatgcaatttttaaaaaatagtccagaaatatactcacacataaactatcagttttccaaaaaaagtgccaagataattaaataagaaaaatgtttttttcaataaatgttctgaggcttatgtacaaattggtataaaagaattaaccttgacttcaacctcatagtatatacaaaattaccttaagccagatcatcaatctaaatataaaatctaaaagcaaaattattatagataaaatataaaagaatatcttcataaccttgccataggccaatatgctttgaataggaaacaaaacacataaattaagaaattaaaagttgacaaatcaaacttcaaaattaaaaactgctctttgaaagacgacaatattaaggaaataaaaaagacaagccaaagactcagagaaaatataggcaagatatatctgacaaaagacgtgtatgcaaaatatataaagagctcttaaaaataagtcaaacaactcaactgaaaatgggaaaaatcttgaacactttataacagagtatatccaaatggcagtaagtatatgagacattgttcagtgtcatagactgtgatgataatgcaactttaaaaccacaatgagaactggcttcacaccactagaatggctaaaattgaaaagactaacactaccaaggggtgtcaaaaattagtggcaactgaaactttcattgcggatgggactgcaaaatggtactttgtcagtttcttagaaagttaaacatgcatccaccctatcatccagcaattccactgcttacatttacccaaatgatacgaaactatatgtctacacacaaaaaaaatcttatcacgacttttaaaactactttattcataataatcccaaactgaaaatatatcaaacgtttatcaacaggtgaaaggataagcaacaattccttcaaaggaataatatttacaatagaaagaaaaactagtgacacaaccaaaaatatgggtgaagtgataaccattatgatgagcaaaagcatccagatatttaagtgtagatcttatatgattccatttatgtaaagtcctaaaacaggtaaacctatactgataagtatctaaagagtcattttttggggtggggaaaatttactagataagaagataagaaaactttctgcaggcttgaaaatgtcctatgtttcaactgggatggtgatttcacagatatatacatttgtaaaacctcatgtaaatttatacttgaaatctgtgtgtttttatgtgcttgtaaattatatttcaataaggtatttatatttcaataaatctaccttatttatttatttatccatttatttatctaccttatttatttattcatttgagacagagtgttgctctgtcacccaggctggagtgcagtatcatgatctcggctcactgcaacctctgcctcctgggttcaagcgattctcatgcctcagcctcgagtacttggtattccaggcacacaccaccatgctcggctaatttttgtatttttatttgagacggggtttcaccgtgttggccaggctggactcgaactcctgacctcaagtggtccactcgcctcaggctcccaaagtgctgggattacaggtgtgagtcactgtgcccagccagatttattttttaaataaacaaaacatcaacaatctgtgagacactgacaagtgctctaatatgcattgatctcagaaagggaggaaagacacactgaggacataaaatgtttgaagcatatagaaagtgtacatcccttcttatattttttaaagtctagtaataacaagtgaaaaaaattataacaaagtgttgtggagttatgccatatttagaaataaatcatatgaaaacaatgacatatgttgggggtgtaaatgaacttatgctgttatattattcttacattatacatgaggtagtagatcatgcaacttatcataattgatcatagtatttctttttaaaaatatctgtaggttatgtagtgatgtactctcttttatcttgatactggtaatttgtgttctttctccttcctttttcttgatgtgtcttggtagagattgatccattttattaaactttgcaaagaaccaactttaggtttgtgaggtttctttatcatgtatctgttttctcttttgttgatttttactcctcatttatctgttttcttctttgtatgtaggatgtaatttcctcttctttttttcaagtttcttactgcagaaacttagattactaattttaaccattctttcttctttttgaatattgacatttagtgttaaaatttcttccaggctgggtgtggtggctcacgcctgtaatcccagcactttgggaggctgaggcgggcggatcacatgaggtcaggatttcgagaccagcttggccaacatggtgaaaccttatctctactaaaaatacaaaaattagccaggagtggtggcgggtgcctctaatcccagcaacttgggatgccgaggcagggagaatcgcttgaacctgggaggtggaggttgcagtgtgccaagatcatgccattgcactccagcctgggcaacagagtgagactctgtctcaaaaaaaaaaaaaaatcctctaaattttgcttttgccctacccacaaattttgtatgctgtgtgttcaacaaattattctcaaacgtttttccaatttttcttgtgatttcttttttggcacatgagctatttagatggttgtaatttgattttccagttatttagatgagatgtgggaaatgagtgatcaatatcttatttgtcattaatttcttatttaattctgttgctaagaacatactatataagattgcagtctttagaaattattgagagatattttatgcttcaacatatgacttatcttgataagcattccatgtgaacattttaaagaaggtatattcagaagcattcagtgtagtgttctgtaaatgtcaatcacatctaattgacagtgtttatattttatatatcattactttctttttcaaacagttactgagaaaggaatgttaaaaatgccaatgatgattgtggatgtattcatttcttccttagttctgtagattttgctttaaatattttgaagctgtgtcactgggggaaacacatttaggatttgtatgccttttgaatttgtccttttattattgtgaatacccactttcatctctgctaatattgcttgtcttgaaatacactttgtctgacaataatatagccatgctacctttcttgtaataactactcatacaatatataattttccataatttctaactttgtacttacatatgtcttcatatttaaagtttgtctcttttaagacaactgatcatctttctcttttatcttaatctgaaaatctctgcctcgtaactaaacgatttggatcaattacattttatgtaatcatcaatatgactaggtttaagtctgatatcttactattcattttctttttgcttcatttaatttttgttctcctgtttctcttttcctgccttctcttctgcttaccaaatacctttagcattgcattttagttcctttattgactttttatctatatatttttaagtatttttatttgacctaggtggatttaaggattgccatcggatatcttatctcataagcatccttaattttaataatgtactaattttccactttagactttagacatgtaagaaacttaaaatgtataatttgatttttcaagcctgttctttttgttaatattgtcatgtatgctcttgctacatatgtcatagacacaactttaaaatcaactcatttgtgcctcaaaacctcacttaccttttaagaaattaggaaaaaataaaaagtagtctgtttacttacatgtttaccattttgggtgctcctctttcctccagtagttgtgagtttccacctggtatcattttcaacagcctgaagaacttcctttagcaatctttttttttttccaaattttattttaagttcagggatacacgtgcaggatgtgcaggtttcttacataggtaaatgtgtcccatggtggtttgctacacagatcatcccatcacttaggtattaagctcagcatccattagctattcttcctaatgccctccgtcctcaccggctggcaggccccagtgtgtattgttcctcgctatgtgtccatgtgttctcatgattcagctgccacttctaagtgagaagacaaggtatttgcttttctgttcctgtgttagtttgctgaagataatggcttccagctccattcatattcctgcaaaggacgtaatctcattcctttttatggctgcatagtattccgtggtttatatgtaccacattttctttatccaatctatcattgatgggcatttgggttggttccaagtctttgctattgtgaatagtgctgcaatgaacatatacatgcatgtatctttataacagaataatttacattcctttgggtatatacccagtaatgggattgctgtgttgagtggtatttctgcctctgggtctttaaggaatcaccacactgtcttccacagtggttaaactaatttacactgccaccaacagtgtaaaagtgttgctttttctccacaacctcaccaccctctgttgtttctggactttttaatagtcgccattctggctgacatgagatgatatctcattgtggttttgatttgcatttctctaataatcagcgatgttgagcttgttttcatgtatttcttggccacatgagtagcttctttgaagaagtgtctgttcatgtcctttgcccactttttaatggagttgtttttttcttgtaaatttgtttaagttccttgtacactctggatattagacctttgtcaggttgcaaagattttctcccattttataggttgtctgctcattcttatgacagtttattttgctctgcagaagctctttagtttaactagaacccatttgtcaatttttgcttttgttccaactgcttttggtgtcctcatcttaaaatctttgcccatgtctatattcagaatggtattgcctaggttttcttctgagatttttagtttggggttttacatttaagtctttaatccatcttgagttgattattgtatatggtataagaaaggggtccagtttcagttttctgcatatggctagccagttctccaagcacaatttattaaataggaaatcctttccccattgcttgtatttgtcaagtttgtcaaatatcagatagttgtaggtgtgcagtcttatttctgagatctctattctgttccattggtctatgtgtctgtttttgtaccagtaccatgctgttttggttactgtggccgaatagtatagtttgaagttgagtaacgtgatgcctccagctttgttctttttgcttaggattgccttggctatttgggctcttttttggtttcatatgaatttttaaagtttcttctaattctttgaagaatttcaatgatagtttaatgggaatagcatagaatctataactttgggcagttatgagcattttaattgcatcgattctttctatccatgagcatggaatgtttttccatttgtttatgtcatctctgattactttgagcagtggtttgtagttctccttaaagaggtccttcacttcccttattagctatattcctaagtattttattccttttgtggcacttgtgaatgggagttcattcattctttggctctcagcttgcctgttgtttctgtataggaatgcgctatctcaggcaggctccaccctgttgctggtggctggctggaattccaaaccagtgggtcttatcttgtgagatgccatggaagtggggcccgcaggacaatgctgcttgacttcccggattcagcccccttcctagtggtatgtacggacctcccgccttgcctgagttgcagacacctttgttggggatcctggggtcagagtatgtaaagctcctgggtctctgtgtgtgcctgagcagctgctttgctgtgactccacacagctctgtgttggacccaaggccctggtggcataggttcacaaggggatctcctgatctgtgggttgcaaagatccgtgggaggagcatggtttcccacggtcgcacaagcactcaccgcttcccttgactggacgtgagggttcccttggctctgtgttgctcccaggtgggccgttgccccgcctggcttttctttgttctccatcggttgagttgtttccctgatcagtcccaaagtgagtacctggatatttcagttgaagatactgtattcactcacgccttttgttcctctctgtgagtgccgtggactgtagctgcttctaatcaaccatcttggtccccttagcattcttttaatgaagttctgttggcaacaaattctctcagctttagttgacatgaaaaagtcttaattttaccttcatttatgaagtatatgatcactgaacataaaattctgggttgacagatgtgcgtttgttgctgtagtttttactttattctttttaaagatgattttatcttctgtcctccatggtatctgatatgacacccttggatatttctttctttttcttgcattaagctttattttaatgggtttcaaaattctgtaacagatttttggtcagggcgtttccattaaaaagtgttgattttaaaaactaaaaacttaaaactgccacatgcaaaaaaaaggggatccagaaaacattctctttttcttctgaaggttttacaatgcattgtcatcattaatcagttttactattaaacttaaaaggctaattgaaacaaacagttctgagaccattcttccaccactgattaaaactggggtggcaggtattagggataatattcatctaaaacttctgagatttctggtcaaacttggtgaccttgccagctccaacagccttcttgtcccttgctttgatgacacataatcaagatatgatgtctatctcatatcataaagagcaaaatgactcagaggaggatagtctgagatactgtcaacacacatgggtttgccaggagccatatgaatgacaatgactgcagcatcaccagacttcaagaactcctgtcagcctgaaatagtatggttttctaggtatccttgaaaaaaaatttcctctccatgcaaaataacccatggaaacagataaccctgcaggttaacaataatttccctatgttttcattttgatgtttatcaagctgttctaggaaacgtattctctaatctcttttgtatcactatttattattcatctcttggcagtctgtttcctgtcttcactataattgttctctctataatcaccaatgacctcttcattttcaaagatagagaaaatgtttcaaattctagatctctctgtggcatttgaaactgttgcggatgtcttcttcagaacactccttccctttgttcgtaatgacataacttttcacttacactgaattgttgtcatgtagctgacactcattttgcaaattttgctgctggtagttttgatctttccagaagatgtcaaaagaagttattcagaccagtttcacacatgtactgacaatgacaactatctaatgactagtttctggccaacaatgattgtaagacactatgggttgtatgaagcatcacaatttcaaagatgttaaaatctgaaagaaatgtgcctcttagaatcattggcatatgaccttatggtttggagagaactgatctgtgttgcttgaattcaaggttttaagaaataatgtaaacatatttatacatcctctgaacttacctcttttgcagtaaaataacttcatcaactaatgggcttttaagaggctgaaatgagataatgcatgtaaagtatgtaatgcagacaaagtatcagagtcagtaagcactcataataaacacttaatgaatgatagtagtagtagttgtaacagcagtagtagttataatagcagtagtagttataatagtggtaacgttatattttgaataaaatagtggtagaagtaacatatgatattttcagtaaagctttaacttaacaatgttaatgaatttaatattctaaaatgctaagtaagactcttatatgtttactgaaggcactcttcctctcagagtttaagtaaccttaataaataataaccacttttcagagatttgcaacaactgaattagataatgcatgtgaaatatatttgacagtttattagttgaagaagtacctaaggtttgcagcacaacatgaattataacttacctttgttggttctaaaattctaaggaagatgatacagagttattgaagttaatctcagaaaggttaagtgattccacctaataatttatttttttttgtctggattgaataaaatatatataaaagtatataacaattgtgaaatatgtggcttagtgcatgacaaataagccctcagtaaaaggtagttattattattggaattattgttagtgacacctgatattttcaatggtagttcatatctagttttcctctttggccaaatcaggaatttcaaaaatattgaagattgcctcatgatatttgctaaacttacttaatttttctgaagttaacttcatcaaataacatgtgccttgcggaatttttataaaaatgaatgatgaatttaaagtgttttgttgccagtattgctgttatttatatttaccagacatgataatatcgcatgaattactattggttgaaataaaaatgctaagacaaacttaacacatttgctgaacttaactctctagcacttaaataacttaatgcattaacatagaacagcagttctcaagctctttggtgtcaggacccctttatactcttcaaaataatcgaggactccaaaagagtttttgcttatgcggcttatatttattgatatttatggtattagaaattaaaactgagaaatatttaaaatatttaggaataattttattttcaataataataataaacccatctaaggttaacataaaaacatatttttgaaaactataatctccaaaacaaatcagagagaaaacaggcattgttttacagttttgaaaatttattgtatttatttatttatttatttattttagatggaattttgttctgtcacccaggctggagtgcagtggcgggatctcggctcactgcaacctctgcctcctgggttcaagcgattctccttcctcagcctcccgagtacctgggattacaagcatgtgccatcatccctggctaatttttgtatttttagtagagactgggttgcaccatgttggccaggctggtcttgaactcctgacttcaggtgacctgcccacctcggccttccaaagtactgtgattacaggcgtgagccactgcacccggcccacagttttgaaaatctcttttaatatcttgtttgacagaaagaaagctagattctcatatatgtatccacattcaaacagttgtgatatgttgttttggttgaaatttatgaagaaaatgcagttttaaagacagttaggaaaggaaaacctagcaagctttctaacagtctcagacacccccctagggtccttgaatcacactttgagaactgctgacacttaccttttatttttttttaaagtattgaataagacagtgtacaacatatattgttattaatgctgcttttgttgttgctttttataatttcctcatatgtttgaaataacttgaatttcttcttgttttgttgattgcattcatggtttctaaaaacaaaagaaaattaatgacagtgcagatttggtaaactggttaagctactttgccaaataatacctgtcttataaagtttttaaccaaattgagataatacattctacatctgtaatgtcagtaatatacatggctcagtgcctggcacataggatacactcaataaatggcagctattagaatcaccctttcctcaatgcacaaaaaataatacaaatagatgccagggataaaattggcctcatctacccaataacagcttcagcttatctacagtgactttgctaccctctcttgctgtcccttgacaaggcctactttaggctcaagaatcccttagacaagtgaataaatcatttaacagaagcgagctaacattactctggagttggtctctaagtgatacaaacttccaccaatctcatggcctgtgtgtgaggccttccccagaaacgtccaagtgtgtctatgaatacttagaatatatgcagcatttcctgtgggaaattgaaggtacatgcctcagtcatgatgcctccagggtgaaagcaaattccccagattgagtctctagccccacgctgtagtatctaaggtgctgggtggttggcaaggtaggagattgaagagggaaacaccactcctgcatcctttattgcttttgctgtaaggaacctggaaaggtataacagagtttcctatcaacacattgtcagaaaatggccttcttccctacagttttatcaaacaggtggttgaatgtttctatttagggatccaaatgtttttttgctctggaaggaatcacttccaagattagcagtggccaatcagttttggagactttttaaaatctgaggcttaacagtgatgttactctgtttcagaaaggacctctatgtcttcttttctctttttttaaattgaaaaaaattattaaactttctgtttcatagttgactttcaaagattacaaaggtagaattataaaataaagcccatgaactcatcatccagctccaagatttatcagcctgtggactgtcttgtttcatccatactttcatccacttctccctcccgtattattttgaaataactccaaacatcataatacttcatctgtaagtgttttagtatgtatatcaaaaaataaaagagctgtctttttatataaccacaatatcaatacctcacctaaaaattaatgaacaataattatttaatatcatccaaaggccagtcattgttcagatttttaattgtgtcatgaaaatttttaacatgtttttgttttcatcaagatcccaagaagatccacatattataattacttgatagatcttttaagtatctcttaatatataagttccccctctaacattttctcttgtaaatttttttaaagaaactctttcttcttttaaaaatcttatattaactttctgcagactaatccgtcactaaaatatgttattaaggttaagccaacactgatgtctttagggcatgtttgatctgtgctgtctagagattaccttacgtttatgatttttcacataaagatttaaacaacacagtctggcagctttcttaactgcttttttttttttttaactcttaagaaatatattctgtgtggttctgctgtactctatattcccaaattcctgttgaaatttcccaggcatttcatcaaacttggtgaaaaatcactttctcttttctccttctaataattgtcattccaccccatctaggtgcaaaggtctctgctttaggatctggccatgcactacttgaggtgacttactgtttgcagtgcctcctcattttcagtctttcctactttcttgaatggtgtgcctaggttcagagctataggtaggcatggaccaatacccagggaagtcttgtcatatctgttgtggcttcctcaccctgttacttggcttcctactctaggaaaaggccagtcattttagaaattccatgtctgaggaagaagacttaaagatcactttcaaaacactctcttctttctatcttcccagagattaaacatccgtcaacattctcagcaagctctagcaaagaagcattgactcattgttttttttccctcttgatcatccagccagacactctatacctgactaggcatgttaaagcaactagtaaggactttctgtttcaggtttgtcacagttgcttgtgtgttctctaaggtcagcaaggatctctgagaatgcatttctgtctcctctcacagttcatgatgtagacacctaccagcccaggattcctaataatctctaatggaaccccacaaatacaatctgaacttcccaggcttcgacttcctgtggacacaagacaggacagcaatctctatctgttatctatttatctctatgtattgatgcaggacctcttgaagacctactgtggttatttctgaaagcttccagatatcttacttatgctcaggcacaagatcaccttctgctcccacctcctcattgatatttcctaactatgggcctatttattgaaggaagtgcttccctagagtactacctctcagtattcttaaaacaaaaatgctcaaaattccacacagaaactggaggactgcatatctcccaactctacattttaccctctcttgactttgaaacattgctcatgcccagagactcaaaataaaacaaacaaacaaaaacccttgctaaaaagagaatcttttcagtctctgcttattgactatttctgcatagtagttagactcagcccagccatccctaataggctattattactattacaggtggtatttgtctcatttttattgaatttggaaaatgatatgctaaagaaagaatgattggctttattaatgtcatcaagtacagatgtgaatttattcattgattcaacaaatatttatcgagtgccttctctgagccaggacgattcttggaactggaaatccaacaaatctgacacaatccaccctttgacacaaccgtgtctctaatatagttaatatcaataagggtaattccatgccttctacagaatttagggagaaggcattcctaacatgaaaaacgccatcattttctgatgccatactgctagtgtttcatgtgactatcgattatgccgtgaatagctttcaacaaatatcaggtctgaatttccttccgtaaaatgcaaattaatgtatgccgttgaatacatctgttcagtccttcaagatgctataacaacccccttcctttttcttcctttaggtgtatcagttcctatccctgtgattggactgagggacgaagaaaaggtgttcgtgaacaacacgacgtgcgtgctcaacgacccaaatttcgttcttattgggtccttcgtagctttcttcataccgctgacgattatggtgattacgtattgcctgaccatctacgttctgcgccgacaagctttgatgttactgcacggccacaccgaggaaccgcctggactaagtctggatttcctgaagtgctgcaagaggaatacggccgaggaagagaactctgcaaaccctaaccaagaccagaacgcacgccgaagaaagaagaaggagagacgtcctaggggcaccatgcaggctatcaacaatgaaagaaaagcttcgaaagtccttgggattgttttctttgtgtttctgatcatgtggtgcccatttttcattaccaatattctgtctgttctttgtgagaagtcctgtaaccaaaagctcatggaaaagcttctgaatgtgtttgtttggattggctatgtttgttcaggaatcaatcctctggtgtatactctgttcaacaaaatttaccgaagggcattctccaactatttgcgttgcaattataaggtagagaaaaagcctcctgtcaggcagattccaagagttgccgccactgctttgtctgggagggagcttaatgttaacatttatcggcataccaatgaaccggtgatcgagaaagccagtgacaatgagcccggtatagagatgcaagttgagaatttagagttaccagtaaatccctccagtgtggttagcgaaaggattagcagtgtgtgagaaagaacagcacagtcttttcctacggtacaagctacatatgtaggaaaattttcttctttaatttttctgttggtcttaactaatgtaaatattgctgtctgaaaaagtgtttttacatatagctttgcaaccttgtactttacaatcatgcctacattagtgagatttagggttctatatttactgtttataataggtggagactaacttattttgattgtttgatgaataaaatgtttatttttgctctccctcccttctttccttccttttttcctttcttccttcctttctctctttcttttgtgcatatggcaacgttcatgttcatctcaggtggcatttgcaggtgaccagaatgaggcacatgacagtggttatatttcaaccacacctaaattaacaaattcagtggacatttgttctgggttaacagtaaatatacactttacattcttgctctgctcatctacacatataaacacagtaagataggttctgctttctgatacatctgtcagtgagtcagaggcagaacctagtcttgttgttcatataggggcaaaaatttgacattgtcagaatgttgtgttggtatttactgcaatgtctgtccctaaacatagtggtattttaacatagcagctggttaaccgggactacagaagtggaaggataatgagatgtaatacaccaaatagcttttcacttcttaaggacagtgttcaaattctgattattacaacaagcaaactgaaattagtgttttcattctggtccttagtaaattcctaattctatgattaaactgggaaatgagatcccagagttatttcccaacccaggattcaacatcaattgggttttgatctcagcatcctggaaatttgtgtgcttcacacaaagtgaaattagtattttgagccttattaaaatattttcttaattatggtacctctgtctataggacttaatttagcagtccatttttgagtaaaacttgtattggaagtatagatggtagaaactttggaagttttacttgattaaggactacagaattgggcccttagaatgtgaaaaaaaaaagtaattaaaaagacacttttaccgaactcgggattacagaaacacggagtttccatttggattttaaacaaaatttatgtcattttcagatccttccaaactctctagtgcaggaaaaggctgcagctaatttgtgaaagtggcaagctcttcattgcactgcagttatttaccagaagtttaaatctttgttaaaatatagtgttgtgttacaataagtgttggccatcatttcattcgtgggcctgctgctctctaagaattcagtagcattttaatagtttctaaaccatgaaaagttttcaagcattgctaaagtcaggccattcagtctatgctgtgtgcagagtatacaagtgtttctagtaacagtatttccatacgtgcccatttcacacaactgtggataaattttggaagaattcatgatgctagttcttacgcttgacagttacttacacacctgagaatgtgcctctcagtatcttaaaattggttaatgaaaaatctgaatttctaaaacccttggtctgtgttctcaacacacagtatagataaatccaatagtctgccacaagggcagtggaagagctgctgtatttgaggaaactcatacagtctctatttgatttgcaacactgccaaacatcagtcaattgcttgagcatgcccaaatataacatgaaagtcaagtctacctgccttgcctgttaggtctgttgaagtgcatgttaaaataattatatgaagcagaatgagatgatttaattcttaccgaaatgaaaatggctgaagaaacacagcatgcatttagcatgagttctgcacatacagatggtgtcctgcatgtatgccatgtatgttgcatgaatccatcgatttgtattaatgtagggcagaatagctgatagaagaaggactgaagaaaatccttcagcaatccttaaaaagaccatgcattcagatctgaagtagtgtgagtgttagaaaaaactggaaacatctgatttctgaactatcagggcaagctcatagcacatgttttacaaagaaacaaaatataaatcacagatttccaaaagtactagcaataagttgaatgataatagctcacagcacatttgttaatgattcttgtgtcatcaagtagtagtacttaatagtacccaacctggtaattatcctcaagttgtgtgctattcgtaagttctgtgcagtttggtatgaaacaaatatactcatttggatataaatcttacccttcaatgttaaatctacaaacttttataaatgttttaaagaagtccatgtgataattgtaaaggtgatgaatttaccatcaaacaaatcattttgatgtattattatatatgtatatctgtgtaagacacgtgcaacagactgccttatattattttctgtaattcttctcctttgtcaaatggtattttttgtgaatggttgcaaagtgttgtcttattcctaattcctgtatgttatccactacaggttttatgagacttcctattaatttattaaatttattaaatgttg

SEQ ID NO: 4937 - DNA, 44561 bp, human
actggtatgtgtggggctccagccacttagttggaattcaccatgaactgcatctcgaggatcaagtttaggctccccagtccattgtgacatccagcaaagtggagtaagtgcttgcccctcaatggtttttacttttccctacattttctacctactgttagccaggctcccttccctcctcccaatccctcttaacaggccgggcgcccccagcatcccgtctgtctgacgctaaatggcgaggctctccaacccacttagctccaagctcaaccttctgcaaaagttcaaccttctgcaccactggggatatcgtgcagctcaggtgagaggcaaggagcatcgcataaggctagagtcagatgccattaacccccactccacctcccgggctgggatcatcttacgtcccggagcccggcggtcggaaccgccagcacactggagcagcgacggcggcagcaactttgggactggcgagaagccagggcgggggtggtcggcgtccccgggcctctcattacagcgcttaagtactgcgggtggagaaaagtaaacacaggcaagtgcagctgtgcggggaaagggcgggggggtagactattacctccctcccgtcgcccctttgcctctctctctccaagagtcgggagaggtccgggactgccgccgccccgaccgcgcgcccggggccgcaaagtcaaaggagctgaaaaaaggacagggggtgtggggccaggggagaacggaaaggtactgtcctactagcccagagatgttctcctactgaaaggaaaaaaagtgcttactcatagggagactaggtgcgttcgcgacgccctcgctaaggacaagggagggaagcaggcagaaggcaggcaacccaaacctcgtgccttccctcggccacggccccccctctccagagccccagggtcggcttaagccagccaggtcacccgaggcgggcgtgtgggggctggaggagtagcaggctgctggctccgggatttcctgagtccgggcgggagggaagaggggatggcagtagctggagaaggacgacagagggaagttgtgcgctccctttccacttcggggccgcagccgcggaggggaatcagggcaagggctggcgtctaggactccagcccaagactggcaacaagttaagagcaactagtaagaaaacaccacttaatacagtgaagtgcagaaaacgtgtctgcggcggatgctagtagggaaactccccgtcactcacacccatttcggttgcgaccgatcgcccgggcgcccgagggctccaactgaaatttctccgacctccctctcccccaacccccgccccacggtgcgccgcacgttcctgctgagcttaaccgagatgctctccccgggacccactcctgcccacgcccaggaaacccgctcccctagtgcccgccggcgcctacaaagcacttacgtaaagtcgcagagtcctgggtctggcccgactgccgccgaccaacgcactcagacaacttctgcacctcggaatctttgcagctgtggctctaaagccagcgctccctcccctcctgccagccccctccgcccctcggccgccgccattggctcgggtggtgctagcagtcggcctgggaaccaggaaggggattgggccacgagcctgtcacatcaactgggtggggatccaggaaaataggcacggggatgggcacccaggagggatagggactgcaactctgctgcagggagaggagaatggtccccagcgcctgagtctccccttcctacttgggctaagaggaagttagaagtccaacgtgcctggctcggagtacacattcacacaatcttgtgggattaataaacagatgaaaaagttgggaacaagaatttgaatgccacctatataagtctatgggggaggggtacagtttctcccagaatcgtgagaagaataacggcatgttggggaacattcctaattacatctgcaacaatcagtccaggtgccaaagggtgcagagggaaacatcagcaatcattcctttccttaagaagtcaagggagaagaatatgggcagggcagggccctcaagcctttggcctcatgccaagtaaattgttagcccacatcacctgtctggtatgtttgtccatgcggagaggggttgagaggaggtggttggaagtacattggttccactcttttgaccggaaatgggtatcaattctcatcagtctcctttcaccagagaaaatttggagacatgttactactccccagactgccatttcttctccttctctgcccaggagatggcttccacgtcatagctgacctctttcattaatacacgtggaggttatctgcattccaaacctatggttcatcgtatatccaaaatcaactcagagagccagagtttgagggattttgcagggtcaggtcaagagactgacttgtgggatagctgtagaagaaaaagtctaagccctttcctgttccagtcgtaaccattttgttgaggaaatgtgtgcttggaaagttctgtcaacatttaaaattagttcaattaagtcgcattttacatgtaccaggaaaaaatgctgagaggctttaaaatggaatgttcttgaaaaggaacccctatttcatctgccattatgaatttccttagagaaattaatccgtagtgagtgccaaggcttcttaaaagggaagaacttggggagttcatatattgcctaaaggctagactagcagaggacttggcacgaggaaaaagccttgttaaatattaattaatgattaaccaactggaagaacttatgaaaggcacaggaaggtgaaaaagaaatgggagggcaatcatgctttcacaaacattgaatttctgttatgggagattttctactggttcaggtttgggccagcacaaaaatactgatttcaacatgttggcgttggattgaacatggagccagtgcattgccacacacatttacagtaagctcccaaatgagatttctagcattcagtaattggccaaaggtttggtgtgacttctggaattctttacaaaaaatttttagatacaggaaataggctttttcagttttctaccttttatggtgtctgtcggtcaccgctgaagagcttccacctgctcttaaacttaaaattacagactgagcaatagcatgaagggactctgtaagctaaattttccagtgcagatatatttgtctcaattacgttgtattcaattttagtttatttttcaaattctagaatttaaagtaaaaatattaagaatcctacgtatatgctatttacagttcctgtttttaattcaaaaaagcttacattggtccgagtagggtagctcacgcctgtaatccagcactttgggaggctgtgcagtgggaggattgcatgaggccaggagttcaagaccagcctggacaacatagcaagacctcatctctacaaaaaaaattaataaaattttttaaaagcttaatagaatctatactttgataaaagtcttcattcaccactatcactgaggatgtcagaattcagtcaagaaatgtcattttaattgaaatgcaatagtccatagtttcaaagctgcagtgtacctagctgatggcattagttctcattgcctcagtaactttccaacagataaaacacaccctaaacacagaagcacctatttggatgctagctgagattcctgtttaacaagctccactatataatccaggtagaactccattttaatgaatactattaagatacccagccagtttgatgtaactaagctacctttgtgttgcccagaatctaaaggatcttttcaaatttagcattttgctggaagaaaggatcctcaggctcaaagctcttaaacagcatttctttataatttttcatgccatcaatttacctcatagaggatcattcacgaagtaacccaaagttgattgttttcttatctgtatcaaaaagcctgcacagatgtttgtcagggttccctccacctgcttataggctttaatttattttgacagtgacttgcatagtgcctgacacataggagttcagtaaatgtttgctgaaccaatggttattttatgtctattcttgttaaacaacagcaacaaaaagctattaatatatataggattctcacagaccttgtgaatcagtaacctaagagtttttacctttccttccatttccaattttcgatcctaatgcctttgtaataaatcacttaaagtcaatatcacaaaattttgaaaaccatttattcttcctgtcctccgctgatatcataagaaggcgccaatatctctcttaggttttttgtctgtccaaactacttttctttcctccttttgatacgcacatccccctttttcttgctctttttcctattgttctgcccaacactctccccagtctagctcacaatgtattatgtgtacatagtctaaaattttccctgaaattttcctagagtaagttgtcagtttcctcttctatccatttttaattctttattcttaacatgtcattgctggtttgaacttttttttttttccttgagacagagtttcactgttgtcacctcagctgtagtgcaacggcacagtctcagctcattgcaacctctgcctcccgggttcaagcgattctcctgcctcagcctcccaagtagctggtattataggcacctgccaccacacccggccgatttttgttttttcagtagagatggggtttcaccatgttggccaggctcctctcgaactcctgacctcaggtgatccacctgccttggcctcccaaagtgctgggattacagaggtgagccaccgtgcctgaccactggcttgaactttttatccattttttattttattttattttattttattttattttttcttctttttcctcaccccgtctgagataatttttatcattttttttaaaacctcctttctgtagtctattaaaaaatgattttgctgcataaactttatataagccaggaataacttaaagaatcttgatcagttcaatactaaatcatttttctaacacacctaattgttttctcagtctctaaatgtaaaattgtgtactaatctgttttaattaattgtattttattttatcacattattttcaaggaattatccttttttaaatcatctttttaattcatggataattctattccatgttgtgatattttaggttcttggattgatcctaatccctctttttattcagtgtgctgtgagatgacatttttattaaaattaagtatgattttaaaggtttctctcatacttaaaatatttggcatagaggaaatcttggaagacctggacaattattaatttttttttgatccataggatacagatttgaacagttattaccactgtttattagtggagtgtttttatgtttccaactcaaaatgtacacatgtataggacatgaatattaatagtgaataggcaattgtcaaatatttttcaaacctaaagattattatgaatgtgaatgcctgctaatgcaggccaactatcttacacgcacattcacataaagaaattactctgacatgtccaagcttatttcagattttcacttgttaaaaaaaaaattatcagtatctgagaataagaaaattaaaaaataaaaaacaaaaaattaattgaagtctctttaataggattaggacatatttaatcagtatggactttataatatatagatttaacaaagatcactatcatcactggaaatgctcaaaattaaagtgtcaccctcccctctcccgactttctgggtgttaaatatctaattaatcaatcagataactattataagcaacatagaaaaagtatggtctcaaaacacaacgaattaatagtctaatattaattcaagatcaaagtccacataactgtaataatgagaaaacaattcaagatagaatatataagaagcaccgtaggtaggctgaaaagaatgagaataatagggctaaagcagttgtagaaggcatcctttgtgcaatggaacttgagctaggcttgacaaagatgggtaagacttgatataggcaagtagaaatgaaaaccattttcattcctaggaagtgataaaagaaaaacttcagacaaattaaatttaacatagtttaattgagcaatgaacgatggggcagccaccccaaaccagactaggtgcagagagactctggtgctgccacatgttcatagagaatttatggacagaaaaagaaaagtgacatacagaaaatggaagtggggtacagcaatagctggattggttacaccttggcatttgctttatttgaactcaatttgaacaattggctgcttttattggccaaaactcagtaatttttacaagtgagggttacagtgtgtttacacatctgtttaggttacagttcactatgtatggaaatactgttttttttttttggcagggtctcgctctgtcacccaggttggagtgcagtggcacgatcatggctcactgaagcctcaatttcccaggctcaggtgattctcacaccgcaagtctcccaagcagctgggactacaggctcgtgccaccacacccaactaatttttttttgtggtagagacgcggttttgccatgttgtccaggctggacttgaacgcctgggctcaagtgatccacctgcctgggcctcccaaactactgggattagaggcctgagccaccacacccaaccaggctaaacttaatttaacataagaaagcaaaatgggagcgctttaggtaagtttctgagtttgggctttctttccaggcttctacttccttatctgcaaaagaaaaactgaggatttgcctaccacaaaggtgcagtgataacatcaatgggaaggaagattgcttgggatctcactaacgtaatctttttaaaagagaaaatatatttttttaacacttactttagtgattaaaaagacttgtgggctgggctcatgcctgtaatcccagcactttcggaagccgaggtgggtagatcacttgagcccaggaatttgagaccagcctgggcaacatcgcaaaacccagtctctacaaaaaatacaaaaattagctggacatggtcgtggtacatgcctgtagttccagctacttgggaggctgaagttggaggatcacttgaggctgggaggttgaggctgcagtgagctatgatatcaccactgaactccagcccggaaagcagagtaagaccctgttgaaagaaggaaagaaaagaaggaaggaaggaaaggaggaaggaaggaaggaagaaagggagggagggagggagggagggaaagagggaagcaaaaggaagaaaggaaagaaagaaaagaaaagagagaggggaacatcacacaccggggcctgtcctggggttgggggaggagggagggatagcattaggagatatacctaacgtaaatgtagagttaatgggagcagcacaccaacatggcacatgtatagatatgtaacaaacctgcacgttgtgtgcatgtacactagaacttaaagcataataataaaaaaaaaagagagagaaagagagagagagaaagagaaggagagagggagggagagagggaaggagggaaggaaaataaaagaaaagacttgtgaatctttcttgtcttacattaattaaactgccaagttacagaaggtcttgcttttagttacagtaattttgtttgtctggttttttttttaaattttttaatttaattttttttaagacggagtctcgctctgttacccagactggagtgcaatgatgcagtcttggctcactgcaaccttccgactcctgggtgcaagcgactctcgggcctcctgagtagatgggattacaggtgcgccaccacacccgtctaatttttgtattttagtagagactgggtttcaccatgttggccaggctggtctcaaactcctgatatcaagtgatccacccatctcccaaagtgctgggattacaggcatgagccaccgtgcctggccaggttacagtaattttgacagttgctttagttagagccataataatccttccctcaatgagatttacataattaattggcacatatcacattttgcttttaaggaagtattattaataacatgcctgtaacttacacagaatttaaggtaggtgagtgcactagcacgtacaacttgatgttatcattttgtgtgtctgggctataaagcattctttttggtgaaatattcaacctcaacctttattagaatgtaatttgaaatattggaggcttcctatgaaaaaagtcttttaaacatatacaaacaaccctgcagaataaattgtagcgcacattttaaaatttataagggttatccataattctccacagcactagccagacttctaaagaaacagtcatgtccagtctattgcgtttaactgatttctgaatatgtgaggccaaattttggtaaatttatgagtgtctacctgcattatgtgtgtgtgtgtgtgtgtgagagagagagagacagagagaaagagagagaatatgatcagatatttaaatgctataactgtttattctaccaagaatgcttatagttaaatatttgggtctgtgtttactaagtatgcaaaataatgactttaaaaagagattgacagtgtgacaccatggatgaaccttgaaaacattatgctaagtgaaaagaggccagtaacaaaagaccacatattgtatgattccatttatataaaatgtacaaaaagggaaaaatccatagagacagaaagtagattagtggttgcctaggactgggggtatgggcaattggggggaaatgaggagtgactgctagtagggttcctttttggggtaacgaaaatattctaaaatagattgtagtggcggttgcgtaactatatgaataaatttaaaactatcgaattgtacaattttaattggtgatctatatggtatgcgaattagatctgttactttaggcaagttaaaattaacagaatttaactgagcaagaaaaacaaaaacgattcgagaattagccagctcccagaatcagaacagattcagagattctggggctgccccatggtcagaggagatttatggacagaatcaggaaaatgacatacagaaaacagaagcgagtgcagaaacagctgggcctttgccttatttgagcagggtttgaacagctggctgcctgtgagtggttgtttaagtatggcggctgtgattggctgagactcagctattgttatagaagcctactcctaaattaggttttcagtttgtttacctactaagttaggttgcagtttatacttaagaattcgagtgtacaagtacaaagactttctcaggccaaattttagtttgatttaacatatctctatatagctgctattcaaaaagagaaggagattgacagaattaggctattaagcacaaggaaaaccatactaatgaggatatgatatgaaaggatctgtaattgcaaggaagaaactaaactcatgcaatcaaaagggccttgggagataaattcatccacttcttggttagcatgttcccatttttgtcactgtcactgaaagaataacatagtgctttaacttactacaaaagagatgtaaattaaacattacaaaaaaaaaaaatttcaaacaaatcaaatcagccagaaacggaacctaggcagtaaaaggtgatctagtgcttctctgatacttttaaaaaggtttgaatcaccatatgactaaattggtcgaggtatttaaatcatgccacagttttcataaatacttgcggttataaagataattggacatttggtttaagtaaccaagaaattccttaggaagtgtcacagaaggtttcaggataagaagtttcattctgaatcaacacacatctctttggtaattcagaaccaataatgttttcactggtttgtttctttatcaatgccatagattcacctgaacaagggtgaaaatagaatgtaaagttgttcattcagggaggcattccctttcatacactgagcaacattatcatagcttaaatcccatttggtggttggaatagggtaggcctaaaactatgtttaattaaggctttataaaaagttttaaatatttgggagtcctctggaaaggacgccacgtgaaatgcgatcatatgcctaagattatcctaagtcagaagttagcaaactttgcctgtaaagggccagatagtaaatatttttgcatacaagccatacagtgtctgttgcaactactcaactctgatgttgtattatggaagcaaccataaaaattaaataaacaggctgggcgggtggctcacgcctgtaatcccagcactgtgggaggccgaggcggatggatcacctgaggtcaggattttgagaccagcctggccaacatgacgatacccctcctctactaaaaatacaaaaattagcagggcatggtggtgcatgcctgtaatcccagctactcaggaggctgagacaggagaatcgcttgaaccccgtaggcagaggttgcagtgagctgaaatcgtgccattgcactccaccctgggcaacagagcaagactccatctcaaaaataaataaataaacaaacagccgggtatggtggttcatgcctgtattcccagcactttgggaggctgagggaggcggatcacttgaggctgggagttcgaggctggcctggctaacatggtgaaaccccgtctctactacacatacaaaaaattagctgggcctggtggcttgcacctatagtcccagctattctggaggctgtggcacaagaatcatttaaacccaggaggcggaggttgcagtgagccgagattgcagcactgaactccagcctgggcgacagggcaagactctgtctcaaaaacaaatacatataaaataaaaataaaaataaaaaaaattagccagccacggtggcacgttcctgtagtcccagctactcggaaggctgaggcacgagaatcgcttgaacccgggaggcggaggttgccgcgagctgagttcgcgccactgcacaccagcctgggcaacagagccagactccatctcaaaaataaataaattaaaaaataaataaagccgggcacggtggctcatgcctgtaatcccagcactttgggaggccgaggtgggcggatcacgaggtcaggagatgaagatcatccctactaaaaatacaaaaaaattagctgggcatggtggcgcgtgcctgtaatcccagctactcaggaggctgaggcaggagaatcgcttgaactctggaggtggaggttgcagtgagccgagatcacgctactgcactccagcctggtgacagagcaagagtctgtctcaaaaataaataaataaataaataaacaaacgggcatgatggtgtgccaataaaacttaccagaacggacaacaacagtttgggttgtcaggctgtagtctgtcgactcctgtctggattactgttcttgctccaatatgatcttgtcatctggatggagctgtgttctcaaagaggtatttaggagttggtttatgactgatgatatgaaacagattgaaattagcactctttcattattacaatcttaggtcttcacaatctttcataccaagcaactgatgggatggctgtctactctgtcttcttttttgcctttcaaatttgaatgtaatcacaatggccgaatttgcgggtgggagggagtgaagaggaataaaatggcaactactataactactgcttattgagcttcttctaggccttgtactagaaactttatatacatgatctcatttaatgctaataactatctcattaacgaaagcattatttttcccattttcagatgagaaaactaagatttaaggaataagtaacttttgcccaagatcattttgctggtaatgcaggagctgagatgtctgagtgtgtgggatgattccatctcttgtctgactctacagtttgtgattagaaccaaaggattttacaggaagcattcactgtacttttatctaaaaaaataaggcaaaggaacactattattgattgcacctttcttctcacttccttgaaaaaatggttggctcgctggtgataaatctcttagataagcacgtatgttttattacatgctatggtctgaatgtttatgttcccgcaaaattcatatgctgaaacctaattacctagatgacaatattagaagatattgtattagaatatatggtatgagaaaatagcagaagatggtattaaaaggcaggcttaatatatccaattttcgctttttttttttttgagatggagttttgctgtgttgtccaggctagagtgcaatggcacaatctcagctcactgtaacctccgcctcccgggttcaagcgattctcttgcctcagcctcctgagtagctgggattataggcacgcaccaccacgtctggctaatttttgtatttttggtagagatggggtttcaccatgttgcgcaggctggtcttgaaatcctgacctcaggtgatccacccacgtcggcctctcaaagtgttggaattacaggcatgagccaccgtgcctggactaatgatttttgtacttttagcagagacagggtttcaccatgtctcccaggctgatctcaaactcctggcctcaagtgatctgcctgcctcagcctcccaaagtgctgggattacagatgtgagccaccatgatcggccaatttatccagttttttttttttttagaaaatacatgattatagcccaacttattctacctgataaactctgaattatgggtcacataaaccattttagaggggtagttttaaaccaattaaatttattctaaatttaatgtgttataaaaagaaaaacactcaaagcatacggctggcatttcattcaattttacttaatttagggtcttttgaagcatcaaattttaaaagtaaaataatttgataattaaaaccatgggatatttgtattagaaggaatattatagaccacttccctcacagtacagatgagtaaaactgagccctgcaacagcaaaatgacttgccctaatcttttgctttttcaagtccttttataaagttactttaacaggtggccttttgaggattataattttctttttatatatttcctttttaaatgtggctttgcaaatatactacataatgatgcacttcagagacatttccataacggatgtcatgtagtagggtggagtccctttcagctgtcagtgttctatagaagtgacgtcaacagtagggtactggctcagtagggtataagtgtgtttcaaagtcttgcacctacgcagaagtatagggccagtactggactgaccaaggtcaggaaccttgtcaaccaaaggaaatgaaaaatccaagccttaaggatctaatccaagataaggggttgatgaggaagcaaggtaaggcatagaaaatctgaatagcacctcagtggagagatgatttgttagttttgagacagtaccccagacagatcacagaatgcaaagattctttatttgagctgctccttgaacctgctgtctaattaataactctgattgtaagagacatgaaagtcactctattattccttgggaggctggagtaaattattcacatcattaggaacaattcaatgtctgcaaagaggtcccttgtcaggtaattctgccacacaatggaaaggcttcatttgctttgcttccttaagtctcctttctcccttacctgatctttgagtatatacgatctttttgttctgttaaaggaacagatcctttcttttctcttcatcaaagctgataaataaattgcagctttttaataacctttccaatttcttttttaccttcatcaaagcaggtactgctcattaaaatggcataatcgctcaggattagtgtgaatttcagcttttacagaagagaaatcccacaaaggagagaagcataggtaacagattgcaaagggttggcaatacttcccttaaatctgaatgtaaataccagcctctcctagctcccagcaacgtatacttatgtattggagctccccagatgcacagaatggatgtgcaagatgagaaccagttgtcaaggattctttcttcttttgaatttctcttgcaatatttaaaatagtaatatgtatctttttttttttaccggaaatgattcagaacattaaggtctttcctgtgccttgttttccattttgaattaaatatattatttttaaaaaatgaatcaataccttcattaacatttatatcaacccattttttttttttttttttttttttttttttttttttgtggaggaaggaaaaggctctgaagatttggaacagctcagcttccaaagtgcaggtcagaaaattgggctaattgaatgcttatcagtagtactgtaattttttccagatgccttatagcattttataaataattagaaataagagtttcatttctaaaagggaaactgatacataatttataatgtgtatgaaagcgtaaagtattatataaattcaagaaatacacagatttttaattatttaaaaattatataaaatgaaagtgctatgctcatagctaatttttatattttcacttattcctattataaaccatcaaattaattgtaatgctttggtactccatggaaagtatttgcttaaacagtaacatctacaaacttaaaaccaatatcttaaatctcattgcaaggtacagttcttttccaggatccctaaaataggtaatttcaatgattgccctgaaggctttatagaaataccaggaggccagtaggtggctcacgcctgtaatcccaacactttgggaggtgaagggggaagattgcttgaagcctggcgtttaaaaccagcctgtgcaggaaaatgagacccctgtctctacaaaaaattttaaaaattagcagggcatggtggtgcacacctgtagtcccagctactcaggaggctgagtcaggaggatccctcaagcctagaagttggaggctacagtgagctgtcatagagccactgcactccagcctgggtgacagagcaagactcttttctttctttctctttctttctttctttcttcttctccttccttccctccctcccaccctcctttctttctttcttttttcttcttttcttgctttctttctctttctttctttcttctctctcttccttcatccctctttccctccctcccttccttccgttcgtccttccttccttccttttttttttttttttagacagagtctcgctctgcgtctcaggctggagtgcagtggtgtgatcttgactcactgccacctctgcctcctggcttcaagtgattctcgtgcctcagcttccccagtagccaggattacaggcttgtaccaccatacctggctaattttttgtatttttagtagagacagggtttcaccatgttggccaggctggtcttgaactcctggccttcagtgatccacccacctcagctttccaaagtgttaggattacaggcgtgagctaccatgcccagcctgagactcctacttaaaaaaaagaaaagaaatatcgtgaaatcactgttggtttgtactgcttaaaaattcaatcttaattgcaaaacacttccttttattttgtaacactactcaacacatttatagatcatttaacaagatttaattttataggtaatgagttttcaaggtatatgcagattttggcaatgttttctggaataagaaaacatggaactctccaaacacaatatagttatgattcaacatgaaagctgtcgtttttatttcgtactcttctgcatatttgcttcagacagctgttctcttatcattggttgggtcctggtatattgtctggaaagcaaggtgataaatattcatgacttatgatgttttaaagtaattgcaagtaaaaaatgattgcattgataattgattttaattcctttttgttttgttttgtttttccccctccacattatggggtcataagtttttaaaaacttaagttattattgtacctattccaggatcttctcagaaaggcaggaaaaagggaattatttctttttctaaaatcaaatgcaaatgatcagatattgaaacattaacatgcaaattagtgaaacattccacagattttctgcagctgctcctcaccccctccctcaactcccacattcccttatatattctagccacaccagatatttcattatttcccaaatttgcctgtatacctatataatccagcttgggagagtggaattgaaaacgtgtgtttaggagagagtcagaatttggtttaaatctgtgtttatctcttactatctctgtagctttggaaaagtcacttcatctctgtgtgccttggtatcttcatgggaaaattcagacaattggcacctcaacatagtgctaggtatatagcacatgctcaataaattgttattgagtgaaggataaaatataacatataaaccacctaatacagtgcctggcacatactactggtaaacagtaactcatgatttaccctctgttcctctctgaggcctgctctcacattcctttttaatctagcagatacctaactatccttcaagtcccacatcaaatggcatatccttggaaatgatttctctaacccttccaggcaaagctaatgcttctaggtctgcattctcataacatcttttttccccccatccaggacctgttgtgcccctcaaggaaagagaggccaccataaggccaatctgagttcccaaagagtaagggaggagaccacccctcatattgtcttatgcccaatttctgcctccaaaaaaagaaaaagtaaaaactaaaaggcagaaatgaaatccacaagtagacagcccggtgccataccctgggcctggtagttaaagatcgaccctgacctaatcgcttgtgttatctatagattacagacattgtatagaaaagcactgtgaaaatccctgtcctgttttgttccgatctaattatcggtgcatgcagtccccagtcacgtaccccctgcttgctcaatcaatcatgaacttctcgcgcagccccttagagttgtgagcccttaaaagggacaggaattgctcacttggggtgctctgctcttgagacaggagtcttgcggatgcccccggccgaataaaccccttccttttttaactgggtgtctgaggagttttgtctgcggctcgtcctgctatatgtcttggttccctgaccgggaagcgaggttattggtggatggccgaggcagctccttaggcggtttaagcctgccctgtggaacatccctgctggagactccgaccagcccgagcgacccggatcctgagagcgctcccgggtaggcatttgccccggtgggatgcctcaccagagcagtgtgtggcaggcccccatggaggatcaatgcagtggctgaacaccaggaaggaacaggcacttggagtctggacatctaaaacttggtaagactagtctttgaaacttgcccactccatttgagtggaagcgtggcctgatcacccacggcgtgcctttatcggcactttgattttggttttggttttgacttggtttgaattgcttgacaggattggtcttgggaacttgcctactccatttgagtggaagcatggcctgatcacccacggtgtgcctataccggcatttcggtttttgtttttgacttgacttggattgcatgatactttggttctggttttgacctggcttggatttctggatactctgattttggttttggttttgacttggtttgaattgcttgacaggattggtcttgggaacttgcctactccatttaagtggaagcatggcctgatcacccacggtgtgcctataccggcatttcggtttttgtttttgacttgacttggattgcatgatactttggttctggttttgacctggcttggatttctggatactctgattttggttttgattttggtttggtgcaaactgcaaaagtgtgtgtgtgctcttttttacccgttctttgttttgtggtgtgcatgtggtgtgagcatggtgttttgtctcgaagaagcataggtcaggcacaaataagcccaccctactaggaactatgttgaaaaatttcaaaaaagaatttaaaggagactatggagtactatgacactaggaaaacttaaaactttgtgtaagatagactggccagcattagaggtaggttggccattagaaggaagcctggacaggtcccttgtttcaaaggtatggcacaaggtaacctgtaagccagggaacccagaccagttcccatacatagacacttggttacagatggttttagaccccctacccccaacacacagtggttgagagaacagcagcataagcggctggcaaaggcaaggaaagaccagcagagagagagagagaaaggaaagacacagagaggaaaagaggcaaagagagagaggaagagacagagcggaagagacaaagagggagtcaaggagagagagagagagaaaaagaaagagagaggcagagagagagaagaagagacagaggcaaaaggaaagtcaaagagagagacaaagtcaaagagagaaagagagatattcaagtagttaaaaaaaagtgtaccctattcctttaaaagacaaggtaaatttaatacctataattgataattgaaggtattctccgtaaccctataacactccaataccactttcttgtcagtgtaaacaagggcgtatcccaaaaacactgaggccttcctatcaaaaatctttaacccagtaacccgtggatggcccaaatgcattcaatctgtagcagcaactgctttgctaacaacaaaaaaaggtaaaaaaataacttttagaggaaacctcattgtgaacacacctcaccagttcagaagtatcctgaagaaaagaaaggggggaaaaagggggggtggaatttatataaaaagagtattatatggtaaattcttgtcctgaaataaactggttgtttaaagaaagaaatatttgtaataagtcacaaagctaaggcatgttgaagaattgtctgcaaaagtcatgaaagagaaaaatgttataaaaaagaattttggaaaaaatgttgtataatttaaaagtaactaggcatcctgaatgtaaaactattgaaaaaaaaagtttatgtgcaaggtgtataagaaaagtaaaatatacctttggtaaaaggattataaggtggcataagaatgtacatttttacctacattaaaaagttagaaaaaattattgctttgaaggtttaagcaagttttaaaacgttaattgtaaaggaaattctgtgtgtaaacatattagctaaagttaaagaagtatcatccagtttttctgtgaactggacattaaagtaaaagcataacaggtttttcttaaagcaccaacttgctctttagcaaaaattttaaaaggttaaaaaaagtctataaaatcttaccttatggtcaaacattaaaaattagataaatatgtctacaaggttttattaaaattaagtttaacattaataacacagtaatatgaagataaaatttagcttatctggtataaaaatcatacaagaagcattgttaaatgtaaaatggtatttggctttctttagtttaaaaactaagaaaaataggtgctaaaggaaatttctcagtaaaaaagcactaaggactataaactccactgccaaggttcccatatttaaaacaagaggtcaatttctttttttttttgagacggagtctcactctgtctcccaggctggagtgcagtggcgcaatctcggctcactgcaagccctgcctcccgggttcacgccattctcctgcctcaacctcccaagtagctgggactgctggcgcccgccaccacgcccggctaatttttaaaaatatttttagtagagacagggtttcaccgtgttagccaggatggtctcgatctcccgcaaaaggtcaatttcttaaatattatgtacttgatttatcttccactttactttctctcaaaaactaaaagtcttttagcacatgtaccacccctagaatttccaataaaccagcaccagcctcaagatcacgttctcatcaaagggtggaaagaagaaacacttgagccagcctgggaaggaccccaccttgtgctgctaaccaccaagagtgctgttcgtacagcaaaaaaaaaaaaaaaaaagatagactcatcacacccgagtcaagaaagcgccaccccctccagaatcgtgggccatagtcccaggggaaaaccctaccaaactaaagctaagaaaaatttaagtcttttaatctattctattactctttctcctttccttattctattgctgaccatctagttgttaacataaccaagtcaatttcacctcgaactattgcatttaatgcttgccttgttataccctgtggggacttgccaagtcaaagacagctttctactttagaaaagtacttctgtccctcctgactctcctcagactgggcattagtaaactaggaccatttaacccggggagatttcgataaagaccccagttccaaccaggagtcttgccccccaatgtacagctttcatgccatagttggtccaatgttctgtggaccactaaagagcaaggatagactgccccaaccagtttttgtaatttcctaaaaccatacattcattttactagaggatcatagaagttaaagacaaaacaaactttagcaattaagacaggataccaagatgcaaatgcctggttaaaatggatcaaatattccatccgcatgttaaacaaaagcagttgttatgcttgtgcacatggcaggccagaggcccagcttgtcctctttccactaaggtggtcctccagtcgaccaggtataggctgcatggtagctcttttccaggattctacagcctggagtaataagtcgtgccaagctctctctgctatatcccaaagttcggcaccctgtgggtcagccccctagggccatgcagcctccgtctcccaacactaagctcacttcgtgtctctcacgacagggaggaagcttagcattccttggagacctgaagggatgcagtgagcttaagaattttcaagagtggacctttactgggcactctgccaaataactggagtggcacttgtactttagtccaattggctatccctttcaccctggcatttcatcaaccagaaggaaaaaaataagacatcgtaaagcgagagaaggcccttataggtctttcaactctcacgtctatttagacgtaattggagtcccacgaagaataccagatcaatttaaagcttgaaatcaaatagctgcaggatttgagtcagtattttggtaggtgacagttaataaaaatgtagattagataaactacatctattacaaccaacagcaacaagctttcatgagttaaaagaaaaactcatgtcggccctagccctgaggctacctgacctgacaaaaccctttacactctgtgtgtcagaaagagaaaaaatggcagctggagttttaacccagactgtggggccctggccaaggccagtggcctatctctcaaaacaactagacggggtttccgaaggctggcccccatgtctaagggccctagcagcaatggtcctgttagcacaagaagcagataaactaacccttgggcaaaacctgaatataaaggccccccatgctgtggtaactttaatgactaccaaaggacatcattggttaacaaatgctagattaaccaagtaccaaagcttgctatgtgaaaatcccctcataaccattgaagtttgcaacaccctaaaccccaccatcttgctcccggtatcagagagcccagttgaacatcactgtgtagaggtgttaggcttagtttattctagcaggctcaacttccgagaccatccttaaacatcagtagactgtgagcagtacatggacgggagcagattcgccaacccctgcaaagtgactctgaagaagacgacaagccctgctccagtcacacccggaggctgactggtccacgcatggccgaagcatgagaaaactcagcacaggactcattttccttaaaatttggacttgtaccatgaggacttcaactgaccttcctcagtctgaggactgttcccagtgtacacatcaagtcactgaggtaggacaaaaggttgttatggtcctattattttatggttattataagtgtactggaactctaaaaagaacttgtttgtataacgttactctatataaggtatgtagctcaggaaatgaccaaccggatgtgtgttatgacccatctgagcctcccatgaccacagtttttaaaacaagattatggactgaggactggtgagggctcataaatgatacaagtaaagtgttagccaaaaaagaagaaaaagaggtgcccaaacaagtcaccttaaaatttgatgcctgtgctgtcattaataataatgagttaggaaaaaggtgtggttttcttaattagaaaagaggctatacggcagaaaataagtgcctctgtcataaattaggactgtgtggaaataaatgtaaatactgatcttgtgtcatttaggccacttggataaaaaaaaatgaaaaggatccagtccactttagagaggaaaaaaatggcccttcctgcactaagggacaatgtaaccccttagaggtagtaacaaccaatccccttgatccttgctagaaaaaagaggagtgtgtgaccttaggaatcgacgggaccggactggatcctcgagtaaatatcttagtttgaggagaagtttacaaacgctctcctgagccagtgtttcaaactttctatgatgaactaatgtgccagtaccggaaaaacaagaaatttgtttttgcaattagccgagcatgtagcccagtctctcaatgtcacttcatgttatgtatgtggaggaactgtaataggagatcaatggccatgggaagccctagaattagtacctatggacccagttcctgatgaattcccggctcaaaagaatcaccccgataatttctagctcctaaaagcctcaattattagacaatattgcatagctagagaaggaaaagaattcactcaccccgtaagacgacttagttgtctaggacagaaactgtataatggtaccacaaaaacagtcacttcgtggagttcaaatcacacagagagaaatccatttagtaaattcccaaagttgcaaaccgtgtggacccacccggagtcccaccgggactggacagcccccactagattatactggatatgtaggcatagagcttacgtcaaattacctgaccagtaggcaggtagtagtgttattggcattattaaaccatctttcgtcctactgcccataaaaacagacgaactcctgggcttcgctgtctatgcttcccgtgaaaagagaagcatagctataggaaatttaaaaaaatgataaatggccccctgagaaaatcatacaatattataggcctgctacttaggcacaagacagcttgtagggataccagacccccatttacatgatcaaccgaatcatacagttacaagctgtcttaaaaataatcactaataaaaccagcaaagccttgactattctggcctggcaagaaactcagatgagaaatgctatctatcaaaatagattagctctcaactacttgctagcagctgaaggagcggtctgcaggaaatttaaccttactaattgctgcctacacatagataatcaagggcaagtagttgaagacacagttaaagatatgacaaaactggcacatgtgcccgtgcaagtgtggcatggatttgatcctggggccatgttttcaaaatggttcccagcgctaggagaatttaaaactcttataataagagttataatagtaataggaacctgcttactgctcccttgtttgctacctgtacttcttcaaatggtaaaaagcttcatcgctaccttagttcaccaaaatgcttcagcaaaagtgtactatatgaatcactatcaatctgtcttgcaagaagacataggtagtaaaaatgaaagtgagaactcccactattgagtgagagtctcaaagtgggtgaataagggaggagaccacccctcatattgtcttatgcccaatttctgcctccaaaaaaagaaaaagtaaaaactaaaaggtagaaatgaaatccacaagcagacagcccggcgccacaccctgggcctggtagttaaagatcgacccctgacctaattggttatgttatgtatagattacagacattgtatagaaaagcactgcgaaaatccctatcctgttttgttccgatctaattaccagtgcatgcagcccccagtcacgtaccccctgcttgctcaatcgatcacgaccctctcatgtgcacccctttagagttgtaagcccttaaaagggacaggaattgctcactcagggagctctgctcttgagacaggagtcttgcggatgcccccggccgaataaaccccttccttttttaactcggtgtctgaggagttttgtctgcagctcgtcctgctacaagagatctctctctccccattaagaaagttgcacaggtgaggccaaacataactgtagagagctaagagtctcatgacatttttttttttaagagacagtgtagcccaggctggagtgcagtggcacgatcacagctcactgcagtcttgacctcctgggatcaagccatcctctttccttggcctcacaaagtggtggcttgagacactgctcagctcagtctcataacatcttatacctagctttcatagcattttgttgccattgccattgttgatatgtctatttccccaactagactataataacctccttaagggcagtgaccctatcatattggtctttgtatctgtggtttctaagtcccaggtatacaatagagcaaataaatgtttgatgaaagatgaagagactgagttgtctgccagagtttttaccagtatgtaggacttgactatactttgtaattcacatatctatcttccccactagaccatgaagtctttatccatttttcttttgtttttaggcaaggtatcgctctgtcacccaggctggagtgcactggctcaatcacagctcactgcagccttgacctcttgggctcaagcgatcctcccaccttagcctcctgagtaactgggactacaggcgtgcaccacacaccgactaatttttttttttttttttttttggtagagacaaggtctcaccatattgaccaggctggtctccaactcctgggctcaagtgatccttataccactgcctcccaaagtgctgggattatgggtatgagccactgtgccctgttagaccatgaaatctttaaggaaaggccctctttctatgtatctccaggaccgacacaatgcctggctcaaaaaatgtctacagaattgataatagagaaaaatctgtctttcgggctctttcacccattctcttctgttatttgagtaaccctcctccccacacttcacaagatccttacaatacctgcctttccatgtgtgctgttagtctctcctttcttttgctaacttccaaaggataggtttaaataaaatagactcatctttgctaaagtgttcttagctaactctttgctagttctttcattcattgccttaatccagctacaatatacattgtatatagtggctacccagttgtcagctggcatatctagtcctgggcagagatttgatcagttagatatagtgcatcaacctatgaaatctctcaattttgaacctatccttttaatatggagaatgaaattcaccaaatctaatttccccctttcagtttgggaatgctcaagtcatgacctcccatggacctgggagaaaaccttggctctgccttcctcccagattccctgaagcgacccccagtttgtttttgtttgcctagcaaccaagaaggggccatttgccatactgattttaatatgaagacatttgggttctagttgggtattcagctggaacatagtgtactggaattatctatgtcccgtgatctctctatcaagcattaccaatacaaaattaatatggaggcctgactaagattctttagtattttctcatacaaagttggtctctggtagggtggatgaagtaatccagcatgtgtcatattccttttcagtcttttcattatcaaaattaacccctatccaatcatctaacctttaaggaagaaattacattactcatatgattgcaattttaaattcatgcaggaaagcctttcctatatatttttaaaaaacactcaaatattaatggtgttagttatgttgatcagttggtataccagtttgtacaaggagaaatgttttgggctaagagttctaaattagaatatagttagactaaggattgttagtaaaattttccttttactttaccctgatacttggtttaactcccttcagacatctgttcctagagactgttgtcttttctccatatccccctcttccaattagagagacagataagcagttgtcttgagaatataaggtcactggcattccataaatggattccagtgcctgctacagaaataagtggtgagtgttctctgtcacttgcaaactataaattaattaagttgacaacttttccttctttatgttatgttttcagagggacttttgaagtaccttttattgcattttctgattattagagtaacatatggtcattgtagagaattgatagcacagataatcactaaaagaagaataaaaaccttaacacccatagataacagctgttagcattttgatttatttatttacagcttttttatatgcatgtaaaaatgttttaaaagaaaattgggatcatattatatataaatgccatatcttgcttttcaaagcatccttgtatctgaaacattttaagcaccattaagtgcttgaaaaaaccattttaaattgctatataacattgtcatgtggatataccatggattgtttctttaatcattcttttatcatctttagattgattccaatttttccatcttaaaaataattatgggccgggcacggtggctcatgcctgtaatcccagcagtttgggaggctgaagtgggtggatcacctgaggtcaggagttcaagaccagcctggccaacatgatggaacatggtgaaaccctgtctctactaaaaatacaaaaaattagttgggcatgatggtaggcgcctgtaatcccagctactcgggaggctgaggcagcagaattgctagaacctgggaggcagaggttgcagtgagccaagatcgtgccattgcactccagcctgggcgacagagtgagactcaagtctcaaataataataataataataataataattttgttcttagtcctttttctaaatttccgattagactagagtcttaggaatttactgagactaagtgtgtgattttttttttttttcaaaaaacattcatagtaagaattcttaaattgttttaaagaaagtttgaggcttggcttactggttcatacctgttatcttagcactagggggctgaggcagggaggatccacttgagcccaggagtttgagaccaggctgggcaaaaaagtgagtcctccaactctacaaaaataaataaataaataaataaataaataaataaataaataaataaaaaataaattagctggacatggtggcctgttgtagtcccagccactcaggaggctgagatgggagaatcccttgagcctcggaggttgaggctgcagtgagctgtgattgtgccactgcactccagcctgggcaacagaccctgtttcaaaacaaaacaaaacaaaacaaaaaaaaactttacaccaatttgtccatctattatactagcagtgtttgtgagtacctatccattttactgaaatttctctcaatcccttaaacgttcttaatttgactgacaaaaatggtatatatcactggtgttttaaaacgctgaatgttaaaaaatatgtataccataaagttcttaaactttcccatatgtatttatctctgttcttgttctttatccatgttcccttttgactttcgtgagcttttttatatttcaaatctatcaacccttcttaatgtttgttgcaaatattttcccagtttgtggcttgtgttttaggttttcttgtttagtaatggtttttgagcttcaactttttccatttttgtgtattctaaatctattgattttccacatgtgatttgttccattgcttatgtgcttaaaaattccattgttttcagtagagtttttggttggttttacttagccagacttataattttgaaggcaatggatttgttccacacaactgtaaatatagctgtaattgtactttgttcattttaaatattttataggcagatttggatgtgctagctataaaagtaggagcagctgtaattccttttaaacagggccgtgtgtggaaagagcaactcttaagaagtcttttgaaaaaatacttgaaatgttgacattttattgcagtgaacagcattccacattattcatttcacattgtgtaagagccctataactcaaggcaacacaacactcaaattgaataataccccagcattttcactttcagaattatttgactggagctttgtttcaaactagctaaaatagcatttctcaaagggtggtctttggactccctgcatcagaatcacatggatacttgttaaaatggagattcttgagtccctcctccagacatactaaatcagatccctcagggttgaggtccctgaatccacattttaacaagtatcccaggtgatttgggtgccctctaaaatttgagaatttctaggtgaaagagaaacacccatggaggcaaaggacaaaacacaaacatgtgaggacttgagttcaaagatagatctgggccaggtgcgttggctcacacctgtaatcccagcactttgggaggccaaggcaggaagattgcttgagcctgggaagtcgaggctttgagctctgatctcaccactgcactccagcctgggcgacagagtgagaccctgtctcagaaaagaaacaacaaaaaacaaaagaaaacaaaaaacagtgtatcagttaataggaaaaggaatagtcagaatacaacagggcttaagtctaagagtactggtctattaatcggaaaaaggagctctgctaacctcgtgtctgagaacgactcacaatccttcaagttccttatccttcaaacgaggataaggaactcatttgtaattgtggtggctttcacctgtaattgtgatgtctctcaccggtaatggcagccctttgggaggctgaggtgggtggatcacttgagcctgggagttggagaccagtctgggcaacatagggagaacccatctctaccaaaaattttaaaaattagccaggcatggtggtgtgcctgggacctgtggtcccagctactcaggaggctgaggtgggaggatcacttgagctctggaggtggagtgatggccactgcactccaacctgggcaagagaatgagaccctgtttcgaaaaaagaaaagaaaaaagaaaatacatgtaccaggagtttctttttgtaaggtctaattctgtgccaaggaatcatatagtgtttttcttaatttgggaaaagaatcctctgtaataagccatttctgtggacctcaatgctctgtattgcaaattaagactttctagaattcagattttatttttagactgtgatcattaactttttcttttacgtatctgattaggcttaatgagttagctacgttcatgacgtgtaaggtcccaacaacaatttaaaaaaagatatacatgcacccaagtatacatgattgtaaggtccaggtaaaagaacaaatttaacagtgcttcatcagttttattattgttaataatagaattggaggaagtgctagtagtggtcagcatctggaaggagtggcaccaggaaccagtgagtcagtgttgacaagtgtagagtttaaggccaagtaatacagcccctgaaatgagttgaagtagcgggagggagaagggagggagaaagcaggaaatcagttgaagagctgttaaagtcagaaggagcacaagttattgacaggatctacatcaaaagtggaacaaaatgtctcagtctgagtgatgtgatgtgatgtgatgtgatgtgatgtgatgtgatgtgatgtgaactgagtgatatgaatagccaccaagttgctttgcctttcccctcccccatttagagtctggattgggttggcgcatgaagtgagggcacacctgtaagaggtgactacataaaactagttcctagaattagggaattgagggatatgggggttgagaggtggtggagggagtcaaggcatgtatttttctgttgtcacaccttcaggaaaggggaaatatgctttctgagcaatgtaatttcccttctgacctccattctctttaggatttcagttgcctttatttattacaaaattactatattccagtgtcatcaaatctcagagagtaacaaagaaactatatagcagtaaatatagagatgcatagttatttgaacccttctgaggcaagctccattcattaagtggaatagatgtgggattcaagtctgtcaggaaccccttaaattatttctgagttggaattctttctcaatttcccactatgtgtgtgatcttgaatatgatgtatatgagccacatttttgaaatctggaaaatggagataaacatttttatttaaatagatatttgaagattaaataagattaaataagatataataaataagttactatttattattaacttcaaataaatagttatttgaagattaaataagatataatagaaaaagaacctggtacaatgactggtacatagtaaggaccagtatcgtttttaaattgattgatcaaatttcaataagtcttatccgattttccagtatagtgcctaaactcattactttagccttattctgtggggtcttcaattcttcctcactagttttagcattttttgcttgtctcatcatctatctcttcattctctttgtctttcatgttttctccttccctcccacctgtatttttaaggaagagcattgcctttgatctggaatgtactctggattcaaaattatgtccttagcctcttgaatactgaatatattctcctggtcttctactcagcggaatctctaaactagcctccaacttttctcacttggccccttcctcatttttcttactatgcactgttcttcccatggttgtatccaaggtttttttcacatcacttttccccattccagagtaacatttctagccctccagtgtttgtcatcctctctggccacattcaagtcatcctccagatatgcaaaaatacactgacctaaaatccaactaatgatggataaaagacctgctttaagactctggaatacactgcacttagagttaacactcacttcttaccactattatttaattttatttaatataattaaacctctctatctacccataggggaccaagaagtttaggttttgtctatggggaaaatgctaaaacctttctcctccttctctctgagtccaagtagtcctggataacagaaatctaaagtcttttatttcaagttaataaaaggaaagaagttctttttggagatatttgcttggaagccccacacatctgggtatgcctctgatcattgtacacacacacacacacacacacacacacacaaatatatatatataaacagttcacacattcattcattcaacaaatctatctatctatctatatatctacctatctatctatctatccatttttgagacacggtcatgctctgtcgttcaggctggagtgcagtggcatcaatcatggctcactgcagcctccaactcctgagctcaaaccatcctctcacctcagccacccaagtagctgggactacaggtgcaggctaccacgcccagctactttttatttatttatttatttatttatttatttatttattttggagacagagtctcactgtgttgcccaggctggtctcaaattcccgacttggcctccccaaatgctggtattacaggcatcagccactgcgcctggccaaattcaacaaatatttatcgaaaacctatgacacttcccctacaaaaaaagacaaaacaaaacaaaaacaaaagctatgatgtgatgtgactgggcatggtgtctcacccctgtaatcctagcactttggaaggtcgaagcggcaggatggcttcaacccaggagttcgagaccagactgagcaagagagggagactgtctgtattaacaacaaacaaacaaacaaaaaactaaactaaaagaaactgtggtgtataatataaaattctggctgagcagattaagatgagcaaactacatggttgaataggggagatgaaccatgcacacaactataatacacagcaagaaggaataaacgacacatggtggtacaaatgaaatagaatatgtctttacagaagagagagatttctccaggctgaaaccttatgtaattaatttccttcagtgactgaccaaataatatgtcggtttcatgaagcaagcctcagctaccagatgttaaaatatttcaactctacagcagcagctagacaacatccaaaaaaaatttaaactcaacataaggaagaaatgaaattcaattgtttcaacaatgagcatagtgtaattggatgagggccgcctgttggcatcaaaaggtcctgacaattgcagcgatccatttgtaaagccttctttcttttcctcaggttgtggaaataaaacagtcctcaagagtaaagtggagaatttccaattttgtcctttaataaatgagttgttggcattgtatagaatgaaaataatgatacgtctttttccaccaaagcataatgacccttgtggcctttctctccactctgtaccctgtactttagatggtaagcagcaatttgagtggcaacattgaaaaagatgttaaccctctgttgctcagcaagtactaagcagatacagagcctacattgtgctcactgcgccaggactaatagcaaagtggtgttcctgaatttttccccttcctccaagctcactgaaacataaagtctggcattaataaataaatacaacattctgattgagaaggtagtgcatccacggataactggaaaacttacaatcctagaactttgtcttacattgatgttgacatcgtataggaacttagaatctaatttctgtaaataaattttgcaaaacgtttacgaaaatcatggaacagttaggtttcaaaaattttttttacagtcagggaagaaagagtttcccccgcccccacccctgcacacagcggtgtaaaaatgctttgttttttaaaggacgttaaattataaaacccagctctgaattttaaatgccacagacgtgagggtataacaccttattaggttgccagatttagcaaataaaattacagtatgcccagttaaatctgaatttgagataaacaacaaataattttttttagtataagtatgcctcatgccatatctagcaaccttaaccttagaaaaccatgcttgattatgtaatattccagctgactggttaatttttaggaggcaggtttgctttttattccctgggttttcatcttttcccattcctgcatgtctcctcagcatatgagatttttttgaatgaatggaaagatcttctgtgaagaagaccattcagttcataaatgaattattttaaagccctgaacccctctgcaaaaaaaaaaaaagtgaacaaaaagcccctttttggtcctctttttgtgctgttacaattgctcttcacttgttgatctgggtttaatcattcagataagtgcttcaactttaagtgcctcaattttctgctgttctgaatatgaaggctcagtataaatgggtgggggagggagggagtctatggcactgagtcacatcaatttgaaaaataagtatgtagacctcatgtggacttttcctgtaattaaagactctcacttcccaaaatatataaatcagatgctttacctgttctgatcatttcaatgaacattcaattcatgcgtccatcagagggttcacaaatgcacgaaaagttcataattcaggctgggcatcatggctcatgcctgtaatcccagcactttgggaggctgaggtgggaggatcgcttgagaccaggaattcaagactggcctgggcaacagagtgagacctcgtttcaacaacaaaaaaaatacatcttcttcacactttttttttccagacatggtcttgctctgttgcccaggctggagtgcagtggcatgatcatagcttactgcagcctcaaattcctgggctcaagtgatcctcccacctcagcctccagcatagctgagactacagacacatgccaccacacccaggtatgcaaccaaaacttgtaggaaatattactgatttttagtatttgctttattgtgtcataagaaaacctttttacaaaacttgagacatcttcctattaaggttataattccattatggcagacatatgtgatgttgaaatcacttttaaaatcattatattttaaaaattattgcttttgaaacatttcttgtactttcttcaacttttttattaaaaatatgatttttacaccctcttcttttgaagtcatttgcagaaggacatgcaacaataagtgcctgaactgtctctagaaatgcataagaactctatttaggccaggtgcggtggctcacacctataatcccaggactttgtgaggctaaagcaggaggattgcttgaggccaggagttcaagacaagcctaggcaatatattaagactttgtttctacaaaaatgaaataaaataaaaggcatgatgatgcacgcctgtggtgtcagctacttgggaggcaaggtgggaggctaaggtgggaggatcacttgagcccagcaggtcaaggttgtggtgagcagtgattgcaccattgcccttcaccttgggcaacagaggaagaccctgtctcataaaaagaactctatttaggctctttcatatataacatctgccctctcaggaatctttttaatggaaaaacattgatgtccttctgtttatgatgattatttcatcttttgtttaaccttcaaaaacctacaaaagttttaaaagatgtcatgtctagtatctcaggatactagaaattgaaagaaactttctcaatttggccaaagttgtccatgaaatctttgtagcctatatcacattaatggtttaaaaaagtgaatgcttttcgatagaaaagaggacatgaaatgttaccaactcatagaaatgataaatactcaaggtgatggatacctcacgtaccctgacttgatcattacacattttatgcatgtaagaagcactcacaatttccccataaatatgtcaaatattatgtatcaataaaggggaaaaaagtgaaagggttgctcttaagatcaggaacaagatgaggaggtttgctctcaccaattctattcgacatcatactagaagttctactcagtgtaataaggcaagaaataaaaggcatccagactggaaggaaagcagttaaggctctccttattcacacataacatgatcttctacagagaagaatctacaaaaaaatctaccagatataataagtctgtcgtccagtctggagtgcagtggtgctatcttggcttactgcaacctctgcctcctgggttcaagcgactctcttgtctcagcctcctgagtaactgggactacaggcgtaccccaccacacccagctaatttttgtatttttagtagagacggagtttcaccatgttgtccaggctggtcttgaactcctggcttcaagtgatccacccacctcggcctctgaaagtgctgggattccaggcatgagccaccacgcccagccacttctgttatcattttaaaagcaagaaagttccattaaacagaaatctttatatactttttttttttcagccttgctgagaatgaactcccgtatggttggtatgcatggagatgtactgcctgattaatttatcttatacttttgggcgcaaccaattaaaacttgtggcagtctcttattttttctttctttctttcttttttttttttttttttttttttgataaagacagggtgttgccatgttgcccaggctgaactcgaactcctgggctcaagtgattctcctacatcagcctcccaaagtgctgggattacaggcatgaaccatcacgcccggcctgagtcagtctcttgaagtcagaagtacactagaccgtaaaactggagacctagttgtgctccagctgtgccaacatttagtttcacgatatgcagcaagccacttcacctctctcggcttgagtttcctcatttagtaaagtaggtggttaacagaggatcactcctgttccgcttctaagacttattatttaagatatatagagagtttaacatcaattttattatcacttgagacaccacttcagtgctgcaacttgagcattgaagagcagagcaaaacacttcataaatgcaggtaagagtggatattttggtctgactcagataattgccttagttataaattggcattgtagatctatctacaatgtatgttaataatatcaaaaaataataaaataaaatccccagaattttctgctttcccaaataagctcattaagtgtaaagaaagaactagtttttaagatcttctgatttagacattcaaagtattgaaagggtagattccagattgataaccataagggtctttaaagtggcatttttaggcagggcgtggtggctcatgcctgtaatcccagcatgttgggaggccaaggcgggtggatctcctaaactcgggagtttgagaccagcctgggcagcatggagaaacctcgtttctgccaaaaatacaaaaacaacaacagcaacaacaaaaaaaagccaggcatggttgcatgcctgtggtcccagctactcaagaggctgaggtggaagtatcgcttgagctggggaggcagaggttacagtgagttgagattgcaccactgcactccagcctgggtgacagagtgagattccatctcaataaataaataaataaagtagcattttaaaaaagtatctgcagttttattcttatgctaaacatctaggccctgttttgaaggcacatacaccacacttttatactcaatcaagcagatagccaagttgtcagtgtgcatgtcttaccaataatgttatattgatttctctgtaattgtttctttagtgcattgaggtgttatagtataaaatcattaatcttgaactttgagtacctttatattttttgaaaataacaaaaagtgatgtagtatgccctgttccatatagaatatgaaccttagaatagatgctgtgctacacaattatcattcctttttccccattctctctatcagtgtgatctattcacctactcatatccagaaataaaatttgttttgttttcttttcttttcttttcttttcttttttctgagacagagtctccctctctcacccagactggggtgcagtggcatgatcttggctcactacaacctccacctcccgggttcaagtgattcttgtacctcagcctcctgagtagctgagaccacaggcacccaccaccaagcctggataatttttgtattttcagtagagatggggttttaccgtgttggccaggctggtcttgaactcctgacctcaggtgatccgcctgcctcagcctcccaaagtgctgggattacagatgtgagccaccatgcccagcctaaaatttgttgatatttagtttgttacagaagaaggaggattgaaataaaaataaaatatatttattatgtaatgactggtaactgattttgtattcatgtacagatagaataactctacattctgagaattcaaaaccttttggacaattaaaatattaagaaacatgatctatcttgcttcaattgcttgtttttagcgagtttaaatatttcactaaacttcatagctttgaatgcatcaaggtctcttcagagtttttcagtgggtaacaaacttatgtgtgtgtgtgtgtgtgtgtgtgtgtgtgtgtgtgtttcaaatttgccactgcggaaactgtaaaaaagaatatatatatatatatattccctgttgctcaagcgattgtcccacctcagcctcttgagtagctgggaccacaggcacgtgaccatggcaggctattttttttttttttgtatttttggtagaaatggggcttctccatgttgctcattttgtatttttggtagaaacggggtttctccatgttgcccaggttggtctcaaactcctgagcttaggagatccacccgccttgtcctcccaacatgctgggattacaggcatgagccaccacgccctgcctaaaaatgccactttaaagacccttatggttatcaatctggaatctaccctttcaatactttgaatgtctaaatcagaagatcttaaaaaccagttctttacacttaatgaatttatttgagaaagcagaaaattctggggattttattttattattttttgatattattaacatacataatgttatacaaagaatatacatatattttttacagtttctacagtggcaaatttgaagtatggtaaatgttgcttctgcattccaatttgataatgagccttaaccttgtccatttcattccattaaaagaggaaaaaaagtagttactggcaaagcaaatggctcataaagtaatctgagtgatggaaaaagaacagttctcagcatggaatgaaaatatctttcaccaaggatgaagtagaattatagaagtactccatctgtagctactttttacatttaatagtcttaaataaaattccccttgagtatctctgaccattgaggtctgagagcctgaaacatgatgaaatttacaatctgggcagtcataaagaaagtcctacatttttttcaggctttgaggggaatgggcattctattatgcctattccattggtcaccttgggtcttataaatttctttataaatttgccatacaaacttttatttatttttattttatttaattaaaatgtttttcttttttcatagtgatggggtttccaccgtgttgcctaggctggtcttgaactcctaggctcaatgaatcctcccatctcaacgtcccaaagtgctgggattatagacgtgagtcactgtgtctggctgcaaacttttggatatttttcttaaaataaaaacttttctaacatatacttgttttgtgatgtcaagatggtccaggggatcttaacaaataataaagaagcctttcatgatacaaggatcaagacttaggttctaatatcagttttattgcacaattattgtgtagtattggaaaagtccagtcatctttctaataatttattataaggcttaagtgcaaatatgcttaaaaggttctttttaatcataaagcattatgcaaatgtgacatattttctccaaacagccacctatatgaaagtggtgggttttcaattatctgaggcataaaccatgaatctatgtactttgactacacatatgagatgaagattagccttgtggttgcttattagattgaaatgcttttgcatacatattcatatagaatacttacaaatcaaatgtcaactttgttatttatatagtgttgacaatgatgataataggtaacactaattaagcactccgtatacatcatgcctggtgctaagcagtttccatatgttacctaactcaacagttgaaacgaccctgtattatagagaggaaagagataaagccaggattatagattgaagcaatccaactcctctcttagccattatatttttatgccttccaatactcttaaaaatctgctgtctgtcaactttttatttctggcagagcattcttcagaataaatgcaagacaaatcctccagagaggcttctggaaactacagactccagatagtctcatgatacattgagtaatctggttaaatggagagtaaacattaggattatgaaaacacagaagcacagaacttaatggagagaacctgcttgatttccataacagaaaatcatgctatactagagtttgggataagtagaaagtagatacaaaagtgggagcctcagacaaaagaactttaaatttaaaaaaaaaaaaaccacctttgaaagtttttaaaccaaaaagttttgattacagtccacatagcattgcaggacatgtaatgtaagagcttagagatgagtgggaggagctgatggggaattttgcaggcaatatgaccactctgtaattgtaattgacaacttgtcaattacccaaggtcttccataccccttgtgccatctggtaatcacagtattctggtgaggaaaatagaacagattctattatgccattttagagatattttaactgttaatggcagaatcttcttaaaattagccttgagattggtctaaattatcattttcacaaattatctttgaagagaaagtacatgagtacattggtcccaacccacatttataaccccagcatccatcatgactttattcacattatattctagctagacagaattactccccaggcagttatacatctttacccattgcttttttttttttttttttttttgagacagggtctctttctgttgcccaggctggagtgcaatggcacaaccatagctcaccataacatcaaatttctttgtctcaagcgatcctcctgcctcagcctactaaatatgtcggactacaggcaagtgccaccatgcccagctagttttagagggggttttattatgttgtccaggcttgtcttgaactcctgggctcaagaaatccccctgcatcagactcccaaagtgctgggattacaggtgtcagccattgcgcctggcctctactcttttttttttcctaccatacaagcccatcccaacaacttatctctattcatattgacttttcaaatcacatctatatttccacccctaaaatctccttacttcttgatttcttcaagcatatgttaaaatgacaagttctgagttgtcatccctggaaagggtgccaagagtcctttatagactctctcctgaagacagctgcccaagtattgtttcggtcaaaataatcaggaaaatgttgaacatcattaagaaaaattggaggaaaaaccagtaagcagtcattctattttttttttttttttttttttgtaaatccttgaggtgtctgcatccgggctcttttttgtagttctggtctatgtacaagacaggaataatagagttggagaagaccctgagacgagcaactgaaacggtgaaggggacggaaagcaaggcgggatataagctatatataaaatgataactcttcatattaaaactggctaaaggtaagcgtcatcagagagctgtgtggctgccagattttgttactggtatcttgccagagcatatgtcctaaacagttttatctccagtggcctcatccttgggctgtagtttggctattctattttctctaactcaatttcttgaatttctgacaatttcttcagtcccacacatccccatttaccaggagcttctcattacagagtggtgaatgtcaggatgcccttacctacaggtaaggggcaggtgaacagtcttatttatgttcatacgggttctagtttgattctccccccaggccaattgtcatactctttaggctacctgggcctcaactaagttgtgtacatcagaatcacctggggaactatagatctatgaatcatttatcacttaatttctctattgtggaaaatcaggatgtcatgtatgtatttctttaatacagaacataactaaacaaacaacaaaaatgaatcattaaatagaaaactgcttttggtctaatgttttatacacacacacacgcacacacacatatgtgtgtgtgtgtgcgtgtgtgtgtgtgtgtgtgtgtatatatatatatatatatatatatatatatatatatatatatatatatttggagattaggtctcactctgtcgcccaggctgcagtgcagtggcacaatcatgactcattgcagcttcaacttcccgggttcaggtgattttcccaccacagcctccggggtagctgggatgacaggcatgcaccacaatgaccgagtaattttttatattcttttgtagagatggggtttcgtcatgttgcccaggctgatgtagaactcctggcctcaagcaatccacctgctttggcctcccaaagtgctgggattacagacgtgagccaccatgccctgctggtttaacgttatattgaagtttctccaactgaagggcatgtactgttgagcatgctcagaagccaaggttcaagccattcttcaactatagatgcttcaactcatctctctttcttcggaatattctctcccttatcaatttcaccaattataccaagtaaccccctgcttattcccctagaacagacagagctgatactagtctgtgccttatgtgatttagaaaaagactcttggaatgcagccccagaccatgatgtacagagcatgagttgggtattgccccattttattctctaattcaggtgcccttgtgcagtgaataacatggcagctgtgagactagtgatgctaaacaggtttaatttttggtgcaaattctaatgaattaataatagctgttttaaaaaaacacacagtgctaagaaagactctgaggctgttttcaggctcagtagataaattgtactgtaagctgggatgatttgccttggttgggagaatggcaccaggtgtgacaagaatttgctatctaaggactagaggcatctcacccgtcctgaagaggtaggaagcctggggtaggcagatgttgaggtagaatgtgggcccagacaagttttataatttatagaacacaactttcaaatgcccttgtaatacaaggcaacaatcctacttttccaggtctctaacaaaaagcatctagctgagctagagtgttttcatgaggcatctgctacacaaaacaatgtcttgcttaataaataacacccgtttctacttggtgtcattttactgtttaatcaaaacttattttcaccactcttaaccacaatctaaagaaggatgcttcaatctcttcctgatttagccttaaacttggtcatgtgtaccattcgactaggattgccagagtcagccaccctcccaacaaaggatgctcagttaaatattgcacagaacacacttatactaaaaattgtttgttgtttatctgaaattcaaatttaatggggcataatgtattttacttggcaatcctacctgtgatggacatatatatttccccccagctttattaaggtataattgacaaataaaagtgtaaatatttatgatataaatggaaatataaacagatgctcctcgacttttgatggggttacatcctgataaacctgtcataagttaaaaatattgtgagttgaaaattcatgtaatacacctaacttactgaatatcctagcttggcctagccaaccttaaatgtgcccagaacacttacatcagcatatttgggctgatgtaacacaaaccctattttatcataaactgtttaatatctcatgtaatttattgaatactgtattgaaaatgaaagataaaatggttgtatgggtact

SEQ ID NO: 4938 - DNA, 88330 bp, human
cagctgcaaagattccgaggtgcagaagttgtctgagtgcgttggtcggcggcagtcgggccagacccaggactctgcgactttacgtaagtgctttgtaggcgccggcgggcactaggggagcgggtttcctgggcgtgggcaggagtgggtcccggggagagcatctcggttaagctcagcaggaacgtgcggcgcaccgtggggcgggggttgggggagagggaggtcggagaaatttcagttggagccctcgggcgcccgggcgatcggtcgcaaccgaaatgggtgtgagtgacggggagtttccctactagcatccgccgcagacacgttttctgcacttcactgtattaagtggtgttttcttactagttgctcttaacttgttgccagtcttgggctggagtcctagacgccagcccttgccctgattcccctccgcggctgcggccccgaagtggaaagggagcgcacaacttccctctgtcgtccttctccagctactgccatcccctcttccctcccgcccggactcaggaaatcccggagccagcagcctgctactcctccagcccccacacgcccgcctcgggtgacctggctggcttaagccgaccctggggctctggagagggggggccgtggccgagggaaggcacgaggtttgggttgcctgccttctgcctgcttccctcccttgtccttagcgagggcgtcgcgaacgcacctagtctccctatgagtaagcactttttttcctttcagtaggagaacatctctgggctagtaggacagtacctttccgttctcccctggccccacaccccctgtccttttttcagctcctttgactttgcggccccgggcgcgcggtcggggcggcggcagtcccggacctctcccgactcttggagagagagaggcaaaggggcgacgggagggaggtaatagtctacccccccgccctttccccgcacagctgcacttgcctgtgtttacttttctccacccgcagtacttaagcgctgtaatgagaggcccggggacgccgaccacccccgccctggcttctcgccagtcccaaagttgctgccgccgtcgctgctccagtgtgctggcggttccgaccgccgggctccgggacgtaagatgatcccagcccgggaggtggagtgggggttaatggcatctgactctagccttatgcgatgctccttgcctctcacctgagctgcacgatatccccagtggtgcagaaggttgaacttttgcagaaggttgagcttggagctaagtgggttggagagcctcgccatttagcgtcagacagacgggatgctgggggcgcccggcctgttaagagggattgggaggagggaagggagcctggctaacagtaggtagaaaatgtagggaaaagtaaaaaccattgaggggcaagcacttactccactttgctggatgtcacaatggactggggagcctaaacttgatcctcgagatgcagttcatggtgaattccaactaagtggctggagccccacacataccagttggaatcacgtgccccaagtctctgatggtcacatgacgtctttttactttaaagctggaatgtaatggttgaggcccatattccaaaaaccacctctacgtttgaaaaaaaaaaggtggggaggagtgtgaactagcttctaatcaaggaagtctactaggattttggatgaggggaccagaaagggaatttggtgctcagcttttatccaaaacaaaaacaggagctgtttttaaaataagggattgaaatatatgtgagctgggacatgtatctcctctcttcttcaatctcatggtttttctaaatttaaaaaacatcttactaattattttctagggaagtcatcctattactcatgcctcattttgtccctgaatactagatttgaagctaaatcccacaagatagtgttaaaaagtaaggctctgttcatcttccttggtctggcctatattctaattgaactgttccctattttaggcaactacttaaaggtagtaaataacctcttgactaaaattaaccaccagttatttgtggttttcaattaactggattagaaatcatgcacaaaaacagtggatagtaaatttgatacatcgagttggttgggtttttgcctgtcagtggtttggtagaataatgagaggacactgaaacaactttcccatattgacctatacccgcccaagtggcccaagttaaggttgcttctgggaaaacgtggcaatttggctattcagattatatattacagagtatagaagagaggcagaggagcctctgaggtcaggagtttaaaagctttgcttatctgaaaaaaaaagaaaaaacggacctggttgatgcatattcagtcttgaaaacaactagggcagaagatatttaagagattctgactttgtattcttttgccaaaaaccctttgtctcctgcagcagcctctgaatgaccggagcactccagtttcttgctgttcatccgtttctgagcctgaaaactagaacaaccttaaagcacattgttctgaccccaaggctagccttgtggcacagatgagctggaaatggatttaaggtgcacctgagttactagagttaactacactggtagatagacccctctagtggaagtgaggtgataatataattttagatcgaaataataaatgtttaacctcaaaaaaaggaagttattaccactcaactaggttacagtggtagggggataagttcttttttaagtattgtgaaatcatgtctaaacagaatcatcgctaggctctagtccacagcttttcattgtcttgggatgcctactcattgaacaccacccccaatattgctgactttttttggtggtatgatctaatgagcccaaatttttattgaaattagggggctgggagtcaaattcttgatttttactgttagatctagcagatagcaacccctttacctgaggtggggagctattaataaataaataacactttgccttgacttaatacagacgatcaacattgaagtccaaagtctctagtctgatgtaaccatttagattcaattgataaaaatgactaggcttatggcattttgggtagaaggattaattataactagtgagtaataatttgggtgagattaagcctcttccacaagtggttacacgcacattagactttgactgtgactgtttatactggcagaatgtcagtatctagggcactatcagaaacccaatgagatttttctcccaggagaacagaattctgttactgaaaataaaagggcagcttggccatggtgcttgagcaccaaagtggttctttttggtgacactgagagggtacaagaagaaagtccatttgccattatcccatattctgttttaggcattatttctacttggattttcatgaaatgtactgacagtgttcttagcacatatgataaattcatgagtttgctgttgtgtttgatctagcataatctatgtggaatgtataagctgaactgtttcttttttgatgtttggtacagattatgaaagtagctggtataaaataaaatttgaaaatgaatatctctcaatacatgacaacaatggggtatctgtttttagaatcatgttgtctttggtcatatggcaatttttcttttggtgaagagtgatccagaaggcaaaatttttgatctgtgaaaataatacaactcatttagaagaagtcagctgggtcatgttttgagtctgtattattttagacagtgatataccatataatgtatattcagtgtgttggaggtttcaaagctttttggatacattacaatgttggaagatttttatataccagtggtcatgactagctgattttagttatgagagcgctttggttaaagttatggaaacagtctaatcgtgaaatgtcagtcttagaagatctgatcatacttgggccaatttattttagttacggaggtgagacaatttcagaagattcacgataaatttaataataccaaattttgccttagtcttgacacttggaagataaatattagtgagtataaactgttttagggatgaagaagtattgttagtatacaaaaatgaaaatactaattattttagcatgggtcttttagtcctttgcagtctggacagatagattatcttaagtaaatcattgaacttgccctcagaggaattagattctagatagtgctctgccattgactcataatttgaccttcggaaagtcatttaaaattattatattaataactaattgagtacatacatgtgccagacaccattcatgcttttgtttataaaaagagaggattgctcaagctttttggtttgctgggttttattttttcaaatattcataatctggcttatttcacttatcagttgacttttcaaactttgatgcaattgcattgatccaagctaaatactttgttggcaaattgatgactattcaggaaagtgatcaccagtgggttattccatgactaatgttagttctttaaaataaagaggtgccatttatttaattccttgacagggatttttggtgcattaagcctactgattttataatatgagaaaccttacattttcttaaaagtttagaaacgtatttgataataaggaggtagtgttgtttattggaaaagcattgagcatagaatttagggtcttttagtcctttgcagtctggacagatagatgatcttaagtaactcattgaaattttctgtggtcatatctgggtttcactttatttttaagccatgtgattccaatctacatatttcacaggcatggtaaaaggataagtgagaaacgtgaagccttggcttttaagcagacaggtgctatataaattcaaagtactgcagcagtgtatcatagaaacactaaagctttaacaagagtttacagaaatggcagggttctcatcacgtaagtcttgccacatttttctttgtctgtaaaagttctgcacccatccaatttttacaagcaaaggaaaaataaagccagacatattataatgaaaaataagagactaggttgataacaatagaataaaaacctacatgtgatactttcttcttcttttgttttgttctgttttgttttgttttaaagacggagtcttgctttgtcgcccaggctggagtggtgcagcggcgtgatctcggctcactgcaagctcctcctcccgggttcaggccattctcctgcctcagcctcccgagtagctgggactacaggcgcccgccactgtgcccagctagtttttttgtatttttagtagagacggggtttcaccgtggtctcgatctcctgacctcgtgatccgcccgcctcggcctcccaaagtgctgggattacaggcgtgagccaccgcgcccggcccgttttgttttgttttgttttgagatggagtctcgctctgtcgcccaggctggaatgcaatggcgtgatctcggcccactgcaacctctgcctccgggttcaagtgattctcgtgcctcagcctcctgggtagctgggattacaggcgcgtaccaccacgcctggctaatttttgtatttttagtagaaatggggtttcaccatgttggtcaggctggtctagaattcctgaccttgtgatccgcccgccttggcctcccagagtgctgggattacaggcatgagccaccgcgcccagcccatgtgatactttcttctatttcttacctcaaatattgtgcaaggtagcccgttaaagccattaattgggtggtgtttttcccctttttaactaactactgagtagaattttggtcttcagtggtaattgttacagagtccattggcttaccatacctcatttttagttttgtgattgcccataatgggaggtttcgtgtaaaaaacctcataaaaaatcaagtttttcctcctcataattgcagtctaaaggaggacaacacgcaggtctgggaaactgcatagtggaagagataatctatacatttaagtagcatgccatgaataacacaaaaaatggcctggcacggtggctcacatctgtcatcccaacactttgggaggccgaggtgggtggatcacttcaggccaggagaccagcctagccaacatggtgaaaccccgtctctactaaaatacaaaaacttagccaagcacggtggcacgggcttgtagtcccagctacccaagaggctgaggtgggaggattgcttgagcctgggaggcggaggttacagtgagccgagattgcgccattgcactccaagcctgggctaccgagtgagaccccatctcaaaagaaaaacagaaaaacaaacaaacaaacaaaaaaaaacagaaaatgtgggaagttaagttgaaaaataaacaccttcaaagctattaacttggattttcttttcttttcttcttcttttttttttttttttttttgagtcaggttctcactctgtcgcccattcatactctgtccagttcattgaaaatacaagtctgattcccttgagttgtgatattcatacacacacgagtatatatacacttatgtgtgcatatgtatattatataaagttttacgtgatatataatataagtttttactttctgtaaaataaaatttgttagggccgtataatagttttgaatattcatattattgtgttccacattataagctctaattacatcgtgttgcactcagattgacattctgctgttgacactgaaaataacgctttcattcatagatgaatgtaattttcaagctttttttctatatttcttaacttgcttgaatgttcccatttttgccatttcttgttgttcattttaacattttggggcttgtgtttcagatcaggaagaatcaccattatagggtgcaaagagtttgctcagaggtgaaaatgatacgaaattgtccctagagcacatcctattgctatactattcaacatgtatgaattaatctactgggaaagtgtcttgtgtagtgtgtactttaaagatgttttcaatcactttgctttggattagaaaaattcaaggtaactataattttaaatgctcatatttttatgtttattttatatgtaggaagagaaatttttaaaaattggaataacactatatcccattcttttcatttattacattataaacatgtttccaagtgatcaaatatttttaaaaatgtttaaaatcactgcagtatattttatataatggctgtttcataatttatttcactaattccaagttgttgaacatttgtttccatatcttatagataatgcttcagtaagcattcttgatcgaacatcattttgcactctatcattttttagaagtcaccaagaatgttttaaagatgaattcctttgatagtccctgaaatttaaacattggcttaaacaaaaagatagccttgatttcagtggcatttaaaaaaagaaggctgggcatggtggctcaggcctgtaatcccaatactttggaaggccaaggcaggcagatcacttgaggtcaggagttcaagaccagcctggccaacatggcaaaactccgtctctactaaaaatacaaaaaaactagctgagcatggtggcgcacgcctgtaatcccagctacttgggaggctaaggcaggagaatcgcttgaacccaggaggtgaaggttgcagtgagccaagattgcaccactgcactccagcccgggcaacagagcaagactccgtttcaaaaaaaaaaaaagaagaagaaaaaagaaaaggccattctttatatagtgtattgtatcatatgtgactctaaactggaacttgtttaggtaaagtatatgtcttggaagtattttggttttctctgatctagttagcaggtgcagagcaggatgaggtaggattctgtgctgtgtacaatcataggaagttctgttttttgaaacggaactgttaatgggggaagggagacacgtttgtttttaagaagcctttatgtttaatattattataaaactcagttcaagtatacaaagcttatttgtgcctatgaacattcagtatcctaaagaaacatttaatcctggtgttggctaaatgactatttgctgatatgcccttttatctcaaggctattagtttcttaaagtactttgatatcactcaataaactacagttaaactcagagttttacatttcattcaggttgcttaaataatataactaaacataggtccaataatagtaaaaattctgatgctgtcacttaatttgtgcctggtttcagtatatggcgattgcttaaattacaagcacttgaatttacaaatattttgtgtatttaaatggctcattgtacattacatatccctcctgaaacttaacccatgccatttcacagacccttccatggtgtttttctctttcctccagttcactagcctcactcaccaaagactttattggtctgggaattctattatgacccagaagtgacttggaaggttcctttcacccaacaacacattctcactacctttcttttcttttcaggggcatcatttacatgctatgttgcacagtcagaatggattttagcataaagtatgggttccaatagctctcgcattttattatttatttatttgtttagagacagagcctcactttgtcgcccaggctggagtacagtggcacaatctcggctcactgcaacctccatcccccaggttcaagcgattctcctgcctcagccttgtgagtagctgggattataggctcctgccactgtgcccggctaatttttgtatttttagtagagatggggtttcaccgtcttggccaggctggtcttgaactcttgacctcgtgatccacctgcgttggcctcccaaagtgctgggattacaggcatgagccaccgcgcctgggccagctctcccattttatatctctgtggcattgaggaggtttcttaactctctgaacttcagttaccccatgaataaaatgaagataatccactcacttttcactttgttctcataattattatatgagaacacttataaagcaactagcatatggtaggtgctcaataagtattttcatttacaggttgattaatgttgccttagatgatttttgtcaggcatctatatctacctctttttctctaatttgagtaccttcctaccttcctttttttttttttttttttggacagagtcttgctttgtcgcccaggctggagtgcaactgtgcgatctcagctcactgcaaccttgacttcccggggctcaagcgatctccgtgcctcagcctcccgagtagctgggattacaggcgtgtactaccatgcctggctaacttttttttgtagtttgttttttagtagagatgggatttccccatgttgcccaggctggcaagattttagaaattagtggggttttttgtgttttatttaatggtattggaaaaacactccttttattgtttttcattgtgaatgtgaaggattctagccatgtttcaggttgaagaagcttcttcgcttagctcagaaacctgtttatcgtttaatttattctttttttttttttttttttgaaacggagtctcactgtgtcgtccaggctggagtgcagtggcgcgatctcagctcactgcaacctccgcctccgggttcatgcgattctcctgcctcagcctcccgagtagcagggactacaggtgcccaccaccatgccctgctaattttttgtatttttagtagagacggggtttcactgtgttagccaggatggtcttgatctcctaacctcatgaccacccacctcggcctcccaaagtgttgggattacaggcgtgagccactgaaccctgccatttaatttattcttttgtgaggatatgtggagaactagccaagacccgtcacagtggtttacgcgtgtaatcccaacactttgggaggccaaggcgggcaaatcacttcagctcaggagttcgaaaccagcctggccaacatagcaaaactctgtctctactaaatatacaaaaattagccaggcgtgttggcccatgcctatgtacccagctacttggaaggctgaggcacaagaatccctcgagtctgggaggcggaggctgcagtgagccaagatcgtgccacttccctccagcctgggtgacagagcaagactctggaaaaaaaaaaaaagaaaaagaaagagagaaagagaaaaggaaagaggaaaaggaaaaggaaagaaacaagaactcaccttcaaaggaaaattggaaacatggctcagtaaattacagacaccgttataaactcaaggccgctaacaaatacagcttaaatcagaatgaaaggtaataggtagtgttgatacctgacttgtggaggaggaaaaaaaagtaggggcaaagagaaaatatattattgaaaacttaaaatgctgaggatggcagagggttataaagtaaaccaatatgttttcatgatgacatgtagcctttaaaaatggctgaatctaaaacatatttatgatgcccattattttatctagtggaaattttcaaaagcaaaaaccaggaaatgatgaaggctattgacacattcagaaaatattctgagcagtttgtgggtctccattgtaaagctacagttgaatcatttttacaagtgggtatgaataattacaattttatattttgtcctgtggtaattaaaaagcaaatagagccaaattatcattaagcgtaactaacagaaaagtaatattgatagatttacatgtttaaaaatataagccaacccatgcattcagtattttatcctcaaacaaggtgttccagctttagttgacactcagataaaaagcaaactagtggctgggcatggtggctcacatctgtaatctaagcactttgggaggctgaggcaggaggattgcttgagcccaggaattcagaaccaacctgggtaagatatcaagaccctgtctctattttttaaaaaataaaaatagaaaataaattttaaaaaagcaaactagaatatatctagtaggtgctagcagaaggggaaaaattctctaagcagagatttgtgtaaaaatgaagggaaggttaataagtatctagaaactgtaagtgttgtataaaagaaggcttatagaccattggtaaatagatgtaaaactcaaggaaacttttaaacgtgcccaaagttcttaagtatatattaagatggtacaaactacagatgaagtaatagttaaccaaatatactaacatgcacaattgcttaattagtctatttgtggaatggtttcattattcattcaactaccataagtttaatgcagactgttaggtgctagggctacaaagacggataagatactcctccagtctagtagaacagaaagacacaaaaataatcttggttctcatgaaacctaaaaatattcataaatgtagaaaatgaatttagaccgtgcccggtggttcatgccagtaatcccagcaattagggaggccgaggcaagtggatacctgtggtcaggagttcgagaccagcctggccaacatggtgaaaccccgtctctactaaaaatacaaaaattagccgggtgtggtggcaagcgcaagtaatcccagctacttgggaggctgaggtgagagaattgcttggacctgggaggcagaggttgcagtgagccgggattgcgccattgcactccagcctgggtgacaagagtgagactccgtctcaaaaaaaaaaaaaaaaagaaaaaagaaagaaaggaaaaaaaaagaaaatgaatttaaatacagccttttttctcagcataaaataatttctaaatataaaccttgtgtgaacaaagaaattcacttataacccaatataatcaaatctaaactaagaacaaatctcatttaaacattgttatttctttgcaataattattgcataccaaaaaagagcccactatgagttaatgttacttaaatagaacattgctcagcctacaaatgaaggtcagcagacaccagtgtcttggaataaaatagccctttggcaagaaaacgagccacaccccattaagtttttacaaaaataaaattctttccagctttactaaattgtagatgttgcgcccagcatgtacttctgcagtagttgattctgcagctgtggaaatattcatgtatgcagaagtccccaaaaacatctattcaccattacttgcacatgcagctcttatactttctgtagtaaagtattccgttaagttttattttgactcgtggataatagcaagcaactacaggtatagctgacaccttaatttcctgccttgaacttctggccacagactttatttttttattttttgagatggagtatcgctctgttgcccagactggagtgcagtggcataatttcggctcactgcaacctccgcgtcccaggttcaagcaattctcccgcctcagcctcttaagtgcctgggattatggtgcataccaccatgcctggctaatttttgtattttttagtagagatgggttttcactgtgttgaccaggctggtctcgaactcctggcctcaagcgatctgcccacctcgacctcgcaaagtgctgggattacaggcatgagccaccttgcctggcccattgtcacagaattcaaattgagcaggaatacgtaggatttcaaatctaacagttgtttcatttggtgggatagcatcaaagccatgtactgtgaccactgtatatggttttcttcaagagcagcaataaatttctgccatgtaccatgggaaagagctgtacttttagggagaaaggaaataagccctgagaaaaagccccattttcctagttcctttcacagttcacctggcacacaacgggtcttgatatttatatttgaaagagtgaaacatggatggccataaatgctccttgctgataacgattgaattgggaaaatctaatcaggaaatcagtgatttatgaattacattgcataaaatacataatgatgggagcctgtaagaagactaaacaaatggcttccttagtttatttttcctttaggttttagttgttttcagtgaatattatgagtgaatgttatcgatagtgttttcattgtgagaactgctaaactgtagagtcaaagaagaaattgggacatattaatattttgacttttatgccagctttattgagacataatatcatactttttttttttttgagacagagtttcgctcttgttgcccaggctggagtgcaatggcacgatctcggctcaccgtaacctccgcctcccagattcaagcgattctcctgcctcagcctccctagtagctgggattacaggcatgtgccaccacacctggctaattttgtatttttagtagagacagggtttctctatgttggtcaggctggtctcagactcccgacctcaggtaatccgcccacctcggcttcccaaagtactgggattataggcgtgagccaccgcgcccggccccataccatctatttttatagattttagtatattcacagataacatgcaaccttcaccagtcaattttcaaacattttcatcacctcagaaagaaaccccatacactttagctatcaccttccacagcactctacccctgcaaccctaagcaaccactgaactatttcctgtctccattgagttccctgttctggacattacatataaatggagtcatataataggtggtattttgtgactagtttctttcacttagcctaacattttcaaggttcacacaccttgtagcaagtatcagtactctattcctttttatggctggataatatttcattgtacaccatattttgtttatccatttgtccatcgatggatatttggggttgtttctacactatggctatcataaataatgggacatgcaaacattaagtgtctatccatgagtcccctaatgagttagaggtggtgctgacaagataacatttcacttattaccactctgctcttaatataaatccttgctttgattaagcactaccgatttttccatctaagtttttttgttattttttgttccttgagacggagtctggctctgctgcccaggctggagtgcagtggcaccatctcggctcactgcaagctccgcctcccgggttcacgccattctcctgcctcagcctcccaagtagctgggactacaggcgcccgccaccacacctggctaattttttgtatttttagtagagacggggtttcaccgtgttagccaggatggtctcaatctcctgacctcgtgatccacccgcctcggcctcccaaagtactgggattacaggcgtgagccaccgcgcctggcctctatctaagtttagctattttttttcttgtttcctgatgcttattggcttatcatcgacttgttctcaataacgttttccttagtagtatttatactggaataatagaaagcctgtaaatgctgtataatcatcttttctaaaacttattgtataataaacatttagcacagttttgtttaatcacattttttgaacactaaggagcaaaggcaagcagtattaaggagtacaaaagtacatgataaatgctttgaaatgcaatgggttcaatcaaccaaaagcattattgagcacagctaatatatttacttttaaatgtactattcaagtgtgaaatatatccatatagaacaaaattcaaaactcacaaagggccataatgataagtaaattagcctctaacacttaatatttttaagaagacattagtgttttacgtttaggtattttgacagtaagtttgagggagtctttatcttttgaccttttggggtgaatatgagaatgaaggaatataaaaagatgattaaaagaatcaccaggccggaaatgacggctcatgcctgtaatcccagcactttaggaggccgagacaggagaatcacttgagctcaggagtttgacaccagcctgggcaacatagcgagacctcatctctactaaaaataaaacaaaattagccaggcatggtggcgtgcgcctatagtcccagctactcaggaggctgaggtgggagggttgcttgatcccgtgatcacgcctctgtatttcagcttgggtgagagagatcctgtctcaaaaaaataaaataaaataatttcctgcaatttcagattattcttttaagcacccttgaccccagattcaccagatcaaaacagctaatgactcatagaactttactctgtcattattttccagattcaacccacagcgaaatttttgggatccagtctccttactcttatgggcaggcggaaccttgcagatcctttaggaaaggataggcttccctgagaaaggtgggctggagttaagtcaaaaaaaaggtgcaactttctggagtcccatttagaacttcctgcgtatttaataggcctttgctaattattaacaatgtgcctggcacactaacataaataaaacagtgtgccatcgtttgaagagctgagtctaatccacctactgatttttacaaaggaggcaactgaagtctgattttggcttgcctcagcatagagtgctccaggacaatggtggaggatcaggtcgccatcactggagacccagattgtagtaatggaactgatccatcattcttctcactatatatttaaactccatgtccagggtcaactttgtttagtagcagtgcctcttccctgaatcagtttgtatctacacttaatttctttcagagattaataaaatgacaaatgctatctcaataaagttaccatgaactctctgaaactcatatcacccatgactaaagcaacttgctttgagtctgacaagctcttccctagctaatggaaatgcattagcaatagctttacagtggtaagctatttttctaggtcatattcaacccagagtagtcacatgctgacaaaacttcaatcctaaacactgatcataaagagtttcctatattgtatgtaatatatccaaaagtttttgaaaactctaattccagtatattgaatatacattatagggtttatcactcctgatttttttttaattgagacggaatcttgctctgttgcccaggctggagagtagtcccgtgatctcggctcactgcagcctctgcctcccaggttcaagcagttctcgtgcctcagctccccaagtagctgggattacaggcgtgcaccaccacgtctggataatttttgtgttttttgtagagatggggtttcgccatgttggccaggctgatctggaactcctgacctaaactgatcctcccgcctcggcctctaaaagtgctgggattacaggagtaaaccaccatgcctggcccactcctgatttcttctaaactggattttatcattctcagagtcagtgtttcctctctgtattactccttgcctagaaaaaaaaatgtccatttcattcatctattcattgacttattcaagtacttaccgagcaccttatatatgtcagatactattctaggcactggggattacagccgtcaatgaaacagacaaaaatcaccgtctttatgaagcttacatcctactaggggagagatagaaaataaacaatgattttatatattagatgctaatgtgttatggagaaaaagtaagattaatggtataggaagtgggaagaagggtattgccatttcaaaatatgtggtcacagaaggcattactgagagggagatatttcaggcaagatatgaaggaaatcaaggagtatccatgtgaatgtttggggagaagtgtcacttgaacaagtaaaaaatatttctaataacagatacctaaatcatcatacattgatgtgtttcagccctgaaattttcctttatgacaactcctttttattttggtattgaacagaaaaaaataactttcacccagatcaaacactctagtggagtcatgaactgactatatatgctaagaatattgtgtcagaagttatgtcaaaaaagttttgaaaagataaagctaggcgtggtggctcacgcctgtaatcccagcactttgggaggctgaggcaggcggatcacgaggttaggagatcgagaccatcctggctaacacggtgaaacctcgtccctactaaaaatacaaaaaattagactggcgtggtggcgggcgcctgtagtcccagctactcgggaggctgaggcagaagaatggcgtgaacccgggagacggagcttgcagtgagccgagatcacgccactgcacaaaaaaaaaaaaaaaaaaaaaaagataaagtgggaataatgtttaaagcaggatatagaattaatacaagtaaatgttcttcattttccctattaatttaattatactatattctgtgtttaattctgaattagattttttaattaaactttttattttgagataattgtagattcacacctacttgtaagaaatggcacaaagagatcctgtgtacctttacccagtttcttccaatggtaaactcttaaaaaaccatagtacaatagcaaaaccacaatgttgacactgatacagacaagaggcaaatgagtttcattaccagtagaatcccttttattgtcctttgataacaacacacacctccttcctcccctgacctccatttttgaccccaggaaaccactaatctgttctccatgtctataattttgtcatttaaaaatattatataaatggaatgatatatagtatgtagcctttgggaattagctttttttctctgagcgtaattctcttagagattcaacctaagttgttgtgtatgtcaatacctcgttccttttcattgttgaatagtattccatggtgtgtatgtaacaaagtttatttaaccattcacccattgaaggatatctgggccatttccagttttttagttatcacaagtatttgtatacaggtgttagtgtgaacttcagttttcgtttctctgggattaatgccggaagagtgcaaatgctgagttgtatgagagttgcatgtttaattttataagaaattgccaaagtgtttgcccagagtgactgtaccattgtgtgcttccaccagcaatgtatgagtgatccagtttttccacatccttgccagcctttggtggtgtcactgtttttcattttagccattctgataggtgtgtagtgatagctcattgtagttgcattttcagtttcataataactaatgatgtttaacattttttatgcacttatttcccatctgtttgccctcttcagtgaaatgtctgttcatgtcttttacctattttctttcatttttgagacagggtcttgctctgttgcccgggctggagtgcagtggcgcaatcacggctcgctgcagcgtcaacatcctgggctcaagtgattctcctgcctaagcctcccaagtagctgggactacaggtgcacaccaccattttattttttgtagagttggggtcttgttatattgcccaggctgatgtgaaacgtctggcctcaagcagtactccgcccttggcctcctactgtgctgggattacagacatgagccaccatgcctggcccttttgtctgttttctaattggattatttgtgtttttactgttgtggaattttaagaggtctttatgtattctagagtctaattctttatcagatatgtggcatacaaatattttctcctcgcctgtagcttatcttttcatcttctgaacagaatctttcatagaacaaaaggatttatttggtgaggcccactttatcagtatttccttttatggattgatttttggtgtcatgtccgagaactcttcatcaaatcaggttcctgaagaatttctctttcccccctaaagttttatagttttatgttttacatttaggtctgtgatctgttttgagctaacttttgtgtaaggtgtgaagtttgggttgaagtttcttattttttgttttggactgtgtttgtcctcgtctactgacatggttttttgcacccttgtgaaaaatcattgaatatatttgtgtaaatctgtttctgggttctcttctgttccgttgttttgagtatctgttgctctgtcagtatcacactgtcttgattactgtagctacatagtctgacttaatgccaggtggagtctattcaccttatttttcaacagttttagatgttctaaggcttgttcctttccatgttaatttttaaaagaagcttgtctataactacaaaaactgttctaggattttgagaggaattgatttaatgaattagacttttgaaattgcatatgtaatgttaataaagttaaaaatggtaattctgttaaggaaaacaatttagttccttccaaagtctaacgctagttcttattttctgaagaaatgtgtatttttatgattttgaaattattgaatgaatattaattagcagtttcttttttattttttaaattttttgtgtggagatggggtcccactatgttgcccaggctggtctcaaactcctggtctcaagcaatcctcccgcctcagcctcccaaagtcctggtattacaggcgtgaaccaccatgcccggccagcagtttcctttcagccataacatgaatgaccttttttaatggccaaaattgaagtttgtcaggttctaaatcactaatatgtttttgaatttaaaaatttttgaaggtttacttctggaatttttaagaccaaccattagatttataaggctgttaataagattcctaaacctattgttttgccttaaggaaagtatggtttaccttttgtgttatcccaaacaaattcatctccccatatagcaaaatggaatatgctactaaatagttgaaatttagggtaatggagtttgggatatgtttattattcatgaatagtaagtcaaaagtttttaaatgaaaacatttgtgtattctcatgctttgattgttgattctgcaaaataaaatcttaaaaattacaaaaagcatctgataaacttcttaatttaaaagaacactcagaaatttactttcaggtatttaaaaaaagagggaggctatcaaactgattaggactgaagaagaactgaagagataatgtcaccttgttggttttgggtgagggaaaattgaatgagatcatgctttctttctgtcttgctttctcaagataaagcttttccactcttctgtctgcttactgattcagggtggcaggcacaaaacaaaacgttccggttatattttccatcctgtttatatttaaattggctgtttattctttaataaagtgtataactgttggtctataacattatgaatgtgggattaagtggttagacttagcaggaatttgaaaatcagggtccaaatgtactaccctaagtacagtagcagaattacttctataaagaaaacttccctaagttacagcatctggctcatagcattatcattacagtgaagtttaccatcactcatattagtgatgtgttacttcccacttactcctaaccctgcttaggtaatgcaaaactataatttagaaagtgtgatttaaagaagatgcaatataatggtactcattgtaaacatatatccagatttctttcttcacatataatttatctgtatttttaaatttattttgtctaatgaaagacttttaaaagctcattctctcgagcagtgaattctcagctagtgagccaggacagtctgcctcatcaaaagaattctgctaattgctttagccaatttctgaggtaataagctgggagagggaagaggttggttactcatgcataggtgactttttgctaacagtgtgatttttaggaagtgaagaccacaaaagctttttgacttgtggcagaattcattatgatgagactttagctgtaccaggtaacagattgccaaataaaacaccaaacaagcaagattggtcagttacaatccagtctgtagtagtctgatccagcatagtgttatgtttatggattcaattccctcctcgaagtcatacaattgaggcatctcagtagaaataaaacaaaataaacaaattttgtagggaagctcctatacatttgaatggtaagggcatataactattaatactttatgagaccatggtattttgcagccaatcttaaggataaatctacattgtgttcaggattctgtgttgggccagacttaacaatgaccattatgtgtagaaaatagcaaccattgttgctgaattaaactctctctggagatttaaacatttttttaaaaaattaagctaataggccaagcgtggtagctcacgcctgaatcccaacactttaggaggccgacgcgggcggatcacttgaggacaggagtttgagatcagcctgggcaacgtggcgaaagcccgtctctactaaaaacacaaaaagattagccaggcatggtggtatgcatctggtcccaggtactcgggaggccgaggtgataggatcacctgagcctgggggaggttcaggctgctgtaagctgtgattgcaccacggcactcagcctgagtgacagagggagactctgtctttaaaaaaaagaaaagaaaagaaaaagctaataaaaccttgatgacaacatagccaaagaaattaatcagagaagagtggtgattagaaacagaaagcatagtggaatagatgaattacacctggcaaaggaactctaaactatattatgtaaagctcaggacagtctacttgtctgaaaaagaaataccaaaagtatacacatgcaaaaatttggatttttcagctggactttttgtgaaaggttccctcccaccccaaattcaaaagaagtataaagcaggccattcatggcaaactcccaatgaaatggaattaatttgtattgtgttttgaaagtgtatatatgtgcttgcaggaattacatggaagaattatactgacatagagtggctctcaaagtgaataatggaatcttaaggatgttttattaaacagcgagtcaactatttttctccgtgaatgtgactccacaatgatagtggaagtcagaaaatatttcacatgcaaatatatctgaaattcttcatggatgtatttaacgctttgaagtgatggcaacatctggtagcaagtagaagccagcgtcttaaaagctatggcttcatgttactacttcatctgaattagtcatttaaaggggattttatatgtcttcctaaaaactgacgaggttaatcttagactagggcaggctggcaggaaatgctaaagcggctctttcttttgaaggttttgttattccttgtgaggtcaaaaagtagttgttttaaagtttggaaagctaaagcagtgatgttttgactcttgacagtgagatgtttttctttttttttgggggagggtgtgtgtggcaagtttgaggaaaaacttgatacactgagagttctttatactttccactccacttattttctctcaaatgaatttattttctaaaggtgcagaatttagaaattcgtttcaattaccaaatctgagcatggatttggtgctattagaagatgtaaccaccatgtgtttggccagattagctttcaggaatgatcgtatcttacagagttagccaatggaacaagagtagatgccttttatccttatttatttgctttgcattaaaaagacaaatgctgaaagtttattcttgactatgaaataaaccactataatatatgacactgagttaattcctttaggatgctatgtcttccacatacatccatttaataaatatttgttgagtgcctactgtatgccaggcactgttctataagctgaaaatagattgctggacaaaacagacaaaaaatcactgccctcttagagcttattaaatacgaaaacagtagagcaatttaaaattatttaatgctatcactcagcttttaaagatcttcactgaatgagttttgagaacttttgcacatattatctacagcttgaatagggaaaaaatgacattttgtttgaaatctagttcaagaagctagaagctgataagtaaagtaaatattttattctgtgatgatcattttcagttttcatttatcagtgttatacttaggcctcttgaggaatgttactagtttaacttgtggatttcctcctgaggatgggcttaatttgtattgggggaggtggtgaaaggacctagtagccctggaatttaatgtaaagtcgtggcatttgtaaaactatcttctgtcatttgaaaaattatagaatacttaaatgtatttaatgctccctgtggaaaatgaatgtattgctcagttatttttgcctatgtgagtagtacaagagctgactcaaaggagatgacatgatggttcctgtcctgaagtgaaataagatgatgggttgtggtggaaaaatgatgtggtcatgcccatatttgctcacatctcttgttcgtttccttttatagagggaaaccagggaaagtctcatttcttattttttgtttcctttttgtattttctttcatacgccatttccctttctttttttcttaaaattgcattatagtgacttccaattcaattggctcaagttgtacttggtaatgacataaagaaataccgcttagaaaggtcatagtggaagcattatacccattttagggaattgattatatatatagacacagccactctgagccccttgaggatatgaaaagcatgttgcagaaatcctcatatttcctgatgccaactagtatagtgccttttacagaatatatgcttaatcggtatttatctattgaacaaatatgagccatgaaatttaattttgctctccaaaatcccaagtcctttatataagtaggcagaaattttaaaaagtctttttttttgtttgtttgttttttgagacagagtcttgcactgtggcctgggctggagtgcagtggtgcaatctcagctcactgcaagctccgcctcctgggttcaagattttctcctgcctcaggctcctaagtagctgggattacaggcacccgccaccacgcccagctaattttttgtatttttagtagagacgggatttcaccatgttggccaggctgatctcaaactcctgacctcgtgatttgccctcctcagcctcccaaagcactgggattacaggtgtgagccactgcacccggtctaaaaacttatttttatggaattattcaaatacataatgtaaaatagcattaaaaacccccagctttaacaattaccagtatttcatgttcttatttcatctttgctctccccttttttgagatttgctttaaaataatccgcatattgttttaccgataaatactatagtatacttcttagtttttaatattttaagatagtagtgtttgcatttcatatggagttttacttttaaaccctttctgtgctactttatgcaagagaaagaaattcttaaccgcttatcagaagaaaaatctaatttttttttttttgacggagttttgctcttgttgcccaggctggggtgcaatggtgtgatctcggctcacagcaacctccgcctcccgggttcaagccattctcctgcctcagcctccgaatagctgggattacaggcctgtgccaccacacccggctaattttgtatttttaccggagacggggtttctccatgttggtcaggctagtctcgaactccagacctcaggtgatccacctgcctcggcctcccaaagtgctgagattacaggcgtgagccactgcgcccggccaagaataatctaatttgctgtgtatgagtaggatgttaactcattttgtaacatatatttcctttcttaatcttttaaaaaattttattaaaagtttctaaacaggccgggcgctgtggctcacacctataatgccagcactttgggaggctgaggcggacaggtcatgaggccaggagttcgagactagcctggccaacatagtgaaacccggtctctactaaaaatacaaaaaaaaaaaaaaaatagccatgtgtggtggcaggtgcctgtagtcccagatacttgggaggctgaggcaggagaatcgcttgaactcgggagggggaggttgcagtgagccaagattgtgccacgcactccagcctggaggatggagtgagactccgtctcaaaaaaaaaaaaaaagtttctaaacaacattgtacatgttatgtcatgactgtcatgataaagtcttgccttttagacatgaacctgattcagcaaaatgtgctttgaagtagataagctgtagatttttgtcttgcctgaattgatattaaagagatgttttttcttttcacagttcaaaagtacagaactcaggttaaaacctagatatgtaattttgttaattttattttcagtttgaaaattcttgttaaaacctgcatactttataggtttgctgtctctaaaattagatggctccttcataaatattactgaataaagcaccagttttcaaaaagtgtggcacatgggctcatgggggttaaaattactttcatgataaaactaaattgttatttgttttttcactgtgttaacatttgcactgatgatgcaaaagcagtagtgggtaaagctgctgaatcaagatagtggccccacactgtagtgatagccactgtattcctcagcaccataccatcacctttagaaaaaaatcttacaacatgcatttcatttacaaatgtacttgatgaagcaggaaaaaataattgtattaaatctcaattcttaggtatgcatctttttaaatattgtgtgtgatgagataagacatacccataaagtatttctgctgcatatggatatatgacgattgtcttgagggaaagcacttgcgcagctgtttgagttgtgagctaaactagctgcctttttaaaaatagaaaaccaggccgggcgcggtggctcacgcctgtaatcccagcactttgggaggccgaggcgggcagatcacgaggtcaggagatcgagaccatcctggctaacacggtgaaaccccgtctccactaaaaatacaaaaaattagctgggcgtggtggcgggcacctgtagtcccagctacttgggaggctgaggcaggagaatggcgtgaactagggaggcggagcttgcagtgagccgagatcgcgccactgcactccagcctgggcgacagagcgagactccgtctcaaaaaaaaaaaaaaaaagacaaccagttttactttgaaagattgaattaactgattattcagacccgagtatctaacagatactttatttttaaaaaatgaaccaagtgtgcctctcactgcaagggaaacaactaagagtatttgttgccaatgctaaaattagagctttcaagcaaaattcaaatttttgagaacttgcattggtcaccattttatccgatcaatacttaggcttttctagtgaaatcgacagtataattaatgaaaataatgtgttagattttgtataatgaaatgtatcagcatttggaagacccacataacttactgaaacaatatttttccaaataactaatgtatgatgttacaaaatcaagcatgggtaaaaggcccattctaagtgcaagacagacaaatagattttgaaaaaatcattgatattgtatcagactctacattgcaaccaacctttgaaaaactaccacttctctcgagttttggtgtagtattgaagaatatctgtaagtatctggaaagcctcttaaagtatttctttctttttacaacagtttatctgtaggaggccagatgttcttcatgcactggaaccaaaaccggtattgcaaaagattgaatgcagaagcagatatgaaaacccagctttcttgttctaggttaaacattaaagcgatttgcaacaatgtaaacaatgccacccttgtcactacactttttttgaaaatatagttatttttcattaaaaagcttatgttaacatgtaatgggcttattcttatttttaaacaaataaatatcttaaaagtttcgtagtcgcaatttttgatgtgacaaatacactgatagatctaacccatgtgtcaccaaactctttgggatcctcagatcctgaggccaaaaagtttaggaactgctgagttgggttttttgttgttgtttccctccttatccctttgccccacccctccacttttctcctattcccctctcctttcttttctttttttgagtgagagagagaccctcaggatagaaaattgtagagcatgtgagttattcctttgtatgtttttattagctacgaactgaacatgtatgtcttttaaattcattcattgccccatgtgtagttcgatgtattttgaccttttcttttatttattttaaaattttgattacttagttacacaaataaagagctaataaatactatcagggagacagcccttggaatattgaattttatattttcttctgcgacagtcttgctctgtccgtgcagtggcaagatcacagctcacctcctgggctcaagctatcctcctacctcagcctcccaagtagctgggactacaggcgacagccaccatgcccagctaatttttttgtattttttttgtaaagacagggttttgccatgttgcccacgctgctctcgaactcccgggctaaagtgatccacccacctctgcctcccaaggtgctgggattacaagcaccagccaccacgcctggccagaatattgaaattaagatatattctgacttatttttccccaaatatgaaaaaaatgattacatatatgacttgattattaaaattgacacatccatgcaacaagtttatatacctaatgctgtgcctggtatgaatttcctaaactttccaatatagtcccaaaattacagtagtagtttcttgaatgtaaacttgttgcctgttttatatgttagatccctttgcttctatgcttcactcactatgtttgtttgttcgctttgtttttataagtcatgaagatggaaaaaaaactgtttcatgaaaggaaaatagatgagtgttgttgaggtgtgtcattaagcacagtgggagaggcctccaatgtacgtgtcacacatggaaagtatacctagtactgggtgtggtggagagcatgacgtctggatgaaagttgtaagagactttaaaaatactatgcctagcttttgtgttacaactacatattccactgatacttatgtgaaactcccataacttttcgggttgtacctcttttttccaccctggggtgggagtgtgtccacaagtgcatgtgtgtgaactcttaactttgtgtttgtattttgagatggagtctctgtggcccaggctggagtgcagtggtgcaatctctgctcactgcaacctccacttctggggttcaagctgttctcctgcctcagcctcccaagtagctgggactacaagggcacaacaccaatctggcttttttgaatttttggtagagacggggtttcaccacgttggccaggcttgtctggaactcctgacctcaggtgatccgcccacctcagcctcgcaaagtgctgggattacaggcctgagccaccgcgcccagcccggcctgaactcttaactgtatggtttctgtttgtaacatctagagagagtgacagtgagaatttggtttccgtcggctttccttagcattcattttgatgaatttgggatgcaatttaaaagctgttttcattctgtggcctgctgatgaaaatgtagaatttattgcagaacccttgccaccgtcttgcattcccaaaccagtgttcattacccatagtaaaaaccgagatcctgttcacacacatgcacatacacagacacgctccccaccgcccccgtcacgcacacacccacacacacctcggatggtgagtgagatagaagtttagtttacatgctaaaactggttaaattactgatgtggtagaactgtcttttagcccgggcacagttgctcacacctgtaatcccagcactttgggaggccaaggtgggtggatcacctgaggtcaggagttctagaccagcctggccaacatggtgaaaacccgtctctactaaaaatacaaaaattagccgggcatggtggcaggtgcctgtaatcccagctactcgggaggctgaggccagagaatagctggaacccgggaggcggaggttgcagtgagctgagatcgaaccactgcactccaacctgggcgacagagcgagactccgtctcaaaaataataataataaataaaagaaacaaaaaactggccgggcgcggtggctcacgccttgtaatcccagcactttgggaggctgaggcgggcagatcccaaggtcaggagatcgagaccatcctggttaacacggtgaaatcccgtctctactaaaaatacaaaaaaattagccgggcgtggtggcgggtgcttgtagtcccagctactcaggaggctgaggcaggagaatggcatgaacccgggaggtggagcttgcagtgagccacgatcccgccactacactccagcctgggtgacagagcgagactccgtctcaaaaaaaaaacaaaccaaaactgtctttatgtcctacctagcatttactaagtagaagatgtgcccttttgaagggcatgtctattcctagaactttaactacaatgctttgcagtagaaatatatgctattgtattaaggtgaagtgactttagaattagtaactcggtgttgacagatcatgctgatcgaagattagccttggagtttggaaagctggagagcatgtatattccagatgaccaggaaaggaaaagtcagaaaaacagtttttaagtagtactgttataacgacctgtaaaacttgaaacgagagaaagctgtcttctaaaatgaagaattacatatttaaaacattaatttcctcaatgatactgctacatatctgaaaagggtggttacgtagcatttgggacagacccgtctcagtggtttgaggcaacaggtgtggctgaagaaaaggtaaggctggggaaaaaccaacatttctggtctaaactgatactgtcttcttacctgaggcagtttcctatgccctggttttctctgtctgaaaaatgcatgataacacatactcttcaaattagctcaaaatgcttggtagttacctactattccctgacaggccacaggcagatagttctatgcttgttttagaaatggagaatttggtactcagaaaagttgaagaagcttcatttcattcacatagtgagtcagcaacaaggacagacggaaaaacatgtcctatgactcctgccattgtattccttctcttctgcattgtgttgccttttgatatttcacgaaggttttgtgattggtgaaataaattaaagcacttccatgaaggagacaaaatgtaacccagtgtctgctgatggtggttagtgacgaggacaggagaacactgcctcataatggggactatccggtgagggctccttttcacaggtgcccacactgtgagtcacctccttatgctgagagttcggtatgctatcataaaatactttgttgtgtattatttatgaaggactagagtatctattgtctcactttctttcattctcatgaggtagattacagcagcagatggcattatgcatgctttatcccagacacaagaaaataatatctgccacttactgagtaccttgctggacccagacactcttacatatttatatcttcccattgggtcatcccgtggaccttgtgaaatatgtggaatagctccattgttatagatatgaacccggggctcagagaagctaagtaatttgttcagggtcacacagacttacaggtctgtcagactcctaagaccctgatgctttcattgtgctgcatttccttcaaattatgaacttgccctatgtcagcacagaaacggcctcttcagcctagcccagtgctccaactgattgttctctctcataaaaggcactcacaactaaccacttgcttgatttaggaattcactgattagattgctagaccagttaaaggcaaatttcaataatgagagcagttatcacgtatctagtacttaccatgcgccagactatgatctaaatttatgacacatattaaatcatttaagccttacaaccatgtataaaatagtgaactgcgatatgatggagttgctcttatcttcatcccgggatgagaaaatagaggcagaagagttttaagcaatttgcacagttaataaagtgtggagccagaatttgaacccaatctggctccagacctctttactacagctctcagttagaaaattatttctaactgagatatttcggttcagcaagtgttggcttagttcctgtgtgctatgccagcagaaaatatagttcctacacagaagagcttacatttttgacataaatcaaaatgtatatacttgaaataaatgctacaacaccttagcatatggggtgtaaatgttgtgtatggatcagcatgaataatagagactgttagtgagtggcttgagagttaatttgccttcgcaagtaatgttcttgactatggacgagtgacttgggcactggggagaagctgttccatgtgttctaaaataagcaggttacttggctactgttcaaactctaaataggtatatgggttgtagctatttgacctgaactaactttaaattcccctgagtccttatatgattttggggaaaaaaaaaaaaggaagaagaaaaaagaaaacttttctctgtaaatgctgcatttaaattagaatttattaaattctctgcaaaataccgccaggctgacaggaaggggattcgtaagtattgtatcattcttttgtcagggtgttctctttttctagcaggaagtgttgtgacttgctctctaaagttgcaattgtaagaagaatgttgggtttccagattgctcttctgggcgtgggagaaggttctgtctatcagtgctgcgagaaaggaaagaaacaagtttgctctcagcgggtaactattttaatattattttgacaggctctaactttgagattactaaatctaaatttaaatactaaatgattaagcaggaatttacgtcaaaaagcttgaaattcctgttatttatttgggtaaacatttggagtcactttaaaaatattatttattcaagtagaataaaatttttgttaagagaaaattttgaagtttagattctaacctgttctgtgtgtattctgtatttttctttatttagagaatgtttagggagtttatactttttaaaaatgggttttgaaatcctaattatacagccgtatttatcaagttaagtatctaaaacactaaataatagaaattattgtctatatttgtggtgggggtgggatttcaaatgcttttgatcccagttacatggtttttcaaaattctgtaaaatggaggttgaggtggctgtcatgacagaacatgtcacgattagattgatattatactcttcctacgtgagttaaatcaaacagttgtcttagtgtttataatttacaaaataataaacatcactggtgattaaattttgatggcgttattggtacttggcagcaatagtgatttctggtgctcacatacattaggattttccatcacatggttgtcatataagtttaatttccccatatttctggcaaagggaagtatagctagttatacagtcaatcctcactctgagttgagtcacctctcggactggttgtacttaatatgcgcatatgaagtaaaaagtgaagcatgaaacaaaacaaaccagttttttcaattaacaagtgctgtatttgctaacatataagcaaggtatataacactgcaagaggcattttcagtgacttgccgatagctttctgcttcgtgtatatagtgatttgagttgtaggtcacaatattttatggcatttttattttgaattgaagtgaagcatggtaactagtctgatcttgcctagcctctctctctctctctccctccctctctctctctctctctctctctcacacacacacacacacacacaccccacacacacatatccctgaaagttgcccttggcttcactcaaacatatgttaattttcataagaaaggaaactggtggaaatacttcttaggtatgaaaattaattaatttcattagcagcagatttattttcccataaattattcagattttgggggtagatgtaaaagtttacttaggcatggaagacattagaccttttaaaagcaaagtgggctatttcaatctaagaagttagttaatgtaccttagctttctgaagctaggggaaggagaggtgtctttttgttgtgtctttgggtttgaaatagtattcttcatcctaggaaaaagggcttttagactataattgagacttgcattaaatagctgcaaaattcttgcctgagaaacgtttaaatgatgtctttaatctgaccaaattgaattgaatatttctattattggaaaaagctacgtattaatttatttttaaatagccattgctttcagatcttatctttgtttattaagtataaaaagaggaaaggaaacttttacctaaaatggaggtatttgatattcctccaggaaatgacacaggattgggcaccctttggggtttaagtgactcatagatattggtactgaaaacaaaacaaaacaaaagatcagttagaatctagctaatgatcaattatagcacagaatagaagtatttccagaaaaatgaactcatttcttaatagctatgtaggggtgaaatcacaggatttctgagatttgctttaaaataattcatggaagagagacagggaaggagggagggagaagaaaggacaggaagagagaatagatgaaccaagcaaatgtggggaaatctggataaatgtagaatctgtgatgggtttatgggtgttttttgtgctattttctcttgtatatattgaaaatattgacaataaaaaatgttagtagacctttagtttggggcaatttatatttattttctttcttttttttttttttttttttgagatggagtctcactctgttgcccaggctggagtgcagtggcacgatcttggctcatgcaacctccacctcccgggttcaagcagctctcctgcctcagcctcccgagtagctgggattacaggcacccaccaccacgcccggctaatttttgtgtttttagtagagatggggtttcaccatactggccaggctggtcttgaactccttatatttacttctaaatgtcaacttttatctataaattgcaggcctgtcaaaacatgatgtatgcatgatgtgtatgactgtaaaggtgaaatgtgctgcttgaatgccaaaatggttgaaagtaaaaactgcttctgaaaaggtttatttctgtttgattttcagctaaattcaaaggacaggtcacaaacatcttgaagagttttttagtatcttgaagtattaaacaagggtagttaaagcatgataacaggccaattgtatgtgaagaatgtgaagacgttattgaacttgactattttgttcacagctttctccaatagagtatgtgtttttaaaaccacgtgagaggactatatagcctgcatgatgtataggtctgcgcactttccctactcacctccatcgaagtttatttattgaacaaacattcggtaggtgcttgtggtgagccaagatacaaagtcaaataagataccaaccgtgcttttaaggagctcacaggctcgtggaggagatagagaaagaaatagatgtcatcacgctgaaagctgaaaagggctataggaatatggggaaggggaggaacgggttagcaactatgaccctatgacgcatctcctttaaaataatacaaggctgggcacagtggctcatgcctgtaatcccaacattttgggaggcctaggtgggcagatcacttgaggtcagtagttcgagacaagtctggcccacatggtgaaaccccgtctctcctaaaagaataaaaactagccagatgtggtggcgcatgcttgtaatgctagcaactgtgaaagctgaggcgggagaatcgcttgaacccaggagtcggaggttgcagtgagctgagatagagccactgcactcaagcctgggtgacagagcaagactctgtctcaagaaaataataataatataaaataaggctgggtgcggtggctcactcctgtaatcccagcactttgggaggccgaggcgggtgggtcacctgagatcaggagttcgagaccagcctgatcaacctggtgaaaccccatctctagtaaaaatacaaaaactagccaggcatggtggtgggcgcctgtaatcccagctacccaggaggctgaggcaggagaatcacttgaacccaggaggtggaggttgcagtgagccaagatcatgccattgcactccagcctgggcgacagagtgagactctgcctcaaaactaataataataatataatgtaatataatacagacagaaaattggagatggtttaattggttgtgggtattacagtggtagaagagggctaaaatggcttagtctaaccccatgcataactttgcaaataactcttctgctctcatctctcttccccgcccttcttaataaacctttatatctttcttatgcatccacaggggttattggagcagtgtacgtgcagaacagagcaatctcttcttcacattaaagagtagactgatgtttaagtctcccttaaaggttttagatatatccaaggccgaattatagttattaggtaggcagctacttggagttggataaagggtagagttagccttcagtcacagatagagccttctaaagttcatttctcaattgatttggaatttgaaacatattttgtcatggaaatagtagtagggtttttcaggttactttacaagtattcctgaaattttatattatgttatctggcatgatatggttttgttctatgatatcttattttattttcattgtattctatgtgaattgtagaagcacagttgctaaatatatccagatttatgttccatcagccagttactttattctctagttcctgatactatacaatctaatcagtgtatataataatgcctcatgagaaaatactgtcaattttatttgaggtacctaatgatgtcctctgtttagttgtacaatttgcagctgaaatgttaagtagaatgaacagaagagctagacctgaaaaataactttccgaagtaaagtctgctatacgtggtgattatttctttcatagatgtttgctcaccacattgactataagaagaaatttttggctgggcatgatggctcatacctgtaacctcagcacttttggaggccaaagcagacaaatcacttgagcccaggagttcaagaccaacctggagaacatggcaaaaccccatctctccaaaaaatacaaaaattagctggggtgatattgcgtgcctgtaatcccagttactcagggggctaaggtgggaagatttcttgagcccaggagttggaggcttcagttaccatgacactgcactccagcctgggcgacacagcgagattctatttcaaaaaaaaaaaaaaaagaagaaggagaagaagcaatttttgataatgctgatgtgctagaattaatgcacagtaaaacacttcaccactttttcttctgcttcaacctttcctagacttttaggactaggaacctatgacacacgtgagggcatttaggttttgactcccttattttgactttcagagcaacaaatcattaaataaaaattatgcatatagcctcttaagcctttacaattactcctttaccaagattccgtgaaagttttctaaaatgagtcaagcaaaattccaagccacttgttcttgagaaaaatcttgaaagaaaaaatttttaaatgaaaagtaaatcacatagatacttgagtgtttgttttatattaagactaagttattagcactgatacaatgggagtggttgttcacaatacttagcattcatgaggctgaaattaagcagtattaacaaagagaagcagaagcctgtcatatgtaggaatgaatgtgtcataggagaaagtaagcgtttgtgtgcttttttttcagaatattgcctgttttatgatcagtgccaatttaacaccaatgttttaaataaatgacttttagaactctgtatgagtctttactgaactcattgtctatattctgtatgttttatacaattaaagttttggttattttagttcaaggcttaagtgaatcccttatccttttaaataatgaaaacaagttagtattagctggagggggttactatctccattttctggcaactgttcttatttctcgatatcatggtcatatttgttaggagctttttaagttattttccaaaggctatatatactaggcatggaccttctctctgcaaagcaatgtgtagtctctttgtttttgtttttctgggaagagtagttaattggctgggcactgcagctcaagcctgtaatcccagcactttgggaggctgaggcaggaggatcacttgagccctggagttttagaccagcttggcaacatagtgagatcctgtctctacaaaaaaaaaaaaaaaaaagaaataaaaattaaaaattagccgagtatggtggtgcatgcttgtagtcctagctactgggggtgggaggtgctgaagcaggaggatcacttgaggccaggagttggaggctgcagtgatcatgccactgcactgcagcctggacatctcagcaagactctatctcaaaaaaaaaaaaaaaaggaaagagggaaaaaacagttaattacctttcctccaacacatgcttttgctttttttttttttttccagctatgcttggagaaacacattattattattattattattattttgaggtggagtcttgctgtgtcgcccaggctggagtgcagtggtccaatctcggctcactgcagcctccgcctcctgggttcaagcaattctcctgcctcagccccttgagtagctgggactacaggcacgtgcagccaggccctgttaatttttgtatttttagtagagacggggcttcaccatgttggccaggatggtcttgatctctgaccttgtgatctgcccgcctcggcctcgcaaagtgctgagattacaggcatgagccactgcgcctggctgagaaatacatctttttaattgtgcttcacagctttgtgtcctgggcaaagtcaacgactatcccaggcacttgtttattccctaatacaatttagggaatgaagttatggaactctacagacttcttagctttcaaattctcattgctgtgatcactggatattgggaatactgggaattttcactccctctaaacattgcagttggttggagtattttattcattttttatgtttatttttttagaggcaggcaaccatagctcactgcagcctcaaactcctgggcttcagtgatccttctgccccagccttcctagtagctaggactacaggctcaggccaccatgctggctgatttaattttttttttttttttaagagaaggagtctcgctatgttgtacaggttggtcccaaactcctggcctcaagcagttctcccacttctgcctcccaaagcactgggattataggcatgagccaccaccctcagcctcagttggtatattttgtaaaccatgcctgtgtaaccaacatccagcaatgagagtaaaaggtgaagtttagactgttctccagaaacaaacaatcatgaaatgagacttgcaaagcaaagaattacacaagtttttgtgtgctgttcgtgaaagaaggattttcttttattgaagaagattgttctctttgaccaagtttaagaatctatgtaaagaaggtagataaactgaaccaagtaggacaatggaagtcccagttagactgactgtcctcatatccacttatgtaactatagggagaagtctataattaaatttcaaaattttgtggcaagattctaaattctctgggagttgaagagaaagatcagtgggaggtggagtcattgggaaacgtgctttgggagaggatgaggcttctgaaccttgcttgaagggtgagtagaatttggatagagagagaggaaaaatagaggagagtattctaagcatgagacgcagatagagagagaggaagttcttaatggaagacaggaaaagcagaagagaccagaataaaacaaaaggtactgatagaggagaatccagaaccagctgtaatagaaacacagttctgtgagagtactgggaagataaattttatcttgggtgcggacaatctgaagatacttcctgaaataggcttttgaagtgtctagatagatgggtgaagagcattccactggagagacccagtggtctctccagggagtggaagaagcgggaaaatacatggcctgtttggggaataaggtctcttgagagtgttgggttcaagggtgtagtacatataatgggaagtagcattggaaagatgggcagacataaagctagaagtcaagtcagaaaagtgtagggccttgaatgctgtcctaaaaaggtgggacctccttttgcatggaatgtttataagatccgctcttcaggagattatcaggagattagcagtgtaaagattgcactggaggaagacagaacagcaggcagatctgataaaaaaaaaaaaaaacttttgtggggttgggggagggggaagggatagcattaggagatatacctaatgtagatgacgagttaatgggtgcagcacaccaacacgacacatgtatacatatgtaacaaccctgcacgttgtgcacatgtaccctagaacttaaagtataataaaaaaaatatataaaaagataaaaaaaaaacttgtggagtaggccagacatgaggtgataaacagatatgacggaagaatctcagatattgcaaggcaagaatccagagggatgggtggttgactgatcctccctttgttttttatggtcaaactgcagtctggagacagaggaaagtgggaaagttgaaaacgagacctgatttggcagaagaaagagttagaaaaaaacagggaaaataatgtggcagtaagttagattggagacacttagactttcctaacttgaatcgtcctcactgactttccttctcccttggccacttctaaattggaccctgatctgctgctgcgagtgtgtctgtcactaacacaaggcacaatacccttaccagtgatgtctctctgagaatgcccttactggggatgtctatctgagaaaatcctacttgcactcaaagacagagttcaagcctcacctcggaaaaaacttttctgacgcctaccatttagtatatatgactgtgatggcatgattgcactaatgttgtatctttgtttttccatctgtttcccccactagacagtaagctcttccagaaagaaggggatttggatcctaattgtctcttatctggagcacccaacacagtgcctggtacatactaagccttaagttaatgcttgattaatataaataaataagtgggtgagtgtggtagacattcaagctgggaatcttctaaagtcattaggaaacatgagactggagctttagtaatcatagtatgaataggtgagttttagcccacagtgttgcacacccatctaagctagagactagtgttgagctgttcacttacctaactagggaggtggcagggtggcagtttctattggtaaaggtaggtatgcaaagtgtgggtgttcaaaagcactgcctgttttggatggaggaaggtgacaacaccccttttctgatcattcttgaactgttcacacataatggtggctaacttgtttattttcatttatagtgaaataatgtatttcttccatgttttgtcccctctttgttgctttcttgttcattttaggacctcaagtatgtgttgcccagtctctgatttaagtaatgagcttctcttttccaattctatttaccatactagtggctgggatgaagcctgtggtgaatatcctgtttttatcttttggctgcctttcaatttaaaaaaaaaaaaaatcaagtttatgatcaaagttggttacccccagatgagtttcccacgtgcattctctttctcctggacctcatggtactgaatgacacagatgaataagtagattattcagtcagctgcattcctaaagtgagtgagtgctttaggagataaaataggcacccccgtcccccttcaaatacctttcagaatttgaataatagtttcaggtagttgtaggtatacctttctcagcaaagatctgtgtttagggtttatgtatagttaaatgagccggtggagtggtttcataattgcagtattgttagtcaaactctgtaattagagatgacttcataggcataagattcttctatgggtgacgccctgaattcatacccaattgtacactatatccttttatgaaaaaacaaacaaacaaggttttgtttgcttttgttttactcccttatttgaaaatctgttttcctgtgtcttatatgtttagtgaagaagggctggcttttttctacagctttcccttttcctttacagaaatggcaggcataggagctaaggaggaaacagaatttgggacagatcaaagtgctttgcagatgagcgaattcagaaaaacgtagagactccaggaggttttatttttgataagtattaaaattgctgagtttaaatggaggaaaaatatatctctatttctttgaatgtcagttctctttctctctccctctctctcatcatgtaaataaagtccgcttttgcttggtggcacacatctgtattctcagctactcaggaggctgaggcaggaggattgtttgagcccagaagattgaggctgcactgagctgagattgcaccactgcctgggtgacagagtgtaaccctgtctcaaaaagaaataaacacataaagtccacttttgtgggaagacagactgggaaagaggacatatttgaaaatcagggtttttttccttttgcctgtcaatcacatattgtgaaatcggggttaaacttttattcagcaagtaatactttctcttcacctttttctagtactcatgaaaaaatttgcaaattaggaggaatgtgacaatattgacaagctgttagctattttgaaaagtgatcctaaaatatttaaagaaaaattgttgtttgtttgtatatctcctgtctgctctttaaattgtgtttagaaactggccttacggaggaaccaaattgagtcatggataaaaagtgactgacaggttttcctttaggcccatccttcttaaattactttgactaaagacttgtaatttttatatatgagggagacctattatactctgtagtcagtaattatagggagatgagataacttttcatttatcccatgtaaaaggctattagtagaactaatgccttatatttatttatacagctcttcacaattaacccaagcattcatttattccctattttctttcatgaaggatttgaagttgctatgtaatacttcatagttcacaatatgctgtcatacataccatctgtaatcttcattaggacctgggggaagtaggtattattatcactattttcaaatgaggaaacttaggctgagacagattaattaaacttgctcatggacacattactagggaatagcagaaccagagcaataatcgatgccttctaatttcacgtccaacatctttctgttaaaacatactacaaccttgggcgcggtacaacagcttggtgtactggtacttgagattaaatgaagtgtctacagggcagtattgatgtcaaatcttgtgttttgctttgtgaacccatccgggatgttttagtaactttaagggaaaaaagtcctatagtacaatgaatgccccatgaagaggaatagagcttctgttattttaatttgtaagatctttattttttaatatcttcactcatttccaagttacttaatgtgatgttttctctcaagatagtactttactgcttgacttccttaaagacaccatcaagtacctatgagtagtcttaaggacagaccattttttaattcatagtggcataaagaaatctacattaaacaactttattttaagcttcaaatggcaaaatgtacaattgtatcagctagagcatatattgtgagctttttaaatttggctttatattttttagtcttggcccaggtacttcagagtagcatttctttatttcctttcaaataactgtcaataaatgaatatgggtttatttaaattggaaagtcctgcattaaactattctgttatcctgaaacaaccttgtctggaaatacggttttaaggatatgtgcatgttccaattccttctttttgttctcattgaagtgtatctctttaatgtctctgatagatgggaaatctgagttacatatgcaaagtcactttaggctttttaaaaggcaattagaaataagaaacttgaaaattttaaaatatatgtttaatgcactggattaatttttggactaaactggtgccctaaaattatttctatgagatctaagcatttcttaattcatttttattttttactttttttattgagacagggtcttgctctgtcacccatcctggagtgcagtgacgttctcatggctcactgcatcctctacctctcgggctcaatcggtcctcccacctcagtttcccaagtatctgagactacaggcatgtgccaccacccacgatgcccagttaattttttgtatttttggtagagacgaggtttcaccatgttgcccaggctggtctcgaactcctgagctcaagcgatctgcccacctccacctcccaaattgctgggattacaggcatgagccagcacttgctaattttataggaagaaaaaaagaactgcgtttctggccactctgagaagaaattaataatccttaaagtctctagagacttttttcttctaaaaaaatggatatttgtaccttttattgcagtcactaattcactttatgtcatattgtaattattcatgtttgcttcgcagattgtaaattccttgagggcaagaactaggtgtatagcagatgtctaaaatattggtaaaattgtttgagaagtagcggggaggggcaggttggggagaaagagatttctacaggatttaatcagaacccaactggtcagcagggataaggggggcggggggcaggaatggtttatgtccagaaccatcttatctaatttcttttttttttctttcttttttcttttcttttctttttttttttttttttttttttttgcagtgatgcactgatggctcactgcagcctcgacctctcaggctcaagtgattctcccacttcaacctccagagtagctgggattacaggcacgcaccaccactcctggataagttttgcatttttggtagagacagggtttcaccacgttggccaggctggtctcgaactcctgggctcaagtgatctgcccgctttggcctcccaaagtgctgggattacaggcatgagccactgcacccagacctaattttcttttgcatagaagtgatatggtagtgtgagagtaagctcagttgtataggtttgttttagttgttttttacccacatactttaaattattactgactcactatctgcccaaactggaaaggacctttagagataaaggagagaggccacatgttttagatttctgagatggtcttacttttaaattttctgtgccattgttctccttggtgtgtgattcatggagatgtgtaataattctttattaaaaacatgattgcttaaaaggggtgaagaaaattggaataaatcctatgtcgtatttttgtaatggggagtgttgaacatattagtgaaacagaatatttttagaattactactattcgtttgcatttaacttacgaattttaaaaaaaaatttttttggaggcgaggtctcactatgtttcccaggcttgtcttgaactcttggcctcaagcaatcctcccgcagtgctgggattgcagttctttttattcttaatctttaaaatgcctaacttcaggcctgggcgtggtggctcatacctgtaataccagcactttgggaggctgaggtgagtggattgcttgaagccaggaattcaagatcagccagggcaaaatggtgaaaccccatctctacaaaaaatacaaaaattagccaggcatggtgtcccacggctatagtctgagctacttgggaagctgaggagggagaatcacctgggagggaggagcctgggaagtcaaggtcgcagtaagccgtgatctcaccactgcactccagtctgggctacagtgtaagaccctgtctcaataaacaaacaacaacaacaacaacaaaaaaaaaacccacaaagcctaacttcattactaactgaagaactttctttccctcatagatcctgagattactctgaaaggtattttcatccaacctgtctactgagaagttatccatctttagtggcatcttgatatcatacataagaaaagtttatgaataggccagctttgttttatatcttttttaaagagtctagtgttatttaatttttttttttttttttgagacagagtctcactctatcacccaggctggagtgcagtggtacgatctccgctcactgcaacctctacctcccaggttcaagcgattctcctgcctcactcaacctcccgagtagccgggattacaggcacccgccatcacacttggttactttttgtatttttagtagagacagggtttcaccatgttggtgagactggcctcgaactcctgacctcaagcaatccacccgcctccacctcccaaagtgctgggattacaggcgtgagccagtgcgcctggctgatggttttatttaatttttaaaacaccagtcactgtatgtgtctgttacattatggtaaaaacttagctaatagcatcatatggtcattttaaaacttctccaggatttgagaaacctgagtgtgaattccagtcctgagagcccaggtcttctaataggaaaaaaaggagattagaatatttagctcataggactattgtgagggtttaggaaattaatatgcaaatgaatttgtataatgtattaataatacttggtgcatagttgttgaagggattaattttattaaagttctgttttattgagtgccttactatgtgccaggggctgtgataaattctagaaatagcaacaattctgtgaaaaagatagatgtagcccagctctcttatgaatccctccctaccacttccagcccctacctctctatactgagtgttacacttcttggccaaaacataagttggtgagtaatttgttgccttttaataaaatgtctaaaagggataaatgtaagatctcaaaatgtattttgtatagtttgtgaaatttaacccgtagtatatttttttggaaaggcaacatctttagggcagtggaactactctatgtaatatgttaatggtggatacatgtcattatacatttgtccaaacccacagattatacaacactaagagtgaaccctaatgttcaccagagtcttagggtggtaatgatgtaagttcatcagttgtaacaaacgtaccactcaggtacaggatattttggtcaatgactgatcgaatgtatgatagtagtcgcataagattataatactatattcttactgtaccttttctatgtttagatatacggataccattgcattacaattgcctacagtgtttactacagtaacctgctgtgccatttgtagcctaagaggaataggccataccgtatagtctaggtgtgtagtaagctataccatctaggtttgtgtacgtgcactctttgatgcttgcacaatggcaaaatcacttgacaatgcatttctcagaacacatctctgtctttaagcaacacttggctgtatttgggaactctctgtaacttctgcttgattttgctgtgaacctaaaactactctaataataatgtctattggccgggtacggtggctcacacctgtaatcccagcattttgggagaccgaggcgggaggatcccttgatcccaggagttagacaccagcttgggcaaggtggcaagactctgtctttacaaaaaaagagaaagaaataaagaaaaataaagtctaccaaaaaaataaatcagaagagagaaaaaacccaaaacaaaaaaggagaaaggaacatgtaatcattttcatttttctttgtccaaaattattgttataataggtttgcatttggaaattatctactgtgatacagacctcctctctttattgccaggatcagcaaagtttttccatataggttcagatcataaatattgtgtgccaagaggtaaaatcaagaatattatgatattaatatcaaggatataatatattatttctatcagtttttattgacaaaattcaaaatataataattgagtacaattttttggtaatacaattctgataagaatagaattctttttttctgggataacatttcacttaattgggttcaaagttaatgtgcccccatcatcaaaatggactgcaaaaattttcctttaataaccatatccagcttgaggtcatacaaaaacaactggtgatccagttttggcccacaggccatatgtagtttgccaacctttgttctgttagttaaatagatcaataaggccaaattggaaagggtgtatactcagataatataataatttacatgcataagaatgtgtatattagcacacatgtgcatttttatatcaaaaccagctataatttgttttgtttcctctttattcttcctttaatgagagtgattgatagatgtcagtatgctatttgaaaatcaatgtcttcacagtgaatgattctaaagtggcttaatgggaaaatgatactttccgtgaatcattggtcacataatattgacctttagctttggctcatataaccaagaatttctattatgtagctttttcctgtcactgctgggtactttggcccttccttaaactttttgaatgtaatttaagattttgtccttagaaggaaaattcagaaatattttttctcaataaattttggtaagtgatgacttctcatttgttttctttattaaagctgtatgtagagacatggtaacctattcagattgttttgatagtttgaaattctgtttaaattatccctaagatgagaacttagcaagagtgcttatatttatcacaattttttaaagtctgaaacgtttttggtttttctttagatctttaaatggatgagatggctaccactcagatttccaaagatgagcttgatgaactcaaagaggcctttgcaaaagttggtgagtattttttgtagtaaaactatagggaagcaatatttatttggtctcaaagttatttctctataaatatcacatgaatggttaatcaaaaacattagggcaagatagttaaaatagatgggataaagttttggaagctatacttaaaattgttttatttcttttttttttttttggtcgagtggtagctgatattatttccaattttatgtagtatttaatatggtcaaattttttagaccacagttccaatccttaactggtgactgttatgtatggttcctgaaattttcatgccaaattttagttattattatattttgtatctcatatctttctgaagaggtttgaaactttcaccatattctcaaagggatatgtgaccctcgaaaacattagatgatgttttacccttccttaattagtttggcgttattgacttttttatgggttttctgtgcctttggttactgcagatcgttctacctcgccacgttaaattatagcttcagtataagatgagaaggcatagcatgctatttgatttatcctttatcatcatataacatgccttacaattgagcagctatggaaggtaaatatggagtatttacattccaaattttagtgcttgggtcaagtctatagacaataatgagaaaacagggtgagaacagcctacttatgtaaatacatgaatcaacatgtgcttagagaggtagattattattatttggtatctccttgactgaagggtacagaattagctcatatgatgatttgttatgtaaatcagaatttgccgttagacctgtgtcgaaaatcccattagtggaaaatgaggaaatatacatttctgttcccatatatttatgatcaacattttctatgaaggcattcagtagtagcagtgtaccttgggaagaataatgaccccagccagagtgaccattcataatcccatcaaaattttaactagaaaaaactgaatattcctgaatctaacatgatcgcgcgcacgcgcgtgtgtgtgtgtgtataaaaatagcagttaattaccttgccatggataccacttactgtaagaaaaatgctacatagtttaatatataacagcaagtgaattcttggctgcaagagtttttttttttcaaaatgactctcattcagtcaaaatagtcttataattgttttaggagtgcatttttgaaccttttttaaaattaatattcatctttcagcattagcagcagcttaatttgttatttatgaatagaatttcagagtaggcaccatgccttattaagtactcatctcctcaagtaaatgctgaatacaggtcttgtcctcatgtgcagcatcttggaaataattacgtgcaatattccttaaaaattaaagttaattcagatattgtttacctgatgagacttggaatacatttgacgagtaaaagaacttcattgtcccttaaaagcttaatgacataaagaggattgaccaattatcttcatagaggaaggagttaaattgtattaagtaagggatcaatgagaagtttgactgcaagaaaaggtcattgtggagctattgtttaagtagagtttaagataggcgtacagtttgccaaagcccctgccaggcatatgttcctaacatactcaggctcttattactatatatgctgtaaagaattctggaatccagaatttctgcctattgtgaatattattcttttgtagtctccactcagtatctagcatagtgttgcacacatgttaggttctcagtaaatatttcattgattgaaacccaaggaactatatacatagccttttgatgtactgggatttttgtcattatcaaccatacattcagagggcctttgttgtgaagattttcattacagtggaatttattattaaaggtttttgccattaaattgtagcatataaaatttatatatatttttcagcataataaaagcttgtgtgtacactccatcttttagaaactcatttaaggacccagccgagtctttcgattttctttaaaaaatctttgtagttttaagttgttgttacttacagaaccctcaggcaaccgtcaaaggtgttatagaattttttttctaattcagggacactttattttaaaaacaagctctataacttattatcctgtgaaggacagtttttcctttttgtgggggtgggttggcagagaataggaaagactactttgtctcagttcaattgcgacaaaatatggaaatcattagatgattttccccatctattaacaataatagccttgattatctccttagaaattcagcaaaatcatagcgtgtggagaaaatctctgtaattactgctaatcataggttttgttcaatcaattaatagtgctttgaaactctctttactagcaataaattgagtattagaatttaaagttctcttttcactcactttctgcacctgcttagttttaagctccaagctcatgtaattattttaattttctcaacaattgtttccagtgcttcccagtagcagaaacgttagttatcagtttttgtacttcatgatgtttcaaatttaatttaaatgctgtaatacataactatttctaaagaagaataaataaaacctttcaaaacacttaggtattaatattttaccatctagaaactgtcttttacattctaagcctttaatcttgctatggaaactagtggtcatttggatgattacttgtcataaagaaaaattcatgtaatgtaaacctttgcagagttgctttagtactgcaaacacttaccttgccttgccttttttccctcctgagcactcactactgaggttttttaaacatgaattcagcacttttgaaataaaagaataatgggtttcttaaatgactaggaatagtatgggtgtattcctttgaggtttcccaccaaactaagcaaaaaaaaattggttgtggtgattgtagctataccagacttctctcatcctaggaagttgagttgtttcaaattacttgatattcgctagtatataaaaaccacatcaggatgatgccacaaaaaaaaacagtgctttagtttaatttactttcagtattcaataaaagaacaccagtgcatatttgtttaattatgccttaaaacaaaaacaaaactatagcccgtctaaaaaaaatgaaactaatcagtgctctttcattgtgccatctggttaattatatatggattattagaagtggaggtctcgggatagtcggaaaaccatgtttcaaaggtgtggaagctagttaggagtacacatgtgtgggtgcatgggtaaaagcaatttttatttttatttttatttttattttgagactcctgggctcaagtgatcctcccacctcggcctcctaaaatgctgggattacaggcttgagccatggtacctggccagccaggtatattttgcttcatgcactagatgcgttcctgaaaatcagcaagccaactgtaaatggattttatgtagtgggatatattttaaatgtaaagagaaaatcttatttttttaagtgaagcctgctttgaatttttttatttttttatttttatttttaattattttttgtttatttattttttttgagacggagtctcgctctgtcacccaggctggagtgcagtggcgcgatctcggccactgcaagctccgcctcccgggttcacgccattctcctgcctcagccaggtggcagactacaggcgcctgccaccacgcccggctaatttttttttttgtatttttagtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaaggtataagctgtgagaagcaaaccccatgtttagctaagcatctggagatgtttagcagctgccttttctaaggatttaatgcctaatgaaagcttgatttcactgcttagatcttgggatggaatatagtttaaattcttctgcccaagtcttttgaccgagtcttttaagtcagtattttgtgagctttcatgggcattcaggattgtgtatgtgtgtaaacccattattgttagataaatagattccttttgtcatttctttagtgcagaaaatttgtagaatatgttggtcaaaccaaattgaacttttaaatccagcttttccaaaaggatatgcatctgcacttgctaggctttcttctttaagtcctaatgagcactgtcctgagtgggctaatagagaggtcgcatgtgtattccagatgagggcacacaatatgtgacctcttcataaagaaagacaccagatttagacagattcaaggatgtttaaagcaacacacacacacacacacgcatacacacacaacccgagcgtcaaagaaaatcctagtctttcttactgtcaaatttatgagacaaagtagcaccccaaaagacgcttttgaagtgatagattgcagcacgtaccacctggacatgggcagtgtaaaacagcagctaaaatcaaaaccacttggattctggcttagctttctccagacaagtacttaaaatagcttaaataacaggatgcaaggggagggaaaacatttccttttaaggatatgcattcttggtgtgattcaaacttctgcaggaacatggctgtgtaataagtttatttactttaaggtttacttaggggagggcggcgggggagttaaatagtatttaaaataatacttggtaaaagagaataatgagatttcctttaaaacaaaatgcagatgtgaacctacacgtgtcatcagagagagagagagagagagagagagagagagagagagagagaaaggaaacagtccttttaacagttgattcttttcttatgaattcagtcagtggccaatatgaaaaatgggcctgtctggtgcagcactgggagctgcgtagtgatttttttttaagtatcataattttcttcttttaaaaaaaaacgctttgtcaatttactcaaatttagccctttactttctgccagaattgtgttcagtgataaggtagagtttcctttatccagcttctccttaatgtccagccatactgaccatattttctaaaccaaaaggttgagaagtgctggcattgaaactgcactgcacaatataggcagtatggtaatttatgtctgctttatcagctggttggaaactatgatgctgaaacagaagagtcttcaaaacacagagcttttcccactccataccaatgtatagttaatgagaaaatggcaagtgagccaaaaaggtgttgcagagtattggcagcatgaatgagaaaataaaggactgccatcattcctggtggttgtgattttagtttccagttgttaaaacgacttccaatctaggtatgttattttgggtcagtttattattaagttctcatgtttatgtcaaaactcagaataggagaaattcaccatcaaacatactgaacagcaacattctaattccaatgctctgtttttaaagtggacactgtaaccacaaataaggacatagtcttatgatttcaaaaaattaaattgtctttttgaaaaaccttgccacattattcttattctcattttgcttttgaataacaaaaaattatccaaaattcattttgggttatttggaaatcattcaggtacctcagctattttattttacacataaggaaaacatgactcaaagactatcatttagccagtttgtaaaacgaaactacttttctccgatgtagaaaattagattgaatagtcatcagcatttatgtttattttttaaaattacaagttagtcttagaagtagactaaaagttgtgagcacctgatgagatggaagctttctaaaatcccattatgctacctttttactggccttccaaaccacgttagatctttgatattgtttaaggatgtgtttttggttttttgactgagggttcgaaataaaattagcataaaactctttaagaataattgcatgctattttgtctctcaagtactttaccagctgggaggttttgtaaaattaattgctagctgcatttttaggctccctctgccttcttgtttaaattgaaattattttcttcaaaatatatgatttaagagctctaagaaaggcttgataaaattgactctaactaacactaaaatgcctttgatcatgggaggtagtgtaatttggactaacactgggggctaaactatgggaaaatggcagaataggtaaaacttttagaagacgacgcacattcttgtcatccaggaaagcctaaggatatgtattcgaagtgactcaaaatttttacaaggattttgtagccacagtttcaagtaagacccaggggttccgtttgattcatttctgtatctttggtatgtagcccagtgggtgtcttcccacagggtaggtactcagtttgctctggagggtgactcatacctaaacaagtgcacatctcctttctcagtaaagccaaagcaggtttctacatttggaacaaaagagatcctgaccagagagctatcactggtggtccacttgggccctccttgatgggtgtgttcacttagaaaaccaaattacagatctgaaggctgctgggtagggacaggattagaacaaagggaatgagattgaatgttatttaagggatatttctgtcaagttttggtttctcgatgaattgccattcagtctttgagtgctatttctgtatttctgtcattgttgtttagttttgtttctaaaatgctcatctaggattagagcattctttctttggtcaattcctgagaatcagtgattctacaaaaataatttttttccattgcttattatacacaaaagattgtgctacatattggggtgggagatacaaagatttaaaagaatctttatcgggagatttgcagcctaataaggaagtttgtcatgtaatgacaaattcttattcctccaatttcctttaaaattttcctgtccctttctaaaagcatttcttactactgcccttacttcaaaatgaaatttccaaatgtggttattttatgttaattatgttttagggtggctacttcctggcatcttttaatcacatcagtgaactgtcttctaattaatgttcaagagaggttatttcagggaggatacaggcaaatagtaatttctccctgcgacccaaacttctggagttttttgtttttgcttttgagacagtgtctcactctggtgcccaggctagagtgccatgatgccatcatagctcactgcagcctcgaaatcctgggctcaactgatcctcctgcctcggcctcccaaagcgctgggattacaggcatgagccaccagtcccagccaccagacctgtagtctaacctaatacaaataggcagccagataaactttctgggccttagtcagtttcatatagctttgaatccactgtagttctcccacatctaatttaaaacatctctaccttccacttccattataacactgagaatacaaaaagaacaaatcctgttacatacctgttatatactccagtctaaactagagtcaaagcacagtggctcatacctgtaatcccaacactttgggaggccaaggtggaaggatcatttgaggccaggagtttgagattagcctggtcaatatagtgagaccctgtctctacaaaaaatacaagaaacaaaaagttagctgggcatagtggtgagagcctgtagtctcagctactcaggaggctaaggtgggaggattgcttaagcccaggatttcaaggctgcagtgagctatgattgtgccactgtactccagcctgggcaacagaatgagaccctgtctctaaagatacttttttaaattaaaaaattggctgagcttggtgacttatgcctataatcctaccactttgggaggccaaggtgggaggatcacttgaggccaggagttcaagaccagcctggccaacatgacgaaaccccatctctactaaaaatacagaagttggccaggcatggtggcactgtaatcccagctactcaggaggctgaggcaggagaatcgcttgaacccaggaggcggaggttgtagtgagccaagatcatgccactgcactccagcctgggtgacagagtgagacttagtctcaaaataaagaaaatagcttaaaagaaaaaaagaacccactgaagtggacaacgttttgatagttaaaagaataagctatctcttcctccaaagatatcataaaaatgaaagaatattatacttaggtaataaggtgcagtagtgatcagaatgttatcactctgtatctgtatttaatatgcgttactattctatctccaggttttaaaagtgtttgtgtgaggggagggttgtgaagtcttgtgtattctgatttagaatcagtgtgatagaaccaaaaaggaactttagagattatgtggtccaaagcactccttttacagatgagaaaactaggacctgaagaggtaacttgtgcaaattaatagccaagttgagataagacattgtttcacattattcccactgtgtgtctcttcaagcatgtatgctgtgtttctttcactatgccacacttactctctagtactgaactccactgtaattttagaaaggatgtaggaaaaacaagttggtatatgcatgggagcaggtgtatttaagcccaagacattcataaaacaagagccactaaaattttgcctcagtgccatggggattactttgttctttttagcaactgcagacattattgatggattgatttctacatagaaatactttacatgtagaaataaagagtttgatgtatgaccttttataaatccaaagcaaagaaagtgaatatacatcctagggaaattaagtgctttacctcaaaggaaatctaagtgattttcacactaagtattgaatggtttgttattgatgttttaaaagtacagatattttaattagccaggcatgatggtgcccacctttggccccagccatgccggggagctgaggcaggaggattgcttgagcccaggaggttgatgctgcagtgagccatgctcgtgccactccagcttgggcaagagagaccctgtctcaaagaaatacaaaagtaaaaataaaggtacagatgttttaattcatagatttaaaatgtagtaatcaatgtttaagaaaatttaatacttaaaatagactgcattaaaactaaacagaatttcatcagcattcaaaatatttgcaagatggttccatgcagtatacttaatattttaatttaatttaatttttaatcccccagagcattcttgcaaattgcaattttagtaattgaccaaaaattggacaatgtgaactacacgtagatcacacttagaaagaaatgtcagtgtattccatggaatacattggcctagcagagcttataagatcagctagctccccgaccttatctctcattttcccccttgttcactctacccaagtcatattggatctttacttttcccgaaacacaccagacacactgcagcatcactgactttgcatttgctattttctctacccgaaatctcttgccccagatagccacatgatttgcttcccttacctcatggaagtcttcattcaaatataacctcatcaaagtggccttccttacccattctgtctaagtagtagcaccaccaccatccctgccccccaatatctctataacccagggttactcaacttcagcacaattgacattttaagctgcataactcttgtgttgtacatacaaggaaggggtcatatccattgtaagatatttagaagcatccccagcctctacgcactgtatgccaggtgcttccagttatggcaatcaaaaatgtcccctgggggcaagatagccccagtctaaccccttatgcttttttcttttttttttcttttcttttttttttttttttttttttttgagatggagtcttgctctgtcacccaggctgcagtgcattggtgcaatcttggcccaggttcaagtgattctcctgcctcagcctcccgagtaggtgggactataggcgcccaccaccatacccagctaatttttgtatttttagtgaagacggggttttgccatatgggccaggctgatctcgaactcctgacctcaagtgatccgcctgcctcggcctcccaaagtgctgggattacaggcgtgagtcactgtgcccagcctgctttatttttttattttttattttatatatttttttgagacggagtctcactctgttgcccaggctggagtgcactggtactatcttggctcactgcaacctccgcctcccaggttcaagcgattctgctgcctcagcctcccgagtagctgagattacgggtgcccgccaccacgcccagctaattttttgtatttttagtagaaacggggtttcaccatgttggccaggctggtctcgaactcctggcctcaggtgatccacccgcctcagcctcccaaagtgctgggattacaggcgtgagccaccgtgcccggccacaatacattttcttaaatgcgctaaggtcatcttgagtcatttctctgttcaggttgtttccttctattataattaagtttacatatgaaaatcagtgagacctaaggaacagaagatatttgaaattacttgtgaacatcaaactttattcacaggaaaatatatactcaagtggttacaaccctcaggacattagcctttttctcaataaattaacttttggtcattgatcaggttttttttttctatttttaaaagcttcagaataaacatcattcatttaatcagcacttcaagacatactctgagaaacttcagtagtacaaaaattaaaaggttatttatagagtcatattaaatatctgctttcctcagtagtgcatttatttttataaactctatatttgtcttgaattaatgtttgtttacattaactcttaaaataattggcactgaacatgactgcttaatttcaggtgtactttgaaacagaatcagcattaagttcatataagttctttttggagcaatggaagaataagaaacacaaaattcctatacttacagtagaaattgttctataccatggaagtgttttgtaggtttacgatctattagttctttttttaaaatcctattagcgccaagttaataataattgtattagccaactatgcttccttgaacttagggatgctctttttaagtaaatctacttacacattgcttaaatcacaggatacatgatgtaaaaccttgctttttccatttaaatgtccatttccctttcaaacaactttatgttccccacaataagaaaatattttatgtaagtgagcttatgaactgaacctcaaatgaagggaaatactctaacttctgtctttcaattttttttccttttttgcttgctctccttttttacaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatgtaagtatgtgaaaattcacaattattagaagtagtagatgttccctcgtctagtgggatgttatagtattaagtactgttatgttaagttcttaaatatatcatattagtactgttataacatttctgtcatcctgcccactaaatgtacttcttttagctgctggaatatcttaacaaacgaattgagaaaaagagcactgcagaaacaaagatataacatgataagatgttaaggtgataagttatataaggcgaacagtctcctttcatgtcatcattaaagggcagttatcaaggtgctaagtgacatctttgaagtgttctctctcccgtggtgaacagtgtgctccaaaattttaataatacaccctgactcacagtctcggaagcttcctgagctgaactttctcattaaaaagttgttttccactcttgtggtaggggtatttaactgaaccattctctctaggatgataattttgataattaaaagtttgaagcatatcttttcagtccattggaagaggcatttaacatttttgttttcttctctagtttcatcaaatattcttcaaggttaggggctgagtttttaattctttcacccccccaccccactcccagaacttagtttggtgttctctactcagtgcctggaaaatgtatacatggcacatggttcttcaatgcctaccactattggctgctagcaagtgaggtctagattttttagacttatgccattttcagtctgtatttattgacagtgtatttgagatacgtgttaaaaatagctggctgggtgtggtggctcacacctgtaactccggcactttggtaggctgaggcaggagggtctcttgaggccaggcattcaagaccaacttgggcaagttagggagaacttgtcagcttgggcagcttagggagaccccatctgtacaaaagaaaatttttaattagcccagcctggtagctcgagcctatagtcctagctactcaggaggctgaggcaggaggattgctcaagcccagtagtttgaggctgcagtgagctgtgataacaccactgccctccagtctgggtgacagagcaagaccctgtctctaaattaataaattaattaattttaaaaataaaagaatagttgttgcttcttccctcaattaaggatacctttaagattttattggtgtatttattattaatttaaggctgagtttgactagatcttactagggattcctttcagtatatcacaaactagttatcagtgcctaatatttatcacaaatgtcccagcgctcctatcctcctttgtcatggtttatttttccccaagacaactgaaacgatagcatgtacttccatcagtaactgtggctcaccatagcaagtgaaattttgaaatgttctttccaattagaattaacacctttagaacactgtagtagtccaagaagcaaattgactaagtaatgatgcctactcagctgacagcattttgtgattgtttttaaaatgcacacttgtcggccgggcacggtggctcacgcctgtaatcccagcactttgggaggccaaggcgggtggatcacgagctcagaagatcgagggccatactggccaacatggtgaaacccggtctctactaaaaatacaaaaactatctgggcgtggtggtgcgtgcctgtaatcccagctactcgggaggctggggcaagagaatcgcctgaaccagggagtcggaggttgcagtgagccaagattgtgccactgcactccagcctggtgacagagtgagactccgtctcaaaaaaaaaaaaaaaaaaaaaaaaaagcagacttgtgtcataattataatgatatcgttcctgccgttttcttttgaaatactgatttcctcccaccatttttttgtctccagttatggccaaagccttttgttttgaattctatgttcaatagtaagttgcagtttatttgcaatttgagcacttgcatgttttctgatgtatcacttgctccccttttaactgcatggttaattgtgaatttaaagtagcgcagagcagcagttaactatgattggctgtttttgataaaatgtattgctcagaattttttaatctattagaaagaacagaccaaaatcaataggatttgcagtgtgtcattatattaaggacaaaattgtaaaagtgtctttgaaaatgatcttggggaaattgttaattttgtagattttgaaatgtagtttttacacagctatttgtggcttttaagggaggaggtgtgattaccttagtatattctttaaaagtaaagaacatgcacaataattttggcaacaccagggctttaagaaaacaacattcgtgaggacattttaggttagaatatacattttagaattggaaggaatcattatgtttacactcctacacttttcaaatgaaaagaaacaaacttggatttctgaaaaaggaagtgacttttcctttttgcctaacattacacagaggactagtggctttttccagtacctccctgctattcaagaaatttgaaatatcaaggacagtaaagtaacctacctgaagttttcagatgctactactactatgactgtattaaccaaatgtctgtccgcacccatctgccttgtcatcagtgaaacatcttacaaattgtcaaacaaaatatgggtagagcttagttatccaagaaatagaaatcatgttattcctgttagatattggcataaggaaatagatacaaacatgttcttgcttgttaggtttctgctttttctttgaattgttgcttaaggggtgttaattgcaaaccagactacaaacaaaaacagtttatgttaatttcagagaaatgtctgtgtgtgtgtgcgcgcgtgtgtgtgtgtatggcaaaaaacagtcccaaaattatatgtatgtaaactttaaaggtgaaaattaaatttaataccctgctttttaaaattctaagcacttcaaaactaaaaatactggatttttatgcttacaagataatgggactttttttctttgattgttaaactagtatggcactttcagcagagaagtaagctgcccagaacagtcttggacatatagtaaatactatataggtgttagttgctggggtagttctttctttaaaaaaaaaaaaaagaagttatgtttttcaaatattactaagtttaggcctacaagacattccaaaataatggaaaaattcaatcctgcctctttggaaacattttggaaataagccccaaacactggaagccagtcaattctttttttgcaattctttctgaaatctttctttcttaagtcatatgcctctggattgttttggtttggccactcgtcctgtgttgagctaactctggggtcaaaagaagttagccggttgctgagagtctttgagagaaagaaggcgaaacttaataaaaggaataaaaaacatatatattccataacggagactgaaaaagatgtatagatcaagagtggttatggcttcctgaaaaaagtacagcaggagttagctcacagatgataaagcaagtctttccttgtggagagaaaacagcacaaaacagtgagctcattagtatcacaacgggcagctttgaaaagattcattgagaagactccagcacagtagtcagccttgtgctatctctgatttcagagatttcttgtcaagccaaagcttgtactcaaatagttttatcatccacttaagcgatttctttactaaagtagaaagtaaaatgcaaattcttgtgtagtgaatcaatatcatagacacaaatcttcagttctttcttatcatttttactttttttttttttttgagacggagtttcactcttgttgcctaggctagagtgcagtggcgtgatctcggctcactgcaacctctgcctcctgggttcaagggattctcctgcctcagtctccagagtagctgggattacaggcatgcgccaccacgaccggctaattttgtgtttttagtagagacagagtttctccatgttggtcaggctggtctcgaactcccgacctcaaaccatccgcccaccttggcctcccaaagtgctgggattacaggtgtgagccaccatacctggcccatttttacttttttaaaaccaagggaatagaggaaaatactatgaaactaaaagtttaagcttagctggaataatttatttgaaacaatttagaaaatgaaggtcatgtaacttttgcaagacctttgaaaattaacaaacttaattacaactttgcatttcattgccaagcataagaaggagttttactaaagctatgtaaataattgcattaggatatatagcagagacattctatatatatgtatatatatgtttaatttattttcctttttttttttctgagacaggatcttgctctgttgcccaggctgaagtgcagtggcccatcttggctcactgcaacctccatctcccgggttcaagtgattctcatgcctcagcctcccaagtagctggggttacaggcatgcaccaccacgcccacctaatttttgtatttttagtagagactgggtttcatcaagttggccaggctggtcttgaactcctcctgacctcaagtgatccacccactttggcctcccaaagtgctgggattacagatgtgagccaccgtgcccagcctacttttctagttctagttattagttcgaattcccagacgttctcttttttaaatatgaattaatccttttttctgtgacataaacaaatttggatttattttttagctgaaatcatgatcattgaaacaacctaagttttagaagtaaatgattcttgaagcagaagcactcgtaataagaaaaataactttacatatctcattctgaagctgtaacacttttgtcattgcagggacttgtggtatgttaggcatgaagaaatgcacacctttcagattttaacttattagacaatgaagtagagttcagaaagaagtagactagtgactattgtcttttcacagagcagctgcgttgttatcaaaaggagagctataggatcaaaatgcatcacagttaaggcacagttggactaaaaaatcagattgtaaataaaaatattttaatcatttgaaaactgcctgaagtgtgtgcgtaagctccatactgttgatacttagtgaaagtcagtataatggccatagagcaggaagggtgatttcattggttgtgtttagtatttagagtagtgtgtatgtgtgtgtctgcatacatatacaaacatagacacacacagacatttattctaaaattccacctccaaaattactggtaaagctagcacagaatcacaggtatggaaatactgagtaagcttgattttgtaaaatttaagtgcttactaactattctctcaaacaaaattttatttgtaagtccaaagaaagttaggatttaatttaagaaaggtaacaggaaaaaatgactaagtaatagggccactgacaacacatacagcaacttttctaccagttactaaaagtcactttctctagatggattaattacaaaaaggtaccctcctggaaagacaaaatacaacaaggcactcctttcggtctgacacagtcctgtgcgagacacaaggcttggttagtatagcttgggctggatttctgcttctgctcgtgcctgctctgacacatacaacctgaactgttatgtatattgtaaccctgttctatgaaccgcagacataggctgcatcttcctgagatgtgtgtgtgaatacatatctgtcacgaatgttaaaggtctttgaattgcatttgttcagcaacttttccattaagtcttaagttttctttcaatgaatccacttaaatggaattctaaacgccatttaaagaaagttgtatacggtttctacatcttgctcctgttttactggctttgactaatttagccacgcacattggtggatcaggaacacatttggaattaggtacattccaatacctcagaaaaatatagacagatagaatgtccaatcagatagctacacagtactaggatgtgaaacttactgtgttataacttgcttttgtacaattagaatgttccttactgtgaagagaagctggacttcataaatgccccaataagacaatcactgaaaagcctctttttggtgtttattcttgatagtcatctattactaccagcttaacacattttttaactgcattattctgtaacttttgatttaatgaattcttaatgagctaccccattatactgtaaaatagttttttggttaaatcataaaattttatctttctttgcattaagaatttttattaaagtagggggattcttcaatgttttctctccaggaaaagaataaagccttccttgtttgtagaaaattaacagatttacctgtgcctttgaaccacattagtttttggcttaaagtgagttcaatgcatgtagcgcttaatgtttttgacaagtgtgtgcaattgacattctggtgcttcattttcagaaggggtattgtagtacttgtttagcatttcaaaaactcaagcccagttttttgtatcttttaacatcagctatggaaaaaatgtaagtgatcaagatataaaagaatataaatatgcttattgtgcatagtttgaaattaattgtgaatcaacaaaattactttaattaatagatttttcaagaggtaaaaagtagtgatattgccaagaccttccgcaaagcaatcaacaggaaagaaggtatttgtgctctgggtggaacttcagagttgtccagcgaaggaacacagcattcttactcaggtaatcattttatatgcaataggttaacacaatgtgctaagtgggatggttgctgtaatgtcaaggacgggctctagaaaaacattaccttctaattaagaatacagtagaagtcctttgtgacatgtatttaggcttgagactaatacttgtcataaaggcattataagtgtttattgtatggctttgttagcttgcaagagacaggatacaatccatgtaatgacaggctttattacagtgcattatacagtaatataaatataatttttaaggaattttgtaacttttctgaggactggttaacgtgttctattctttttcttaattttgtaattcctaataaccactgtgttgcatccaagtgtctgggtttccacacagaataaccacatgtttctgacacattaactttcagcactactgcacaactattttaggctttggagtcaaatatttaataagttagagtatgaactaatgtcttgttatttaacataattttagaggaagaaaaatatgcttttgttaactggataaacaaagctttggaaaatgatcctgattgtagacatgttataccaatgaaccctaacaccgatgacctgttcaaagctgttggtgatggaattgtgctttggtaagatgttagcttgttttatatccagatatccaaaaatagccttccatataattgatatatttgtttctgcatgcttgacaggttcacctcaagaaataactagaatggaaaattatccaggttctgcctttttcatttaatctctaggtctgtccatgaatctaaaattcagccataaatcgacaacctctttatagggaagctctcagcctccattttcttctcaacaccaggccagcagaacattacaactttgttgaacttaagtatgtcagtgtctctttattctaaagtaccacagcttccaaaagaaaaaaagaggctactcttcagttctcactctccaatgacctatttctaaaaaatgcttttgtcactgctgctgccccacagccaacagcatcttggcagacataacacaacattatcaacactgccagtcgatgttccaatttatagaggcagtgtcacacagtggttaatagcatgctccataatcagtctgcctgacttctttctattcagtcctgccactctgaagcggtacaactgtgatcataatactcaacccctttgcatttcagtttccatctgttatgatctccacattattatacttatctcacagggcttttgtgagcattaagtaaattactacatacaaagtgcttagggtagtgcaactgacatatttcagataactatatatatataaaatatatacatatatatgtatatatatacatatataaaatatatgtgtgtatatatatttacacatatatattttatacacatatatacaaaatatatatgtatatatacaaaatatatatgtataatatatataatacatgtatatatgtatatatatgtataatatatgtatattatacatgtatatatgtatatatatgtataatatatgtatattatacatgtatatatgtatatatacaaaatatatatgtataatatatataaaatatatattatacatatatgttatataatatatgtatatatacgtatataaagtatatattatacatatatgttatatataatataacattatatatatatatatatgttgtgtgtgtgagatggagtttcgctcttgttgcccaggctggagtgcaatggcgcaattttggctcaccgcaacctccgcctctgggttcaagccattctcctgcctcagcctcctgagtagctgggactacaggcatgcaccaccacacccggctaaatttttttattattatttctttacttttagtagagatggggtttctccatgttggtcaggctggtctcgaactccagacctcaggtgatctgcccgcctcggcctcccaaagtgctggggttacagatgtgagccaccgcgcccggctgacagtatatattatagtatacacaattcttctttttgcagtagggtcattttggttgtttgaaaagctgatattaaaaatgtaagataggctggtcatggtggctcacgcccagccctttgggaggcagaggcagcaagatcgctgaagaccaggagttaggtccagtctgggcaacaaaacgagaccctgtctctacaaaaaaattaaaaattaacccaacatggggttgcacccctttagtcccagctacttgagaggctgaggcaggaggatcacttgagcccaggagtacaaggcggcagtgagccaggatttgcaccactgaactccagcctgggtgaccctgtctgtctaagaaataagaatatatatatatacatttcctttgtgttctgtttacaagcagtgaagaaataatttcccatgtgtgtgttttgtttttgtttttgagatggagccttgctctgtcgcccaggctggagtgtagtggcgtgacctctgctcactgcatcctccacctcccagtttcaagcaattcttatgcctcagcctcccgagtagctgggactacaggtgctcaccaccgcacccagctaatttttgtatttttagtagagacagggtttcaccatgttggctaggctggtctcgaactcctgacctcaagtgatcctcctgcctcagcctaccaaagcgctgggattacaggcatgagccaccgtgcccggcctcccttgcattttaatatagagagaagactgcaagtttccctctctggggactcaccctgcagaactcaaaaaatctataaattgtaaaaataataagagataatcatattgaactaactaagatttgaattttgcatggaaagaagcatggctttctttctgtagaaaaaaatttattagggcagtattatgaacatctaatatgttagagccaggcatagtggctcgcacctgtaatcccaggtacttggaggctgaggttggaggatcccttgagcccaggagttcgaggctgcagtgattcgagctacgatttgggcctctgtactgcagcccaggcgagagttagaccctgtctctaaaaaataacaaaataaaaaataaaatgttaaagtctaaatctagattttaccaaatgagatttttcctaatgagtcacagactatagcctacctaatctttctctcgccactatactgccagcaccaaatatagtgtctggctcattgttgaggcactcggtaaacatttggtgaatgaaagaatctcatgctcaactaattttactgttttgtggaaaagactcatttccaatgcaggattttatctgtctttaaaatatattcaataaagttccaccccccacttttttttttttctttgagacagggtcttgctgtgcagtgattcaatcatggctcactaccgccatgacctcttgggctcaatcagtcctcccacttcagtctccaaagtagctaggactacaagcatgcgccactatgcctagctaattttttttttaactttttgcagagatggggtttcaccatcttgcttaggctagacttgaactcttgagctcaagcaatctgcctgccttggcctcccaaattgctagggttacaggcgtgagccacactgtacctggcccaagttttgttttcaatatccaagttattttctttcataaaagaatgagaaaaaattaaaaaaaattgaaagagaaagcatgctacaatcctctgctcagagatacccaactactatgcacatattttggtctttttgggtttttttttttttaacggcatcttgctgtgttgtccaggatgaagtgcagtggcatgatctccgctcacttcaacctccgcctcccaggttcaggcaattctcctgccgcagtctcccgactagctgggactacaggtgtgtgccaccacgctgtgctaatttttgtatttttagtagagacggggttttcccatgttggccaggctgttttccaactcctgacctcagatgatccacctgccttggcctcccaaagtgtgggattacaggcgtgagccaccatgcctggccagggttttatttatttatttatttatttatttttcttttgagacggggtcttgctctgttgcccaggctggagtggaatggtgtgatcgtagctcactctaactttgaactcctgggctcaagctgtcctctttcctcagcctcctgggtaacctgtactacaggcacatgccaccatgcccggctaatttttttatcgtttttgtagagacagggtctcactatattgcccaggctggtctggaactcctggcctcaagcagtcctcctgcctcagcctcccaaagtgctgggattatagacatcagccaccacatcaggccttggccttttttatttttagtttttattttccatatgtgtagtttattatgatcaacatgataaaagtcatctagctgcattttttagagtacatgaaagagatgttatagtaagctttaaaatatttgtaaatatttacagccactttataaaaggaaatcagctctttttttttacatcagcctttttttaaatttttgtttcagtaaaatgattaacctttcagttcctgataccattgatgaaagagcaatcaacaagaagaaacttacacccttcatcattcaggtatgcattgttctcccctccctttaacatgaaattactgtttgaggacctgttctgcagacttcagcctctgcactctgtaggctcccaatcaatccttgtaaaaactgttgagtgtgggattgttatccagattatacagacagaactgggactcagaaaggtttctgagcttgcctgagattaatgttggaactgaggttcaaatcccattctaatttcaaagccccatgttcttttcatttcataatgtgttcaagcactacagagataagcagaagtatataagctcttaattaactggcgtgcttaagaaatggagcatttttttttctatcaagtgaatattagattattagcaaaattccctcagagaagagcacctcttgggatgtggacattgataacttctaaaactcttttgggcatatgcagtactgttggtctctcacccatttaggcatttttggaattataacactttactcacatggatatatttactgtggtactcagccttttcatttagtgccagcatacttcaaaaggtaccaaataaaaatacaaagttaacttctcatgagattctgcaaaaggcaatagcaataaggctgaaatttgtcttagctaggctttctaacacaaaactctggaatttgttttttgtgacacatatatggatgaaattaatacagggtattaatttcctcattgaatgttattttcagtgaagggagaaagtagactgctaaaaaatggaaaggtcaagaagcaagtgtgtaatttggctgtcttgcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaaggtaatggaacacagtcattctggcagttgtttattggttatttttttctagtcatgcagactttcgtgctctcacttaatggaggtgattaaatggtggtaactagaatgaacataaggtaatgctatagagttattcaggaaaatagcctaattacatgactctcttctttactagtaattcacatttgtctggcactttacaattcattttgcaataatgacacaaaagcacagagagattaaggagctttcctgaagtcctcaaacttgattatctatttttttctgttctgcctacacaacttctaccccgttgccaccctcagctccaccattttgcaccatcttcttttttggagacagggtctcactctgtcacccaggctggagcgcagtggcacaatcagcctggctaacatggtgaaaccccgtttctactaaaaatacaaaaaattagccaggcgaggtggcacgtgcctgtagtcccagcttctccggaggctgaggcaggagaattgcttgaacccggaaggcggaggttgcagtgagctgagattgtgccattgcactccagcctgggcgaaagagtgagactctgtctcaaaaaaaaaaaaaaaaaaagaaagaaagaaaaaaaaagagagaaaatgtaagattgcaaccgggtgtgttggaccatgcctgtaatcccagcactttgggaggccgagacaggtggatcacttgaggccaggagttggagaccaccctggctaacatggcggaaccccgtctctacaaacaatagaaaagttacctgggcgtggtggcatgtgcctgtagtcccagctagtcaggaggctgaggcaggagaatcgcttgaacctgggaggcagaggttgcagcgagccgagatcatggaggcagaggttgcagtgagccgagatcacgccactgcactccagcctggtcaatagtgcgagactctctcaaaagaaagaaaagaaaaagaaaatataaggatgaattatatttctgttaaaataggattgagccttcaagagttaattgattaattttacttaaatacaaataccaccgtgtttctagactactttaatcaaaaggttaagtaaaagattcccaaattgtaaacatctttcccccaaatccctgactttttttttttttttttttgagacggagtctcgctctgttgcccaggctggagtgcagtggtgcgatcttagctcactgcaagctccacctcccgggttcacgccattctcctgcctcagcctcccaagtagctgggactacaggcgcccgccaccacgcccggctaattttttgaatttttagtagagatggggtttcagcgtgttagccaggatggtcttgatctcctgacctcgtgatccgcccgcctcggcctcccaaagtgctgggattacaggcgtgagccactgcacccagacccaaatccttgactttagaagtgttaaataagaacaacttatacaaacatatgacataatgtgaagcttgcattaagcttaaaggccataacctcatttggtatttgaaatgtgaagaataacagagaaaagaataaattgtagtattatgttattatatctgttatatatttatcttttttagtagattatgagtatcttgaaactaggaactatgtcatagtagtttttgcacctctattacttaacagtgtcaaaagactgaatgaacttggcatgaccattattgtgtcatataataactgtgggatttttttttttttcttctagccttggctgctttactccgagatggtgagactttggaggaacttatgaaattgtctccagaagagcttctgcttagatgggcaaactttcatttggaaaactcgggctggcaaaaaattaacaactttagtgctgacatcaaggtaactgttgaaagaatcacaacattttggggggatataatagctggaagatttcatcccagcttaacagagagaaaatcctaacactgtatcaccaagccttgttgtctcttggccctgaaggtagattttagaagagtaatagagccagataaggtacattagcacctatgttttattttgtgggaaaaggtaaaaatattatgctaatttatcatattataatgctaatttgttatatcctgcctattggtaaacatggagtattaaagaataggacatgactattctattcttaactgcctttcccaagcctcagtgtacctgttagtaaacacacctagaagagataggaagggcctcatgatttcctcttcaccttttttatttggcttctctcctgtcattttatcctacctttagttgtgagttcctcgaggatagcaatgagctcttatttatgtctgtgtatcctacctcagcccctgctccagggccctcctactaaagccaacttaaaacatagtatgtggcatatacaagaccctcatatttcttgcattgaattgaatttttttttcactcactgtttatcatgagcagtgggggaaaactaacaatggaggaagacatttattacatgttgcctttggcttctcatgcagagggccaacattaccatagcaaacattgtgtggagttctccttaactgcctcaattctgtgtgacatccagatgttggtacacagggaataaacttaaggatcttcatcagatgtcactgaccagcaaggctgtgaaaacaatactatgtgatgatatgattttgttcagtgatgagaggaagcagtgagttgcctgtactactgatttcatccatgaaaattaagagtagccccaaaattataagaccaactgaccctgccctctcttttaattacacaatatgtttggccaggtttgttgttgttgctgttgttgttgtgacagggtctcacttcgtcacccaggctggagtgcagtgctgctaacatggctcactgcagcctttacctcccaagctcaagcaatcttcccacttcagcctcccaagtagctgggactacaggtgcacaccaccaagcccgattgatttttttttctttttctgagatggagtctccctctgtcactcaggctggagtgcagtggcactatctcggctcactgcaacctccgcctcccaggttcaagagattcttctgcctcagcctcctgagtagctggaattacaggcatccaccaccacgcctggttaatttttgtatttttaggagagacagggtttcaccatcttggtcagactggtctcaaactcctgacctcatgatctgcccacctcggcttcccaaagtgctgggattacaggcatgagccactgtgcccggcctgatttttttattatttgtagagatggggtctcactgtgttgcccaggctggactcaagctcctgggctcaagtgatcctcccacctcggcctcctaaaatgctgggattacaggcatgagccatggtacctggccagccaggtatattttgcttcatgcactagatgcgttcctgaaaatcagcaagccaaccataaatggattttatgtagtgggatatattttaaatgtaaagagaaaatcttatttttgtaaatgaagcctgctttgaatttttttattttttattttttaaattattttttgtttatttttttttttgagatggagtcttgctctgtcgcccaggctggagtgcagtggcgccatctcggctcactgcaagctccacctcccaggttcacgccattctcctgcctcagcctcctgagtagctaggactacaggcacccgccaccatgcctggctaattttttttgtatttttagtagacatggggtttcaccgtgttagccaggatggtctcgatctcctgacctcgtgatctgcctacctcggcctcccaaagtgctgggattacaggcatgagtcaccgcccccggccatcaatatttttaaaaaggaaataattgtttggtaatgtgaaaactaacttccagtttatctgtattcaagttcaaattttcacctgtaaagcccttttcagggtagtaaatacagattttgctgggtctgctctttacttgttcttctcaagagcataggtttattataaattgtttgtgtagctttagcaagtaattggaagtgaaagcactttcgcaattgtagtacactattccttaagaggtaaatgctatgcccccaaatgatagaatcggagttggcattttatgaattgctctgaaatagctttcaattacctgattttccccattcttagaatcatttatggcaccaagtttcaaactcacctgggtaactggtttaaaaggcacctttctgggcagctcccagacatttatatttggtagctcaggaattggattcagtaattcacatattgagtaacttcctcaggggttagtatgcacatagactatgagaaacactccttcatagcctgtctggaccttcaaagcccagtaacaggaaactattaatatcgtagctggaaggtggtcttcacatatggcaggattaaggaatcttgactcaaattccggtcctctagcattccaaagatgcaggaatttacttgacacgtgtgtaaaggttcttaataagcgtttgtgcaagtacaatagttttcaagctgtgttttgtggagttgtccacacaacctgaattcatgttgactgtgagccaaccccattgttttatgtattgggattctaagaaaacaacattcaagtgatttagtccaggggtttaaaacgaaaagagacctttgttttgttaagtacattcagatcatagagggttcagtgttattttagcaactaaaatgtttaccatttaatgcttttgtcatttaaatttacaattaaatacatctttaacatagctaatctcttcttcgtaggttgtggtatatgcattgtgctttgtaatgatataacctgtttattttctctttcttctatgcttcctggatttctgctctcctacttttttaaatgcttgttttgtctgtcaagcttattgacttcagtaattcagtgaaggtacagaactggttatatgtttattagcattattgtattgatgactttaataattgcgaagtcatgtcaaaatccagttcatccatatgcaagacagatataaggcagatagatggacttttctggggaaaacacctgttaaattaaaaggcagagatttgtgccatttattctcaaaaaatccaatgcaaatagccttccaaacatgggacaataggatacattcattccttgtaactgtgatctcactgacattttcaattctttgtaggattccaaagcctatttccatcttctcaatcaaatcgcaccaaaaggacaaaaggaaggtgaaccacggatagatattaacatgtcaggtttcaatgtaagtataagtgctcttttgaattctacaatcttgcaaaattattgtcaatttcttataagtacaataatttttataatcgtatgaagtagagttggcaattttaagcattattttaaaatgtattactgtacatgtaattcagaggccagaaaactagctttgatttattttgattgttagtgaattccatcgttgttgtggtattgatttatatggatggcataaaatattcaaaacaagtatggggaaataagtaactagaagctaaccttttccaagtatttggattacaaccacagtaatagatttagtgactatatgaaaaccttttccaagtatttggattataaccacagtaatagatttagtgactatatattcatattcctgtgttgagagtaatgtgattatgttttacaaactcccaatctatgaaatctaatttagggaattactctcagagaccatgttccctggttatgtcactaatttgtttagtgacattggacaagttccttctcaaaattggatttcactttgttcatccataaagtaaggagttagagtgaactatttagtcccaagtttctaggaatctgtggtttttgtacccattagatatggaatgcatgctactaattaacaaaatccacatatctagcctattatgccataggatggagtggattacattggctaaaccatttttcttctctttcttttttttttttttttttttgagacagagtctcactctgttgctgaggctggagtgcagtggcaccgtgtcggctcactgcaacctccatctcctgggttcaagcaattctcctgcctcagcctcccgagtagctgcgattacaggcgcccaccaccatgcccagctagttttatatttttagtagagatggggtttcaccatgttggccaggctggtcttgaactcctgacctcaggtgatccactcgcctcggcctcccaaagtgctgggattacaggtgtgagccaccgtgccttacgtggctaaaccatttttatgctgcccttatcagaactgaatttgtaactgacttgtgtgcttatatttctgtctgtatgttaaatgcaaaactcttcagctcaggtcactcttggtagggatgaggggccatcttgtccaagaagggagctgtctgggttggctagccatgtgatctgataccagggtaaatggcatcagtatgctaaccgattctgatacaccccttctctagtcaatcctttccaattgatcttaaaacactcttttgtctcttccctcttcagaatccgacaaggattcttctgttgactctagaattcagtctgaaatgttctgcttggcactcaccctacaaatcttgctctaaaatctagccagtgttatttccccaaaagtctgtgttccccaccccaaccttccttcccaccaccacccaggtgcctttgctcatgctgttctcatggttttcagtgtccttcatctttttcagctttacaccttctttagggtcttttttttttttttttttttttaagagacgaggtttcgccatgttggccaggctggtttcgaactcctgggctcaagcaatccttctgcctcggcctcccaaagtgctgggattacaggcgtgagccaccacgtccaaccaaggcctaattttaactctgaacagttttacctgttttttatttcaatttaacttttttctcttcgtctttgtaatggaaaaaatcccttcctttcgtcctaacttttttaatccttcaattccctgagattaatccttggtcttgccttccaccattctccctacgctcaaaagaaatcagtggaaatagattctctgcttctcttcaattcaagcaacagttcacaagcatttcccttgggatttgagcatgacatgaatgaaggtgtctgtcttctccctcagccagggaagcctacttccacagctcagcacaacttcctctctctctagctcgctctccagcagtgccctcctttctagttccttctgctgcataacacagccccagaggttccagggttccaaggagtccactctgtcatgaagctcattgacttaatgcacagtacccagaagcctcagtgaagttcagctgagagccagtagaaaaaaggagaaactccaaagcagaaagtagtaaatcagcaaaataaaataaaataagccaggttgaagagaatgaacccacaatttacagaaaatgaacaccattttctaaaggagacttaagtaggactacagttaataccctttcacatttaataattaattgagattcattgtagataaagtacatttgaaaaaaaattttaacataattctactgaaaatatctgaatatttaacttgaggtggcttaaaaggacaattgaagctgttttcctattgagaaggaaaaaaggaaaagtggaaccagagaaagtgaagatggtgaatgtatatttttctctacagattttcaaacaaaatctgggagtttcccccaaccttttacgtaacttctttcttaatgcaatttagttaaatgtactcagtagtttgctgtgtgatctggcgccatctagtgtatattacaggtactgcatctccaagagggccaacctttttttttgcattcaaaacaattttataataagtaccatatgttagctaaaagaaagtagaactgtatacccagactatgacagtggggaaattttctatatttttagtgtggcctttgacaaagtcttccgattttgtttcaacaggaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggtaactaaaaacctcaatttcgaatgtgtgggactatagagtagaaatacataggccacaatgattttacaatctagacttaataagtttttttatatctacaagaagtagatggcagatgctgagtaaaaactggcaggaaagtacgatacaagtgaacttttaaagtaaagtagtcgaggccgggcacggtggctcacagctgtaatcccagcactttgggaggccgacatgggcggatcacctgaggtcagtagtttgagaccagcctgaccaacatggtgaaaccccgtctctacgaaaaattaaaaaattagctggggcgtggtggcacatgcctgtaatcccagctactcgggaggctgaggcaggagaatcacttgaatctgggagacggaggttacagtgagccgagatcgcgctattgcactccagcctgggcaacagagtaagactccatctcaaaaaataaataaaaaaaataaaaagtagtcgagtcgcttaatgtaaagccacttagtaaatcagtatttagttttaatatttagggttagaccactttttaatcctctcatcaggaaaaagtgcacatatgcattcagtttgacctgtaaatttagcatatatttatgtttcattcatccacagtcaatgtaactggaactaaccccaactcctttcacctttacctcctcaagaaacaaatgataatatatactaatttttttttaagttttggaaaggcagagtttaccttttccagattatatatgtgtgaagcgtagtctataaaaattaagaaatgcagccaggcgcggtggctcacgactgtaatcccagcactttgggaggccaaggtggccagatcacctaaggtcaggagttcgagaccagcctggctaacatggtgaaaccccgtttccactaaaaatacaaaaaattaggcaggcattgtggtgcgcacctgtaatccagatactcgggaggctgaagcaggagaatcccttgaacctgggaggcagaggttgtagtgagctgagatcgtgccattgcactccagcttaggcaacaagagcaaacctccatctcaaaaataaataaataaataaataaataaataaataaataaataatgcaaatagtaattcattgagtgtccactgatatttctataaaaccagtaacttaactgataacatcagttactttgagggatgcagattcgaggaaatattggagaaagatttgagaaggagactataaaaagttcataaacctctaaattgcttaactggttagaataaggttgtattctttaattttaaaataaattcaaattttaaaaataagcctgtacctagagagaatgtatgtacttagaagaatgcttggaaactcgtattatcgaaaaattctagatctgaatagagagataaaataatctaatatgtgtattggcactatatgcacatacataaagtgtttaatgaatcagtaaattttgtgaatattcttaacaggagaaactcgtgaagaaagaaccttccgtaactggatgaactctcttggtgtcaatcctcacgtaaaccatctctatgcgtaagccttcctactgctattgtaaacagttacgaatgtcatgaatggatgttaaataatgacagctctaaagattttctagatattaatttgtagctattatttatattggaaaatgtcaagtggtgatttccatcatcattttccaaatacacaaaagctttaagtattcctttacatgatcgttaactgtaagtgatagaatatataaatgtctttatagtaccctagggagcaaatactttatattttgaaacagctgtttgggaggttgaggtgggggcattgcttgagcccaggagtttgaggcttcagtgagctatggttgtgccactgtactccagcctgggcaacaaagtgagatcctatctctaagagggaaaaaaaaagaaaggtaaaaaagaaagaaacagagaccagggaatcctttaagtagaccatccacaacaactcagggactttggttcattgttctctcagcctggaacgttctttgctcgcatatagtggctcgtatccttactgtattccagtcactgattcaaagatttcctgactaccacctgctactctctaacccctaaccctagttcctttttttcttaatagcacttacatacacccctaaaattgtttgtttattgtcaacaaaccaataccccccgtattgtttgtttatccatgtacttgtttattgtctatctctctgactctaatgcaaggacagggatttttgtcctgtgggcccagcctctagaacagtgccttgcttacagtaagctctcaataaatacttataaatgaatgggatggtcttagctctgttttcagcacagattgatagaaaatatgagtcttgggtattatttatggttttatatatcttgtttgacaatgtagtgttactgtttttaaggaaagtcaagtcccagcttcctgaaaacactgattacattatttttaaatcattagtgacctgcaagatgccctggtaatcttacagttatatgaacgaattaaagttcctgttgactggagtaaggttaataaacctccatacccgaaactgggagccaacatgaaaaaggtagataattaagttgctgtatatatttgttagagtatttttattctcgattaatttcttttgtttctaaaactcttgacgctgagcttcttgaggacaaaactgtgtcttatttgtttttgtgtgctgatacctagcattatacaagacacacacacacgtatgcagattaaacaaatggaagtctttaaccatttactcttgtgcctttgcagctagaaaactgcaactatgctgttgaattagggaagcatcctgctaaattctccctggttggcattggagggcaagacctgaatgatgggaaccaaaccctgactttagctttagtctggcagctgatgagaaggtatagtacacaattttagctgtttagtctttactatcatacaggtctgtgatttagtccttactgtgtttaataagtggatatgtcgataactacacttttgaaatatgttatatttacactccgaaatgagtttaattaatgaatatatgttggatgttaagtgggagatgcttccttgcaagttaggcagcagaactatggttagtcccttttttaaaaaataggaagcctgacacacagatttcggcctcgtttagtgtcagtgaattaaaaaattgtcagaacaaaattatgaacatcttcatgctcatttgaaaataaagatctctctctgtaatgctgatgaagatcactataatgctgaaaagcattcattatgactgggcaccagccaaagcacagcttattttatgccattaccgctattggaatagtacaaaatgtgcctacagtgggctgttggacctgctcattaaagcactgtcaatctgctcctctctcaccactacaaagagtagatcagtagcaagccactactgcttgaaatatttttttcacatagtgtgaatctctttccatgaaatctttagtccttgaaatttaaggaatataggggccaggagtggtggctcacgcctgtaataccagcactttgggaggccaaggagggtggatcacgaggtcaggagatcaagaccatcctggctacacggtgaaaccctgtccctactaaaaatataaaaaattagctgggcgtggtggtgggcacctgtagtcccagctactcaggaagctgaggcaggagaatggtgtgaacccgggaggcggagcttgcagtgagcaggagattgcgccactgcactccagcctgggcgacagagcgagactccgtctcaaaaaaaagaagaaaaatttaagaaatataaaaagtggaagataaagcatctttctgatgtttgcatttttcctcataaagtagatggtgacgttttcttctgctgcctctcttagatataccctcaatgtcctggaagatcttggagatggtcagaaagccaatgacgacatcattgtgaactgggtgaacagaacgttgagtgaagctggaaaatcaacttccattcagagttttaaggtcagaatccatatttgactattaaatattatgtttgctggataacatctatcatttgggaaggcaacttttggcttctttgtgagtgagaattagtgttgggctaatggcacaattctttacgaattcactgggctttgtttttggcacttgatataagtaagcacatgttaatttgtatgtatcaaaattctcagatttgttctcctttcacactaggacaagacgatcagctccagtttggcagttgtggatttaattgatgccatccagccaggctgtataaactatgaccttgtgaagagtggcaatctaacagaagatgacaagcacaataatgccaagtaagggagactgctaatagtatgaaaagaacgcagctttgtagctggacagatctgaattctaattcaggttctgccatttaagagtggtgtcaccttgggagaaacctcttggagcctcagattcctcatcaataaactgggggcaataatacttaccttagattttataaagattaaatttttaaaaattataagagcctagccttgtgcttggcctactaggtgcttagtcggttgttgcttcagtggattacagaaataatgtagcatgtattttaatgcaaatcaggtaaaactttacaaggaaaataagagcttagggtgttcatctgtctgtctcattctttttttaaaaaacgcattatccacttatgtctcttttactatacatagatcattcttactacatttattgaatttatcttcatcagttcccatattaacagaatgcttgctagccctccacagaagactatgccttgaaagtttcttgcatttcaacaatattcagaaggtcttttccaccagcctattttcttcttcaccaaaggcctagagtgtgacctggcttcatgggtgacccatgaaaaccttactagttagacattgaaaatccatccacagtcctgcattaccgaacagctaagaagcattcctgcaaaactttggagttaggcacattatttcttttttccttgaaaaatatttctagcagatatgacaaaggtctaatatccacaatatatcaagaactcttgaaatctctttttctagaaactcgatgatttaattatctttaaagattctggttccaacacacctagaaatacttcacggattagttgagatgtgttcctgaaaatttccctacctggacatctcagttcttctgtcccttcgtctaccttttctagtttttggtccagccactctgtccacgtaccacgtagactgtctcccctctcatgaatacttggaagtattcattgcatctgcctaacaacttgggttttgcatctagcatgattttccacctcatatctctaagatgacttgagtgtgtgttattatgtgtgcaatgagaatattaacatggattgtatagacagcctaggtaattatatatataaagttggtgcttcaagcttaattctcacctcacattggagaaaaagagtgaataaatattattagccccaaataatagagcttaaaaacctactgtaacttcaaagtgaaatcaaaacccaaatcaaaagaaaacaaaaagcaaaactgttctaattggaactatcaatatggaatttttgcatcccagcataataattatatatgaggaaatagatgtcttacgtggtgtccttaactgacaagaatttcatcctgattttgtttccccctaaaataggtatgcagtgtcaatggctagaagaatcggagccagagtgtatgctctccctgaagaccttgtggaagtaaagcccaagatgg

SEQ ID NO: 4939 - DNA, 88496 bp, human
tttacgtaagtgctttgtaggcgccggcgggcactaggggagcgggtttcctgggcgtgggcaggagtgggtcccggggagagcatctcggttaagctcagcaggaacgtgcggcgcaccgtggggcgggggttgggggagagggaggtcggagaaatttcagttggagccctcgggcgcccgggcgatcggtcgcaaccgaaatgggtgtgagtgacggggagtttccctactagcatccgccgcagacacgttttctgcacttcactgtattaagtggtgttttcttactagttgctcttaacttgttgccagtcttgggctggagtcctagacgccagcccttgccctgattcccctccgcggctgcggccccgaagtggaaagggagcgcacaacttccctctgtcgtccttctccagctactgccatcccctcttccctcccgcccggactcaggaaatcccggagccagcagcctgctactcctccagcccccacacgcccgcctcgggtgacctggctggcttaagccgaccctggggctctggagagggggggccgtggccgagggaaggcacgaggtttgggttgcctgccttctgcctgcttccctcccttgtccttagcgagggcgtcgcgaacgcacctagtctccctatgagtaagcactttttttcctttcagtaggagaacatctctgggctagtaggacagtacctttccgttctcccctggccccacaccccctgtccttttttcagctcctttgactttgcggccccgggcgcgcggtcggggcggcggcagtcccggacctctcccgactcttggagagagagaggcaaaggggcgacgggagggaggtaatagtctacccccccgccctttccccgcacagctgcacttgcctgtgtttacttttctccacccgcagtacttaagcgctgtaatgagaggcccggggacgccgaccacccccgccctggcttctcgccagtcccaaagttgctgccgccgtcgctgctccagtgtgctggcggttccgaccgccgggctccgggacgtaagatgatcccagcccgggaggtggagtgggggttaatggcatctgactctagccttatgcgatgctccttgcctctcacctgagctgcacgatatccccagtggtgcagaaggttgaacttttgcagaaggttgagcttggagctaagtgggttggagagcctcgccatttagcgtcagacagacgggatgctgggggcgcccggcctgttaagagggattgggaggagggaagggagcctggctaacagtaggtagaaaatgtagggaaaagtaaaaaccattgaggggcaagcacttactccactttgctggatgtcacaatggactggggagcctaaacttgatcctcgagatgcagttcatggtgaattccaactaagtggctggagccccacacataccagttggaatcacgtgccccaagtctctgatggtcacatgacgtctttttactttaaagctggaatgtaatggttgaggcccatattccaaaaaccacctctacgtttgaaaaaaaaaaggtggggaggagtgtgaactagcttctaatcaaggaagtctactaggattttggatgaggggaccagaaagggaatttggtgctcagcttttatccaaaacaaaaacaggagctgtttttaaaataagggattgaaatatatgtgagctgggacatgtatctcctctcttcttcaatctcatggtttttctaaatttaaaaaacatcttactaattattttctagggaagtcatcctattactcatgcctcattttgtccctgaatactagatttgaagctaaatcccacaagatagtgttaaaaagtaaggctctgttcatcttccttggtctggcctatattctaattgaactgttccctattttaggcaactacttaaaggtagtaaataacctcttgactaaaattaaccaccagttatttgtggttttcaattaactggattagaaatcatgcacaaaaacagtggatagtaaatttgatacatcgagttggttgggtttttgcctgtcagtggtttggtagaataatgagaggacactgaaacaactttcccatattgacctatacccgcccaagtggcccaagttaaggttgcttctgggaaaacgtggcaatttggctattcagattatatattacagagtatagaagagaggcagaggagcctctgaggtcaggagtttaaaagctttgcttatctgaaaaaaaaagaaaaaacggacctggttgatgcatattcagtcttgaaaacaactagggcagaagatatttaagagattctgactttgtattcttttgccaaaaaccctttgtctcctgcagcagcctctgaatgaccggagcactccagtttcttgctgttcatccgtttctgagcctgaaaactagaacaaccttaaagcacattgttctgaccccaaggctagccttgtggcacagatgagctggaaatggatttaaggtgcacctgagttactagagttaactacactggtagatagacccctctagtggaagtgaggtgataatataattttagatcgaaataataaatgtttaacctcaaaaaaaggaagttattaccactcaactaggttacagtggtagggggataagttcttttttaagtattgtgaaatcatgtctaaacagaatcatcgctaggctctagtccacagcttttcattgtcttgggatgcctactcattgaacaccacccccaatattgctgactttttttggtggtatgatctaatgagcccaaatttttattgaaattagggggctgggagtcaaattcttgatttttactgttagatctagcagatagcaacccctttacctgaggtggggagctattaataaataaataacactttgccttgacttaatacagacgatcaacattgaagtccaaagtctctagtctgatgtaaccatttagattcaattgataaaaatgactaggcttatggcattttgggtagaaggattaattataactagtgagtaataatttgggtgagattaagcctcttccacaagtggttacacgcacattagactttgactgtgactgtttatactggcagaatgtcagtatctagggcactatcagaaacccaatgagatttttctcccaggagaacagaattctgttactgaaaataaaagggcagcttggccatggtgcttgagcaccaaagtggttctttttggtgacactgagagggtacaagaagaaagtccatttgccattatcccatattctgttttaggcattatttctacttggattttcatgaaatgtactgacagtgttcttagcacatatgataaattcatgagtttgctgttgtgtttgatctagcataatctatgtggaatgtataagctgaactgtttcttttttgatgtttggtacagattatgaaagtagctggtataaaataaaatttgaaaatgaatatctctcaatacatgacaacaatggggtatctgtttttagaatcatgttgtctttggtcatatggcaatttttcttttggtgaagagtgatccagaaggcaaaatttttgatctgtgaaaataatacaactcatttagaagaagtcagctgggtcatgttttgagtctgtattattttagacagtgatataccatataatgtatattcagtgtgttggaggtttcaaagctttttggatacattacaatgttggaagatttttatataccagtggtcatgactagctgattttagttatgagagcgctttggttaaagttatggaaacagtctaatcgtgaaatgtcagtcttagaagatctgatcatacttgggccaatttattttagttacggaggtgagacaatttcagaagattcacgataaatttaataataccaaattttgccttagtcttgacacttggaagataaatattagtgagtataaactgttttagggatgaagaagtattgttagtatacaaaaatgaaaatactaattattttagcatgggtcttttagtcctttgcagtctggacagatagattatcttaagtaaatcattgaacttgccctcagaggaattagattctagatagtgctctgccattgactcataatttgaccttcggaaagtcatttaaaattattatattaataactaattgagtacatacatgtgccagacaccattcatgcttttgtttataaaaagagaggattgctcaagctttttggtttgctgggttttattttttcaaatattcataatctggcttatttcacttatcagttgacttttcaaactttgatgcaattgcattgatccaagctaaatactttgttggcaaattgatgactattcaggaaagtgatcaccagtgggttattccatgactaatgttagttctttaaaataaagaggtgccatttatttaattccttgacagggatttttggtgcattaagcctactgattttataatatgagaaaccttacattttcttaaaagtttagaaacgtatttgataataaggaggtagtgttgtttattggaaaagcattgagcatagaatttagggtcttttagtcctttgcagtctggacagatagatgatcttaagtaactcattgaaattttctgtggtcatatctgggtttcactttatttttaagccatgtgattccaatctacatatttcacaggcatggtaaaaggataagtgagaaacgtgaagccttggcttttaagcagacaggtgctatataaattcaaagtactgcagcagtgtatcatagaaacactaaagctttaacaagagtttacagaaatggcagggttctcatcacgtaagtcttgccacatttttctttgtctgtaaaagttctgcacccatccaatttttacaagcaaaggaaaaataaagccagacatattataatgaaaaataagagactaggttgataacaatagaataaaaacctacatgtgatactttcttcttcttttgttttgttctgttttgttttgttttaaagacggagtcttgctttgtcgcccaggctggagtggtgcagcggcgtgatctcggctcactgcaagctcctcctcccgggttcaggccattctcctgcctcagcctcccgagtagctgggactacaggcgcccgccactgtgcccagctagtttttttgtatttttagtagagacggggtttcaccgtggtctcgatctcctgacctcgtgatccgcccgcctcggcctcccaaagtgctgggattacaggcgtgagccaccgcgcccggcccgttttgttttgttttgttttgagatggagtctcgctctgtcgcccaggctggaatgcaatggcgtgatctcggcccactgcaacctctgcctccgggttcaagtgattctcgtgcctcagcctcctgggtagctgggattacaggcgcgtaccaccacgcctggctaatttttgtatttttagtagaaatggggtttcaccatgttggtcaggctggtctagaattcctgaccttgtgatccgcccgccttggcctcccagagtgctgggattacaggcatgagccaccgcgcccagcccatgtgatactttcttctatttcttacctcaaatattgtgcaaggtagcccgttaaagccattaattgggtggtgtttttcccctttttaactaactactgagtagaattttggtcttcagtggtaattgttacagagtccattggcttaccatacctcatttttagttttgtgattgcccataatgggaggtttcgtgtaaaaaacctcataaaaaatcaagtttttcctcctcataattgcagtctaaaggaggacaacacgcaggtctgggaaactgcatagtggaagagataatctatacatttaagtagcatgccatgaataacacaaaaaatggcctggcacggtggctcacatctgtcatcccaacactttgggaggccgaggtgggtggatcacttcaggccaggagaccagcctagccaacatggtgaaaccccgtctctactaaaatacaaaaacttagccaagcacggtggcacgggcttgtagtcccagctacccaagaggctgaggtgggaggattgcttgagcctgggaggcggaggttacagtgagccgagattgcgccattgcactccaagcctgggctaccgagtgagaccccatctcaaaagaaaaacagaaaaacaaacaaacaaacaaaaaaaaacagaaaatgtgggaagttaagttgaaaaataaacaccttcaaagctattaacttggattttcttttcttttcttcttcttttttttttttttttttttgagtcaggttctcactctgtcgcccattcatactctgtccagttcattgaaaatacaagtctgattcccttgagttgtgatattcatacacacacgagtatatatacacttatgtgtgcatatgtatattatataaagttttacgtgatatataatataagtttttactttctgtaaaataaaatttgttagggccgtataatagttttgaatattcatattattgtgttccacattataagctctaattacatcgtgttgcactcagattgacattctgctgttgacactgaaaataacgctttcattcatagatgaatgtaattttcaagctttttttctatatttcttaacttgcttgaatgttcccatttttgccatttcttgttgttcattttaacattttggggcttgtgtttcagatcaggaagaatcaccattatagggtgcaaagagtttgctcagaggtgaaaatgatacgaaattgtccctagagcacatcctattgctatactattcaacatgtatgaattaatctactgggaaagtgtcttgtgtagtgtgtactttaaagatgttttcaatcactttgctttggattagaaaaattcaaggtaactataattttaaatgctcatatttttatgtttattttatatgtaggaagagaaatttttaaaaattggaataacactatatcccattcttttcatttattacattataaacatgtttccaagtgatcaaatatttttaaaaatgtttaaaatcactgcagtatattttatataatggctgtttcataatttatttcactaattccaagttgttgaacatttgtttccatatcttatagataatgcttcagtaagcattcttgatcgaacatcattttgcactctatcattttttagaagtcaccaagaatgttttaaagatgaattcctttgatagtccctgaaatttaaacattggcttaaacaaaaagatagccttgatttcagtggcatttaaaaaaagaaggctgggcatggtggctcaggcctgtaatcccaatactttggaaggccaaggcaggcagatcacttgaggtcaggagttcaagaccagcctggccaacatggcaaaactccgtctctactaaaaatacaaaaaaactagctgagcatggtggcgcacgcctgtaatcccagctacttgggaggctaaggcaggagaatcgcttgaacccaggaggtgaaggttgcagtgagccaagattgcaccactgcactccagcccgggcaacagagcaagactccgtttcaaaaaaaaaaaaagaagaagaaaaaagaaaaggccattctttatatagtgtattgtatcatatgtgactctaaactggaacttgtttaggtaaagtatatgtcttggaagtattttggttttctctgatctagttagcaggtgcagagcaggatgaggtaggattctgtgctgtgtacaatcataggaagttctgttttttgaaacggaactgttaatgggggaagggagacacgtttgtttttaagaagcctttatgtttaatattattataaaactcagttcaagtatacaaagcttatttgtgcctatgaacattcagtatcctaaagaaacatttaatcctggtgttggctaaatgactatttgctgatatgcccttttatctcaaggctattagtttcttaaagtactttgatatcactcaataaactacagttaaactcagagttttacatttcattcaggttgcttaaataatataactaaacataggtccaataatagtaaaaattctgatgctgtcacttaatttgtgcctggtttcagtatatggcgattgcttaaattacaagcacttgaatttacaaatattttgtgtatttaaatggctcattgtacattacatatccctcctgaaacttaacccatgccatttcacagacccttccatggtgtttttctctttcctccagttcactagcctcactcaccaaagactttattggtctgggaattctattatgacccagaagtgacttggaaggttcctttcacccaacaacacattctcactacctttcttttcttttcaggggcatcatttacatgctatgttgcacagtcagaatggattttagcataaagtatgggttccaatagctctcgcattttattatttatttatttgtttagagacagagcctcactttgtcgcccaggctggagtacagtggcacaatctcggctcactgcaacctccatcccccaggttcaagcgattctcctgcctcagccttgtgagtagctgggattataggctcctgccactgtgcccggctaatttttgtatttttagtagagatggggtttcaccgtcttggccaggctggtcttgaactcttgacctcgtgatccacctgcgttggcctcccaaagtgctgggattacaggcatgagccaccgcgcctgggccagctctcccattttatatctctgtggcattgaggaggtttcttaactctctgaacttcagttaccccatgaataaaatgaagataatccactcacttttcactttgttctcataattattatatgagaacacttataaagcaactagcatatggtaggtgctcaataagtattttcatttacaggttgattaatgttgccttagatgatttttgtcaggcatctatatctacctctttttctctaatttgagtaccttcctaccttcctttttttttttttttttttggacagagtcttgctttgtcgcccaggctggagtgcaactgtgcgatctcagctcactgcaaccttgacttcccggggctcaagcgatctccgtgcctcagcctcccgagtagctgggattacaggcgtgtactaccatgcctggctaacttttttttgtagtttgttttttagtagagatgggatttccccatgttgcccaggctggcaagattttagaaattagtggggttttttgtgttttatttaatggtattggaaaaacactccttttattgtttttcattgtgaatgtgaaggattctagccatgtttcaggttgaagaagcttcttcgcttagctcagaaacctgtttatcgtttaatttattctttttttttttttttttttgaaacggagtctcactgtgtcgtccaggctggagtgcagtggcgcgatctcagctcactgcaacctccgcctccgggttcatgcgattctcctgcctcagcctcccgagtagcagggactacaggtgcccaccaccatgccctgctaattttttgtatttttagtagagacggggtttcactgtgttagccaggatggtcttgatctcctaacctcatgaccacccacctcggcctcccaaagtgttgggattacaggcgtgagccactgaaccctgccatttaatttattcttttgtgaggatatgtggagaactagccaagacccgtcacagtggtttacgcgtgtaatcccaacactttgggaggccaaggcgggcaaatcacttcagctcaggagttcgaaaccagcctggccaacatagcaaaactctgtctctactaaatatacaaaaattagccaggcgtgttggcccatgcctatgtacccagctacttggaaggctgaggcacaagaatccctcgagtctgggaggcggaggctgcagtgagccaagatcgtgccacttccctccagcctgggtgacagagcaagactctggaaaaaaaaaaaaagaaaaagaaagagagaaagagaaaaggaaagaggaaaaggaaaaggaaagaaacaagaactcaccttcaaaggaaaattggaaacatggctcagtaaattacagacaccgttataaactcaaggccgctaacaaatacagcttaaatcagaatgaaaggtaataggtagtgttgatacctgacttgtggaggaggaaaaaaaagtaggggcaaagagaaaatatattattgaaaacttaaaatgctgaggatggcagagggttataaagtaaaccaatatgttttcatgatgacatgtagcctttaaaaatggctgaatctaaaacatatttatgatgcccattattttatctagtggaaattttcaaaagcaaaaaccaggaaatgatgaaggctattgacacattcagaaaatattctgagcagtttgtgggtctccattgtaaagctacagttgaatcatttttacaagtgggtatgaataattacaattttatattttgtcctgtggtaattaaaaagcaaatagagccaaattatcattaagcgtaactaacagaaaagtaatattgatagatttacatgtttaaaaatataagccaacccatgcattcagtattttatcctcaaacaaggtgttccagctttagttgacactcagataaaaagcaaactagtggctgggcatggtggctcacatctgtaatctaagcactttgggaggctgaggcaggaggattgcttgagcccaggaattcagaaccaacctgggtaagatatcaagaccctgtctctattttttaaaaaataaaaatagaaaataaattttaaaaaagcaaactagaatatatctagtaggtgctagcagaaggggaaaaattctctaagcagagatttgtgtaaaaatgaagggaaggttaataagtatctagaaactgtaagtgttgtataaaagaaggcttatagaccattggtaaatagatgtaaaactcaaggaaacttttaaacgtgcccaaagttcttaagtatatattaagatggtacaaactacagatgaagtaatagttaaccaaatatactaacatgcacaattgcttaattagtctatttgtggaatggtttcattattcattcaactaccataagtttaatgcagactgttaggtgctagggctacaaagacggataagatactcctccagtctagtagaacagaaagacacaaaaataatcttggttctcatgaaacctaaaaatattcataaatgtagaaaatgaatttagaccgtgcccggtggttcatgccagtaatcccagcaattagggaggccgaggcaagtggatacctgtggtcaggagttcgagaccagcctggccaacatggtgaaaccccgtctctactaaaaatacaaaaattagccgggtgtggtggcaagcgcaagtaatcccagctacttgggaggctgaggtgagagaattgcttggacctgggaggcagaggttgcagtgagccgggattgcgccattgcactccagcctgggtgacaagagtgagactccgtctcaaaaaaaaaaaaaaaaagaaaaaagaaagaaaggaaaaaaaaagaaaatgaatttaaatacagccttttttctcagcataaaataatttctaaatataaaccttgtgtgaacaaagaaattcacttataacccaatataatcaaatctaaactaagaacaaatctcatttaaacattgttatttctttgcaataattattgcataccaaaaaagagcccactatgagttaatgttacttaaatagaacattgctcagcctacaaatgaaggtcagcagacaccagtgtcttggaataaaatagccctttggcaagaaaacgagccacaccccattaagtttttacaaaaataaaattctttccagctttactaaattgtagatgttgcgcccagcatgtacttctgcagtagttgattctgcagctgtggaaatattcatgtatgcagaagtccccaaaaacatctattcaccattacttgcacatgcagctcttatactttctgtagtaaagtattccgttaagttttattttgactcgtggataatagcaagcaactacaggtatagctgacaccttaatttcctgccttgaacttctggccacagactttatttttttattttttgagatggagtatcgctctgttgcccagactggagtgcagtggcataatttcggctcactgcaacctccgcgtcccaggttcaagcaattctcccgcctcagcctcttaagtgcctgggattatggtgcataccaccatgcctggctaatttttgtattttttagtagagatgggttttcactgtgttgaccaggctggtctcgaactcctggcctcaagcgatctgcccacctcgacctcgcaaagtgctgggattacaggcatgagccaccttgcctggcccattgtcacagaattcaaattgagcaggaatacgtaggatttcaaatctaacagttgtttcatttggtgggatagcatcaaagccatgtactgtgaccactgtatatggttttcttcaagagcagcaataaatttctgccatgtaccatgggaaagagctgtacttttagggagaaaggaaataagccctgagaaaaagccccattttcctagttcctttcacagttcacctggcacacaacgggtcttgatatttatatttgaaagagtgaaacatggatggccataaatgctccttgctgataacgattgaattgggaaaatctaatcaggaaatcagtgatttatgaattacattgcataaaatacataatgatgggagcctgtaagaagactaaacaaatggcttccttagtttatttttcctttaggttttagttgttttcagtgaatattatgagtgaatgttatcgatagtgttttcattgtgagaactgctaaactgtagagtcaaagaagaaattgggacatattaatattttgacttttatgccagctttattgagacataatatcatactttttttttttttgagacagagtttcgctcttgttgcccaggctggagtgcaatggcacgatctcggctcaccgtaacctccgcctcccagattcaagcgattctcctgcctcagcctccctagtagctgggattacaggcatgtgccaccacacctggctaattttgtatttttagtagagacagggtttctctatgttggtcaggctggtctcagactcccgacctcaggtaatccgcccacctcggcttcccaaagtactgggattataggcgtgagccaccgcgcccggccccataccatctatttttatagattttagtatattcacagataacatgcaaccttcaccagtcaattttcaaacattttcatcacctcagaaagaaaccccatacactttagctatcaccttccacagcactctacccctgcaaccctaagcaaccactgaactatttcctgtctccattgagttccctgttctggacattacatataaatggagtcatataataggtggtattttgtgactagtttctttcacttagcctaacattttcaaggttcacacaccttgtagcaagtatcagtactctattcctttttatggctggataatatttcattgtacaccatattttgtttatccatttgtccatcgatggatatttggggttgtttctacactatggctatcataaataatgggacatgcaaacattaagtgtctatccatgagtcccctaatgagttagaggtggtgctgacaagataacatttcacttattaccactctgctcttaatataaatccttgctttgattaagcactaccgatttttccatctaagtttttttgttattttttgttccttgagacggagtctggctctgctgcccaggctggagtgcagtggcaccatctcggctcactgcaagctccgcctcccgggttcacgccattctcctgcctcagcctcccaagtagctgggactacaggcgcccgccaccacacctggctaattttttgtatttttagtagagacggggtttcaccgtgttagccaggatggtctcaatctcctgacctcgtgatccacccgcctcggcctcccaaagtactgggattacaggcgtgagccaccgcgcctggcctctatctaagtttagctattttttttcttgtttcctgatgcttattggcttatcatcgacttgttctcaataacgttttccttagtagtatttatactggaataatagaaagcctgtaaatgctgtataatcatcttttctaaaacttattgtataataaacatttagcacagttttgtttaatcacattttttgaacactaaggagcaaaggcaagcagtattaaggagtacaaaagtacatgataaatgctttgaaatgcaatgggttcaatcaaccaaaagcattattgagcacagctaatatatttacttttaaatgtactattcaagtgtgaaatatatccatatagaacaaaattcaaaactcacaaagggccataatgataagtaaattagcctctaacacttaatatttttaagaagacattagtgttttacgtttaggtattttgacagtaagtttgagggagtctttatcttttgaccttttggggtgaatatgagaatgaaggaatataaaaagatgattaaaagaatcaccaggccggaaatgacggctcatgcctgtaatcccagcactttaggaggccgagacaggagaatcacttgagctcaggagtttgacaccagcctgggcaacatagcgagacctcatctctactaaaaataaaacaaaattagccaggcatggtggcgtgcgcctatagtcccagctactcaggaggctgaggtgggagggttgcttgatcccgtgatcacgcctctgtatttcagcttgggtgagagagatcctgtctcaaaaaaataaaataaaataatttcctgcaatttcagattattcttttaagcacccttgaccccagattcaccagatcaaaacagctaatgactcatagaactttactctgtcattattttccagattcaacccacagcgaaatttttgggatccagtctccttactcttatgggcaggcggaaccttgcagatcctttaggaaaggataggcttccctgagaaaggtgggctggagttaagtcaaaaaaaaggtgcaactttctggagtcccatttagaacttcctgcgtatttaataggcctttgctaattattaacaatgtgcctggcacactaacataaataaaacagtgtgccatcgtttgaagagctgagtctaatccacctactgatttttacaaaggaggcaactgaagtctgattttggcttgcctcagcatagagtgctccaggacaatggtggaggatcaggtcgccatcactggagacccagattgtagtaatggaactgatccatcattcttctcactatatatttaaactccatgtccagggtcaactttgtttagtagcagtgcctcttccctgaatcagtttgtatctacacttaatttctttcagagattaataaaatgacaaatgctatctcaataaagttaccatgaactctctgaaactcatatcacccatgactaaagcaacttgctttgagtctgacaagctcttccctagctaatggaaatgcattagcaatagctttacagtggtaagctatttttctaggtcatattcaacccagagtagtcacatgctgacaaaacttcaatcctaaacactgatcataaagagtttcctatattgtatgtaatatatccaaaagtttttgaaaactctaattccagtatattgaatatacattatagggtttatcactcctgatttttttttaattgagacggaatcttgctctgttgcccaggctggagagtagtcccgtgatctcggctcactgcagcctctgcctcccaggttcaagcagttctcgtgcctcagctccccaagtagctgggattacaggcgtgcaccaccacgtctggataatttttgtgttttttgtagagatggggtttcgccatgttggccaggctgatctggaactcctgacctaaactgatcctcccgcctcggcctctaaaagtgctgggattacaggagtaaaccaccatgcctggcccactcctgatttcttctaaactggattttatcattctcagagtcagtgtttcctctctgtattactccttgcctagaaaaaaaaatgtccatttcattcatctattcattgacttattcaagtacttaccgagcaccttatatatgtcagatactattctaggcactggggattacagccgtcaatgaaacagacaaaaatcaccgtctttatgaagcttacatcctactaggggagagatagaaaataaacaatgattttatatattagatgctaatgtgttatggagaaaaagtaagattaatggtataggaagtgggaagaagggtattgccatttcaaaatatgtggtcacagaaggcattactgagagggagatatttcaggcaagatatgaaggaaatcaaggagtatccatgtgaatgtttggggagaagtgtcacttgaacaagtaaaaaatatttctaataacagatacctaaatcatcatacattgatgtgtttcagccctgaaattttcctttatgacaactcctttttattttggtattgaacagaaaaaaataactttcacccagatcaaacactctagtggagtcatgaactgactatatatgctaagaatattgtgtcagaagttatgtcaaaaaagttttgaaaagataaagctaggcgtggtggctcacgcctgtaatcccagcactttgggaggctgaggcaggcggatcacgaggttaggagatcgagaccatcctggctaacacggtgaaacctcgtccctactaaaaatacaaaaaattagactggcgtggtggcgggcgcctgtagtcccagctactcgggaggctgaggcagaagaatggcgtgaacccgggagacggagcttgcagtgagccgagatcacgccactgcacaaaaaaaaaaaaaaaaaaaaaaagataaagtgggaataatgtttaaagcaggatatagaattaatacaagtaaatgttcttcattttccctattaatttaattatactatattctgtgtttaattctgaattagattttttaattaaactttttattttgagataattgtagattcacacctacttgtaagaaatggcacaaagagatcctgtgtacctttacccagtttcttccaatggtaaactcttaaaaaaccatagtacaatagcaaaaccacaatgttgacactgatacagacaagaggcaaatgagtttcattaccagtagaatcccttttattgtcctttgataacaacacacacctccttcctcccctgacctccatttttgaccccaggaaaccactaatctgttctccatgtctataattttgtcatttaaaaatattatataaatggaatgatatatagtatgtagcctttgggaattagctttttttctctgagcgtaattctcttagagattcaacctaagttgttgtgtatgtcaatacctcgttccttttcattgttgaatagtattccatggtgtgtatgtaacaaagtttatttaaccattcacccattgaaggatatctgggccatttccagttttttagttatcacaagtatttgtatacaggtgttagtgtgaacttcagttttcgtttctctgggattaatgccggaagagtgcaaatgctgagttgtatgagagttgcatgtttaattttataagaaattgccaaagtgtttgcccagagtgactgtaccattgtgtgcttccaccagcaatgtatgagtgatccagtttttccacatccttgccagcctttggtggtgtcactgtttttcattttagccattctgataggtgtgtagtgatagctcattgtagttgcattttcagtttcataataactaatgatgtttaacattttttatgcacttatttcccatctgtttgccctcttcagtgaaatgtctgttcatgtcttttacctattttctttcatttttgagacagggtcttgctctgttgcccgggctggagtgcagtggcgcaatcacggctcgctgcagcgtcaacatcctgggctcaagtgattctcctgcctaagcctcccaagtagctgggactacaggtgcacaccaccattttattttttgtagagttggggtcttgttatattgcccaggctgatgtgaaacgtctggcctcaagcagtactccgcccttggcctcctactgtgctgggattacagacatgagccaccatgcctggcccttttgtctgttttctaattggattatttgtgtttttactgttgtggaattttaagaggtctttatgtattctagagtctaattctttatcagatatgtggcatacaaatattttctcctcgcctgtagcttatcttttcatcttctgaacagaatctttcatagaacaaaaggatttatttggtgaggcccactttatcagtatttccttttatggattgatttttggtgtcatgtccgagaactcttcatcaaatcaggttcctgaagaatttctctttcccccctaaagttttatagttttatgttttacatttaggtctgtgatctgttttgagctaacttttgtgtaaggtgtgaagtttgggttgaagtttcttattttttgttttggactgtgtttgtcctcgtctactgacatggttttttgcacccttgtgaaaaatcattgaatatatttgtgtaaatctgtttctgggttctcttctgttccgttgttttgagtatctgttgctctgtcagtatcacactgtcttgattactgtagctacatagtctgacttaatgccaggtggagtctattcaccttatttttcaacagttttagatgttctaaggcttgttcctttccatgttaatttttaaaagaagcttgtctataactacaaaaactgttctaggattttgagaggaattgatttaatgaattagacttttgaaattgcatatgtaatgttaataaagttaaaaatggtaattctgttaaggaaaacaatttagttccttccaaagtctaacgctagttcttattttctgaagaaatgtgtatttttatgattttgaaattattgaatgaatattaattagcagtttcttttttattttttaaattttttgtgtggagatggggtcccactatgttgcccaggctggtctcaaactcctggtctcaagcaatcctcccgcctcagcctcccaaagtcctggtattacaggcgtgaaccaccatgcccggccagcagtttcctttcagccataacatgaatgaccttttttaatggccaaaattgaagtttgtcaggttctaaatcactaatatgtttttgaatttaaaaatttttgaaggtttacttctggaatttttaagaccaaccattagatttataaggctgttaataagattcctaaacctattgttttgccttaaggaaagtatggtttaccttttgtgttatcccaaacaaattcatctccccatatagcaaaatggaatatgctactaaatagttgaaatttagggtaatggagtttgggatatgtttattattcatgaatagtaagtcaaaagtttttaaatgaaaacatttgtgtattctcatgctttgattgttgattctgcaaaataaaatcttaaaaattacaaaaagcatctgataaacttcttaatttaaaagaacactcagaaatttactttcaggtatttaaaaaaagagggaggctatcaaactgattaggactgaagaagaactgaagagataatgtcaccttgttggttttgggtgagggaaaattgaatgagatcatgctttctttctgtcttgctttctcaagataaagcttttccactcttctgtctgcttactgattcagggtggcaggcacaaaacaaaacgttccggttatattttccatcctgtttatatttaaattggctgtttattctttaataaagtgtataactgttggtctataacattatgaatgtgggattaagtggttagacttagcaggaatttgaaaatcagggtccaaatgtactaccctaagtacagtagcagaattacttctataaagaaaacttccctaagttacagcatctggctcatagcattatcattacagtgaagtttaccatcactcatattagtgatgtgttacttcccacttactcctaaccctgcttaggtaatgcaaaactataatttagaaagtgtgatttaaagaagatgcaatataatggtactcattgtaaacatatatccagatttctttcttcacatataatttatctgtatttttaaatttattttgtctaatgaaagacttttaaaagctcattctctcgagcagtgaattctcagctagtgagccaggacagtctgcctcatcaaaagaattctgctaattgctttagccaatttctgaggtaataagctgggagagggaagaggttggttactcatgcataggtgactttttgctaacagtgtgatttttaggaagtgaagaccacaaaagctttttgacttgtggcagaattcattatgatgagactttagctgtaccaggtaacagattgccaaataaaacaccaaacaagcaagattggtcagttacaatccagtctgtagtagtctgatccagcatagtgttatgtttatggattcaattccctcctcgaagtcatacaattgaggcatctcagtagaaataaaacaaaataaacaaattttgtagggaagctcctatacatttgaatggtaagggcatataactattaatactttatgagaccatggtattttgcagccaatcttaaggataaatctacattgtgttcaggattctgtgttgggccagacttaacaatgaccattatgtgtagaaaatagcaaccattgttgctgaattaaactctctctggagatttaaacatttttttaaaaaattaagctaataggccaagcgtggtagctcacgcctgaatcccaacactttaggaggccgacgcgggcggatcacttgaggacaggagtttgagatcagcctgggcaacgtggcgaaagcccgtctctactaaaaacacaaaaagattagccaggcatggtggtatgcatctggtcccaggtactcgggaggccgaggtgataggatcacctgagcctgggggaggttcaggctgctgtaagctgtgattgcaccacggcactcagcctgagtgacagagggagactctgtctttaaaaaaaagaaaagaaaagaaaaagctaataaaaccttgatgacaacatagccaaagaaattaatcagagaagagtggtgattagaaacagaaagcatagtggaatagatgaattacacctggcaaaggaactctaaactatattatgtaaagctcaggacagtctacttgtctgaaaaagaaataccaaaagtatacacatgcaaaaatttggatttttcagctggactttttgtgaaaggttccctcccaccccaaattcaaaagaagtataaagcaggccattcatggcaaactcccaatgaaatggaattaatttgtattgtgttttgaaagtgtatatatgtgcttgcaggaattacatggaagaattatactgacatagagtggctctcaaagtgaataatggaatcttaaggatgttttattaaacagcgagtcaactatttttctccgtgaatgtgactccacaatgatagtggaagtcagaaaatatttcacatgcaaatatatctgaaattcttcatggatgtatttaacgctttgaagtgatggcaacatctggtagcaagtagaagccagcgtcttaaaagctatggcttcatgttactacttcatctgaattagtcatttaaaggggattttatatgtcttcctaaaaactgacgaggttaatcttagactagggcaggctggcaggaaatgctaaagcggctctttcttttgaaggttttgttattccttgtgaggtcaaaaagtagttgttttaaagtttggaaagctaaagcagtgatgttttgactcttgacagtgagatgtttttctttttttttgggggagggtgtgtgtggcaagtttgaggaaaaacttgatacactgagagttctttatactttccactccacttattttctctcaaatgaatttattttctaaaggtgcagaatttagaaattcgtttcaattaccaaatctgagcatggatttggtgctattagaagatgtaaccaccatgtgtttggccagattagctttcaggaatgatcgtatcttacagagttagccaatggaacaagagtagatgccttttatccttatttatttgctttgcattaaaaagacaaatgctgaaagtttattcttgactatgaaataaaccactataatatatgacactgagttaattcctttaggatgctatgtcttccacatacatccatttaataaatatttgttgagtgcctactgtatgccaggcactgttctataagctgaaaatagattgctggacaaaacagacaaaaaatcactgccctcttagagcttattaaatacgaaaacagtagagcaatttaaaattatttaatgctatcactcagcttttaaagatcttcactgaatgagttttgagaacttttgcacatattatctacagcttgaatagggaaaaaatgacattttgtttgaaatctagttcaagaagctagaagctgataagtaaagtaaatattttattctgtgatgatcattttcagttttcatttatcagtgttatacttaggcctcttgaggaatgttactagtttaacttgtggatttcctcctgaggatgggcttaatttgtattgggggaggtggtgaaaggacctagtagccctggaatttaatgtaaagtcgtggcatttgtaaaactatcttctgtcatttgaaaaattatagaatacttaaatgtatttaatgctccctgtggaaaatgaatgtattgctcagttatttttgcctatgtgagtagtacaagagctgactcaaaggagatgacatgatggttcctgtcctgaagtgaaataagatgatgggttgtggtggaaaaatgatgtggtcatgcccatatttgctcacatctcttgttcgtttccttttatagagggaaaccagggaaagtctcatttcttattttttgtttcctttttgtattttctttcatacgccatttccctttctttttttcttaaaattgcattatagtgacttccaattcaattggctcaagttgtacttggtaatgacataaagaaataccgcttagaaaggtcatagtggaagcattatacccattttagggaattgattatatatatagacacagccactctgagccccttgaggatatgaaaagcatgttgcagaaatcctcatatttcctgatgccaactagtatagtgccttttacagaatatatgcttaatcggtatttatctattgaacaaatatgagccatgaaatttaattttgctctccaaaatcccaagtcctttatataagtaggcagaaattttaaaaagtctttttttttgtttgtttgttttttgagacagagtcttgcactgtggcctgggctggagtgcagtggtgcaatctcagctcactgcaagctccgcctcctgggttcaagattttctcctgcctcaggctcctaagtagctgggattacaggcacccgccaccacgcccagctaattttttgtatttttagtagagacgggatttcaccatgttggccaggctgatctcaaactcctgacctcgtgatttgccctcctcagcctcccaaagcactgggattacaggtgtgagccactgcacccggtctaaaaacttatttttatggaattattcaaatacataatgtaaaatagcattaaaaacccccagctttaacaattaccagtatttcatgttcttatttcatctttgctctccccttttttgagatttgctttaaaataatccgcatattgttttaccgataaatactatagtatacttcttagtttttaatattttaagatagtagtgtttgcatttcatatggagttttacttttaaaccctttctgtgctactttatgcaagagaaagaaattcttaaccgcttatcagaagaaaaatctaatttttttttttttgacggagttttgctcttgttgcccaggctggggtgcaatggtgtgatctcggctcacagcaacctccgcctcccgggttcaagccattctcctgcctcagcctccgaatagctgggattacaggcctgtgccaccacacccggctaattttgtatttttaccggagacggggtttctccatgttggtcaggctagtctcgaactccagacctcaggtgatccacctgcctcggcctcccaaagtgctgagattacaggcgtgagccactgcgcccggccaagaataatctaatttgctgtgtatgagtaggatgttaactcattttgtaacatatatttcctttcttaatcttttaaaaaattttattaaaagtttctaaacaggccgggcgctgtggctcacacctataatgccagcactttgggaggctgaggcggacaggtcatgaggccaggagttcgagactagcctggccaacatagtgaaacccggtctctactaaaaatacaaaaaaaaaaaaaaaatagccatgtgtggtggcaggtgcctgtagtcccagatacttgggaggctgaggcaggagaatcgcttgaactcgggagggggaggttgcagtgagccaagattgtgccacgcactccagcctggaggatggagtgagactccgtctcaaaaaaaaaaaaaaagtttctaaacaacattgtacatgttatgtcatgactgtcatgataaagtcttgccttttagacatgaacctgattcagcaaaatgtgctttgaagtagataagctgtagatttttgtcttgcctgaattgatattaaagagatgttttttcttttcacagttcaaaagtacagaactcaggttaaaacctagatatgtaattttgttaattttattttcagtttgaaaattcttgttaaaacctgcatactttataggtttgctgtctctaaaattagatggctccttcataaatattactgaataaagcaccagttttcaaaaagtgtggcacatgggctcatgggggttaaaattactttcatgataaaactaaattgttatttgttttttcactgtgttaacatttgcactgatgatgcaaaagcagtagtgggtaaagctgctgaatcaagatagtggccccacactgtagtgatagccactgtattcctcagcaccataccatcacctttagaaaaaaatcttacaacatgcatttcatttacaaatgtacttgatgaagcaggaaaaaataattgtattaaatctcaattcttaggtatgcatctttttaaatattgtgtgtgatgagataagacatacccataaagtatttctgctgcatatggatatatgacgattgtcttgagggaaagcacttgcgcagctgtttgagttgtgagctaaactagctgcctttttaaaaatagaaaaccaggccgggcgcggtggctcacgcctgtaatcccagcactttgggaggccgaggcgggcagatcacgaggtcaggagatcgagaccatcctggctaacacggtgaaaccccgtctccactaaaaatacaaaaaattagctgggcgtggtggcgggcacctgtagtcccagctacttgggaggctgaggcaggagaatggcgtgaactagggaggcggagcttgcagtgagccgagatcgcgccactgcactccagcctgggcgacagagcgagactccgtctcaaaaaaaaaaaaaaaaagacaaccagttttactttgaaagattgaattaactgattattcagacccgagtatctaacagatactttatttttaaaaaatgaaccaagtgtgcctctcactgcaagggaaacaactaagagtatttgttgccaatgctaaaattagagctttcaagcaaaattcaaatttttgagaacttgcattggtcaccattttatccgatcaatacttaggcttttctagtgaaatcgacagtataattaatgaaaataatgtgttagattttgtataatgaaatgtatcagcatttggaagacccacataacttactgaaacaatatttttccaaataactaatgtatgatgttacaaaatcaagcatgggtaaaaggcccattctaagtgcaagacagacaaatagattttgaaaaaatcattgatattgtatcagactctacattgcaaccaacctttgaaaaactaccacttctctcgagttttggtgtagtattgaagaatatctgtaagtatctggaaagcctcttaaagtatttctttctttttacaacagtttatctgtaggaggccagatgttcttcatgcactggaaccaaaaccggtattgcaaaagattgaatgcagaagcagatatgaaaacccagctttcttgttctaggttaaacattaaagcgatttgcaacaatgtaaacaatgccacccttgtcactacactttttttgaaaatatagttatttttcattaaaaagcttatgttaacatgtaatgggcttattcttatttttaaacaaataaatatcttaaaagtttcgtagtcgcaatttttgatgtgacaaatacactgatagatctaacccatgtgtcaccaaactctttgggatcctcagatcctgaggccaaaaagtttaggaactgctgagttgggttttttgttgttgtttccctccttatccctttgccccacccctccacttttctcctattcccctctcctttcttttctttttttgagtgagagagagaccctcaggatagaaaattgtagagcatgtgagttattcctttgtatgtttttattagctacgaactgaacatgtatgtcttttaaattcattcattgccccatgtgtagttcgatgtattttgaccttttcttttatttattttaaaattttgattacttagttacacaaataaagagctaataaatactatcagggagacagcccttggaatattgaattttatattttcttctgcgacagtcttgctctgtccgtgcagtggcaagatcacagctcacctcctgggctcaagctatcctcctacctcagcctcccaagtagctgggactacaggcgacagccaccatgcccagctaatttttttgtattttttttgtaaagacagggttttgccatgttgcccacgctgctctcgaactcccgggctaaagtgatccacccacctctgcctcccaaggtgctgggattacaagcaccagccaccacgcctggccagaatattgaaattaagatatattctgacttatttttccccaaatatgaaaaaaatgattacatatatgacttgattattaaaattgacacatccatgcaacaagtttatatacctaatgctgtgcctggtatgaatttcctaaactttccaatatagtcccaaaattacagtagtagtttcttgaatgtaaacttgttgcctgttttatatgttagatccctttgcttctatgcttcactcactatgtttgtttgttcgctttgtttttataagtcatgaagatggaaaaaaaactgtttcatgaaaggaaaatagatgagtgttgttgaggtgtgtcattaagcacagtgggagaggcctccaatgtacgtgtcacacatggaaagtatacctagtactgggtgtggtggagagcatgacgtctggatgaaagttgtaagagactttaaaaatactatgcctagcttttgtgttacaactacatattccactgatacttatgtgaaactcccataacttttcgggttgtacctcttttttccaccctggggtgggagtgtgtccacaagtgcatgtgtgtgaactcttaactttgtgtttgtattttgagatggagtctctgtggcccaggctggagtgcagtggtgcaatctctgctcactgcaacctccacttctggggttcaagctgttctcctgcctcagcctcccaagtagctgggactacaagggcacaacaccaatctggcttttttgaatttttggtagagacggggtttcaccacgttggccaggcttgtctggaactcctgacctcaggtgatccgcccacctcagcctcgcaaagtgctgggattacaggcctgagccaccgcgcccagcccggcctgaactcttaactgtatggtttctgtttgtaacatctagagagagtgacagtgagaatttggtttccgtcggctttccttagcattcattttgatgaatttgggatgcaatttaaaagctgttttcattctgtggcctgctgatgaaaatgtagaatttattgcagaacccttgccaccgtcttgcattcccaaaccagtgttcattacccatagtaaaaaccgagatcctgttcacacacatgcacatacacagacacgctccccaccgcccccgtcacgcacacacccacacacacctcggatggtgagtgagatagaagtttagtttacatgctaaaactggttaaattactgatgtggtagaactgtcttttagcccgggcacagttgctcacacctgtaatcccagcactttgggaggccaaggtgggtggatcacctgaggtcaggagttctagaccagcctggccaacatggtgaaaacccgtctctactaaaaatacaaaaattagccgggcatggtggcaggtgcctgtaatcccagctactcgggaggctgaggccagagaatagctggaacccgggaggcggaggttgcagtgagctgagatcgaaccactgcactccaacctgggcgacagagcgagactccgtctcaaaaataataataataaataaaagaaacaaaaaactggccgggcgcggtggctcacgccttgtaatcccagcactttgggaggctgaggcgggcagatcccaaggtcaggagatcgagaccatcctggttaacacggtgaaatcccgtctctactaaaaatacaaaaaaattagccgggcgtggtggcgggtgcttgtagtcccagctactcaggaggctgaggcaggagaatggcatgaacccgggaggtggagcttgcagtgagccacgatcccgccactacactccagcctgggtgacagagcgagactccgtctcaaaaaaaaaacaaaccaaaactgtctttatgtcctacctagcatttactaagtagaagatgtgcccttttgaagggcatgtctattcctagaactttaactacaatgctttgcagtagaaatatatgctattgtattaaggtgaagtgactttagaattagtaactcggtgttgacagatcatgctgatcgaagattagccttggagtttggaaagctggagagcatgtatattccagatgaccaggaaaggaaaagtcagaaaaacagtttttaagtagtactgttataacgacctgtaaaacttgaaacgagagaaagctgtcttctaaaatgaagaattacatatttaaaacattaatttcctcaatgatactgctacatatctgaaaagggtggttacgtagcatttgggacagacccgtctcagtggtttgaggcaacaggtgtggctgaagaaaaggtaaggctggggaaaaaccaacatttctggtctaaactgatactgtcttcttacctgaggcagtttcctatgccctggttttctctgtctgaaaaatgcatgataacacatactcttcaaattagctcaaaatgcttggtagttacctactattccctgacaggccacaggcagatagttctatgcttgttttagaaatggagaatttggtactcagaaaagttgaagaagcttcatttcattcacatagtgagtcagcaacaaggacagacggaaaaacatgtcctatgactcctgccattgtattccttctcttctgcattgtgttgccttttgatatttcacgaaggttttgtgattggtgaaataaattaaagcacttccatgaaggagacaaaatgtaacccagtgtctgctgatggtggttagtgacgaggacaggagaacactgcctcataatggggactatccggtgagggctccttttcacaggtgcccacactgtgagtcacctccttatgctgagagttcggtatgctatcataaaatactttgttgtgtattatttatgaaggactagagtatctattgtctcactttctttcattctcatgaggtagattacagcagcagatggcattatgcatgctttatcccagacacaagaaaataatatctgccacttactgagtaccttgctggacccagacactcttacatatttatatcttcccattgggtcatcccgtggaccttgtgaaatatgtggaatagctccattgttatagatatgaacccggggctcagagaagctaagtaatttgttcagggtcacacagacttacaggtctgtcagactcctaagaccctgatgctttcattgtgctgcatttccttcaaattatgaacttgccctatgtcagcacagaaacggcctcttcagcctagcccagtgctccaactgattgttctctctcataaaaggcactcacaactaaccacttgcttgatttaggaattcactgattagattgctagaccagttaaaggcaaatttcaataatgagagcagttatcacgtatctagtacttaccatgcgccagactatgatctaaatttatgacacatattaaatcatttaagccttacaaccatgtataaaatagtgaactgcgatatgatggagttgctcttatcttcatcccgggatgagaaaatagaggcagaagagttttaagcaatttgcacagttaataaagtgtggagccagaatttgaacccaatctggctccagacctctttactacagctctcagttagaaaattatttctaactgagatatttcggttcagcaagtgttggcttagttcctgtgtgctatgccagcagaaaatatagttcctacacagaagagcttacatttttgacataaatcaaaatgtatatacttgaaataaatgctacaacaccttagcatatggggtgtaaatgttgtgtatggatcagcatgaataatagagactgttagtgagtggcttgagagttaatttgccttcgcaagtaatgttcttgactatggacgagtgacttgggcactggggagaagctgttccatgtgttctaaaataagcaggttacttggctactgttcaaactctaaataggtatatgggttgtagctatttgacctgaactaactttaaattcccctgagtccttatatgattttggggaaaaaaaaaaaaggaagaagaaaaaagaaaacttttctctgtaaatgctgcatttaaattagaatttattaaattctctgcaaaataccgccaggctgacaggaaggggattcgtaagtattgtatcattcttttgtcagggtgttctctttttctagcaggaagtgttgtgacttgctctctaaagttgcaattgtaagaagaatgttgggtttccagattgctcttctgggcgtgggagaaggttctgtctatcagtgctgcgagaaaggaaagaaacaagtttgctctcagcgggtaactattttaatattattttgacaggctctaactttgagattactaaatctaaatttaaatactaaatgattaagcaggaatttacgtcaaaaagcttgaaattcctgttatttatttgggtaaacatttggagtcactttaaaaatattatttattcaagtagaataaaatttttgttaagagaaaattttgaagtttagattctaacctgttctgtgtgtattctgtatttttctttatttagagaatgtttagggagtttatactttttaaaaatgggttttgaaatcctaattatacagccgtatttatcaagttaagtatctaaaacactaaataatagaaattattgtctatatttgtggtgggggtgggatttcaaatgcttttgatcccagttacatggtttttcaaaattctgtaaaatggaggttgaggtggctgtcatgacagaacatgtcacgattagattgatattatactcttcctacgtgagttaaatcaaacagttgtcttagtgtttataatttacaaaataataaacatcactggtgattaaattttgatggcgttattggtacttggcagcaatagtgatttctggtgctcacatacattaggattttccatcacatggttgtcatataagtttaatttccccatatttctggcaaagggaagtatagctagttatacagtcaatcctcactctgagttgagtcacctctcggactggttgtacttaatatgcgcatatgaagtaaaaagtgaagcatgaaacaaaacaaaccagttttttcaattaacaagtgctgtatttgctaacatataagcaaggtatataacactgcaagaggcattttcagtgacttgccgatagctttctgcttcgtgtatatagtgatttgagttgtaggtcacaatattttatggcatttttattttgaattgaagtgaagcatggtaactagtctgatcttgcctagcctctctctctctctctccctccctctctctctctctctctctctctcacacacacacacacacacacaccccacacacacatatccctgaaagttgcccttggcttcactcaaacatatgttaattttcataagaaaggaaactggtggaaatacttcttaggtatgaaaattaattaatttcattagcagcagatttattttcccataaattattcagattttgggggtagatgtaaaagtttacttaggcatggaagacattagaccttttaaaagcaaagtgggctatttcaatctaagaagttagttaatgtaccttagctttctgaagctaggggaaggagaggtgtctttttgttgtgtctttgggtttgaaatagtattcttcatcctaggaaaaagggcttttagactataattgagacttgcattaaatagctgcaaaattcttgcctgagaaacgtttaaatgatgtctttaatctgaccaaattgaattgaatatttctattattggaaaaagctacgtattaatttatttttaaatagccattgctttcagatcttatctttgtttattaagtataaaaagaggaaaggaaacttttacctaaaatggaggtatttgatattcctccaggaaatgacacaggattgggcaccctttggggtttaagtgactcatagatattggtactgaaaacaaaacaaaacaaaagatcagttagaatctagctaatgatcaattatagcacagaatagaagtatttccagaaaaatgaactcatttcttaatagctatgtaggggtgaaatcacaggatttctgagatttgctttaaaataattcatggaagagagacagggaaggagggagggagaagaaaggacaggaagagagaatagatgaaccaagcaaatgtggggaaatctggataaatgtagaatctgtgatgggtttatgggtgttttttgtgctattttctcttgtatatattgaaaatattgacaataaaaaatgttagtagacctttagtttggggcaatttatatttattttctttcttttttttttttttttttttgagatggagtctcactctgttgcccaggctggagtgcagtggcacgatcttggctcatgcaacctccacctcccgggttcaagcagctctcctgcctcagcctcccgagtagctgggattacaggcacccaccaccacgcccggctaatttttgtgtttttagtagagatggggtttcaccatactggccaggctggtcttgaactccttatatttacttctaaatgtcaacttttatctataaattgcaggcctgtcaaaacatgatgtatgcatgatgtgtatgactgtaaaggtgaaatgtgctgcttgaatgccaaaatggttgaaagtaaaaactgcttctgaaaaggtttatttctgtttgattttcagctaaattcaaaggacaggtcacaaacatcttgaagagttttttagtatcttgaagtattaaacaagggtagttaaagcatgataacaggccaattgtatgtgaagaatgtgaagacgttattgaacttgactattttgttcacagctttctccaatagagtatgtgtttttaaaaccacgtgagaggactatatagcctgcatgatgtataggtctgcgcactttccctactcacctccatcgaagtttatttattgaacaaacattcggtaggtgcttgtggtgagccaagatacaaagtcaaataagataccaaccgtgcttttaaggagctcacaggctcgtggaggagatagagaaagaaatagatgtcatcacgctgaaagctgaaaagggctataggaatatggggaaggggaggaacgggttagcaactatgaccctatgacgcatctcctttaaaataatacaaggctgggcacagtggctcatgcctgtaatcccaacattttgggaggcctaggtgggcagatcacttgaggtcagtagttcgagacaagtctggcccacatggtgaaaccccgtctctcctaaaagaataaaaactagccagatgtggtggcgcatgcttgtaatgctagcaactgtgaaagctgaggcgggagaatcgcttgaacccaggagtcggaggttgcagtgagctgagatagagccactgcactcaagcctgggtgacagagcaagactctgtctcaagaaaataataataatataaaataaggctgggtgcggtggctcactcctgtaatcccagcactttgggaggccgaggcgggtgggtcacctgagatcaggagttcgagaccagcctgatcaacctggtgaaaccccatctctagtaaaaatacaaaaactagccaggcatggtggtgggcgcctgtaatcccagctacccaggaggctgaggcaggagaatcacttgaacccaggaggtggaggttgcagtgagccaagatcatgccattgcactccagcctgggcgacagagtgagactctgcctcaaaactaataataataatataatgtaatataatacagacagaaaattggagatggtttaattggttgtgggtattacagtggtagaagagggctaaaatggcttagtctaaccccatgcataactttgcaaataactcttctgctctcatctctcttccccgcccttcttaataaacctttatatctttcttatgcatccacaggggttattggagcagtgtacgtgcagaacagagcaatctcttcttcacattaaagagtagactgatgtttaagtctcccttaaaggttttagatatatccaaggccgaattatagttattaggtaggcagctacttggagttggataaagggtagagttagccttcagtcacagatagagccttctaaagttcatttctcaattgatttggaatttgaaacatattttgtcatggaaatagtagtagggtttttcaggttactttacaagtattcctgaaattttatattatgttatctggcatgatatggttttgttctatgatatcttattttattttcattgtattctatgtgaattgtagaagcacagttgctaaatatatccagatttatgttccatcagccagttactttattctctagttcctgatactatacaatctaatcagtgtatataataatgcctcatgagaaaatactgtcaattttatttgaggtacctaatgatgtcctctgtttagttgtacaatttgcagctgaaatgttaagtagaatgaacagaagagctagacctgaaaaataactttccgaagtaaagtctgctatacgtggtgattatttctttcatagatgtttgctcaccacattgactataagaagaaatttttggctgggcatgatggctcatacctgtaacctcagcacttttggaggccaaagcagacaaatcacttgagcccaggagttcaagaccaacctggagaacatggcaaaaccccatctctccaaaaaatacaaaaattagctggggtgatattgcgtgcctgtaatcccagttactcagggggctaaggtgggaagatttcttgagcccaggagttggaggcttcagttaccatgacactgcactccagcctgggcgacacagcgagattctatttcaaaaaaaaaaaaaaaagaagaaggagaagaagcaatttttgataatgctgatgtgctagaattaatgcacagtaaaacacttcaccactttttcttctgcttcaacctttcctagacttttaggactaggaacctatgacacacgtgagggcatttaggttttgactcccttattttgactttcagagcaacaaatcattaaataaaaattatgcatatagcctcttaagcctttacaattactcctttaccaagattccgtgaaagttttctaaaatgagtcaagcaaaattccaagccacttgttcttgagaaaaatcttgaaagaaaaaatttttaaatgaaaagtaaatcacatagatacttgagtgtttgttttatattaagactaagttattagcactgatacaatgggagtggttgttcacaatacttagcattcatgaggctgaaattaagcagtattaacaaagagaagcagaagcctgtcatatgtaggaatgaatgtgtcataggagaaagtaagcgtttgtgtgcttttttttcagaatattgcctgttttatgatcagtgccaatttaacaccaatgttttaaataaatgacttttagaactctgtatgagtctttactgaactcattgtctatattctgtatgttttatacaattaaagttttggttattttagttcaaggcttaagtgaatcccttatccttttaaataatgaaaacaagttagtattagctggagggggttactatctccattttctggcaactgttcttatttctcgatatcatggtcatatttgttaggagctttttaagttattttccaaaggctatatatactaggcatggaccttctctctgcaaagcaatgtgtagtctctttgtttttgtttttctgggaagagtagttaattggctgggcactgcagctcaagcctgtaatcccagcactttgggaggctgaggcaggaggatcacttgagccctggagttttagaccagcttggcaacatagtgagatcctgtctctacaaaaaaaaaaaaaaaaaagaaataaaaattaaaaattagccgagtatggtggtgcatgcttgtagtcctagctactgggggtgggaggtgctgaagcaggaggatcacttgaggccaggagttggaggctgcagtgatcatgccactgcactgcagcctggacatctcagcaagactctatctcaaaaaaaaaaaaaaaaggaaagagggaaaaaacagttaattacctttcctccaacacatgcttttgctttttttttttttttccagctatgcttggagaaacacattattattattattattattattttgaggtggagtcttgctgtgtcgcccaggctggagtgcagtggtccaatctcggctcactgcagcctccgcctcctgggttcaagcaattctcctgcctcagccccttgagtagctgggactacaggcacgtgcagccaggccctgttaatttttgtatttttagtagagacggggcttcaccatgttggccaggatggtcttgatctctgaccttgtgatctgcccgcctcggcctcgcaaagtgctgagattacaggcatgagccactgcgcctggctgagaaatacatctttttaattgtgcttcacagctttgtgtcctgggcaaagtcaacgactatcccaggcacttgtttattccctaatacaatttagggaatgaagttatggaactctacagacttcttagctttcaaattctcattgctgtgatcactggatattgggaatactgggaattttcactccctctaaacattgcagttggttggagtattttattcattttttatgtttatttttttagaggcaggcaaccatagctcactgcagcctcaaactcctgggcttcagtgatccttctgccccagccttcctagtagctaggactacaggctcaggccaccatgctggctgatttaattttttttttttttttaagagaaggagtctcgctatgttgtacaggttggtcccaaactcctggcctcaagcagttctcccacttctgcctcccaaagcactgggattataggcatgagccaccaccctcagcctcagttggtatattttgtaaaccatgcctgtgtaaccaacatccagcaatgagagtaaaaggtgaagtttagactgttctccagaaacaaacaatcatgaaatgagacttgcaaagcaaagaattacacaagtttttgtgtgctgttcgtgaaagaaggattttcttttattgaagaagattgttctctttgaccaagtttaagaatctatgtaaagaaggtagataaactgaaccaagtaggacaatggaagtcccagttagactgactgtcctcatatccacttatgtaactatagggagaagtctataattaaatttcaaaattttgtggcaagattctaaattctctgggagttgaagagaaagatcagtgggaggtggagtcattgggaaacgtgctttgggagaggatgaggcttctgaaccttgcttgaagggtgagtagaatttggatagagagagaggaaaaatagaggagagtattctaagcatgagacgcagatagagagagaggaagttcttaatggaagacaggaaaagcagaagagaccagaataaaacaaaaggtactgatagaggagaatccagaaccagctgtaatagaaacacagttctgtgagagtactgggaagataaattttatcttgggtgcggacaatctgaagatacttcctgaaataggcttttgaagtgtctagatagatgggtgaagagcattccactggagagacccagtggtctctccagggagtggaagaagcgggaaaatacatggcctgtttggggaataaggtctcttgagagtgttgggttcaagggtgtagtacatataatgggaagtagcattggaaagatgggcagacataaagctagaagtcaagtcagaaaagtgtagggccttgaatgctgtcctaaaaaggtgggacctccttttgcatggaatgtttataagatccgctcttcaggagattatcaggagattagcagtgtaaagattgcactggaggaagacagaacagcaggcagatctgataaaaaaaaaaaaaaacttttgtggggttgggggagggggaagggatagcattaggagatatacctaatgtagatgacgagttaatgggtgcagcacaccaacacgacacatgtatacatatgtaacaaccctgcacgttgtgcacatgtaccctagaacttaaagtataataaaaaaaatatataaaaagataaaaaaaaaacttgtggagtaggccagacatgaggtgataaacagatatgacggaagaatctcagatattgcaaggcaagaatccagagggatgggtggttgactgatcctccctttgttttttatggtcaaactgcagtctggagacagaggaaagtgggaaagttgaaaacgagacctgatttggcagaagaaagagttagaaaaaaacagggaaaataatgtggcagtaagttagattggagacacttagactttcctaacttgaatcgtcctcactgactttccttctcccttggccacttctaaattggaccctgatctgctgctgcgagtgtgtctgtcactaacacaaggcacaatacccttaccagtgatgtctctctgagaatgcccttactggggatgtctatctgagaaaatcctacttgcactcaaagacagagttcaagcctcacctcggaaaaaacttttctgacgcctaccatttagtatatatgactgtgatggcatgattgcactaatgttgtatctttgtttttccatctgtttcccccactagacagtaagctcttccagaaagaaggggatttggatcctaattgtctcttatctggagcacccaacacagtgcctggtacatactaagccttaagttaatgcttgattaatataaataaataagtgggtgagtgtggtagacattcaagctgggaatcttctaaagtcattaggaaacatgagactggagctttagtaatcatagtatgaataggtgagttttagcccacagtgttgcacacccatctaagctagagactagtgttgagctgttcacttacctaactagggaggtggcagggtggcagtttctattggtaaaggtaggtatgcaaagtgtgggtgttcaaaagcactgcctgttttggatggaggaaggtgacaacaccccttttctgatcattcttgaactgttcacacataatggtggctaacttgtttattttcatttatagtgaaataatgtatttcttccatgttttgtcccctctttgttgctttcttgttcattttaggacctcaagtatgtgttgcccagtctctgatttaagtaatgagcttctcttttccaattctatttaccatactagtggctgggatgaagcctgtggtgaatatcctgtttttatcttttggctgcctttcaatttaaaaaaaaaaaaaatcaagtttatgatcaaagttggttacccccagatgagtttcccacgtgcattctctttctcctggacctcatggtactgaatgacacagatgaataagtagattattcagtcagctgcattcctaaagtgagtgagtgctttaggagataaaataggcacccccgtcccccttcaaatacctttcagaatttgaataatagtttcaggtagttgtaggtatacctttctcagcaaagatctgtgtttagggtttatgtatagttaaatgagccggtggagtggtttcataattgcagtattgttagtcaaactctgtaattagagatgacttcataggcataagattcttctatgggtgacgccctgaattcatacccaattgtacactatatccttttatgaaaaaacaaacaaacaaggttttgtttgcttttgttttactcccttatttgaaaatctgttttcctgtgtcttatatgtttagtgaagaagggctggcttttttctacagctttcccttttcctttacagaaatggcaggcataggagctaaggaggaaacagaatttgggacagatcaaagtgctttgcagatgagcgaattcagaaaaacgtagagactccaggaggttttatttttgataagtattaaaattgctgagtttaaatggaggaaaaatatatctctatttctttgaatgtcagttctctttctctctccctctctctcatcatgtaaataaagtccgcttttgcttggtggcacacatctgtattctcagctactcaggaggctgaggcaggaggattgtttgagcccagaagattgaggctgcactgagctgagattgcaccactgcctgggtgacagagtgtaaccctgtctcaaaaagaaataaacacataaagtccacttttgtgggaagacagactgggaaagaggacatatttgaaaatcagggtttttttccttttgcctgtcaatcacatattgtgaaatcggggttaaacttttattcagcaagtaatactttctcttcacctttttctagtactcatgaaaaaatttgcaaattaggaggaatgtgacaatattgacaagctgttagctattttgaaaagtgatcctaaaatatttaaagaaaaattgttgtttgtttgtatatctcctgtctgctctttaaattgtgtttagaaactggccttacggaggaaccaaattgagtcatggataaaaagtgactgacaggttttcctttaggcccatccttcttaaattactttgactaaagacttgtaatttttatatatgagggagacctattatactctgtagtcagtaattatagggagatgagataacttttcatttatcccatgtaaaaggctattagtagaactaatgccttatatttatttatacagctcttcacaattaacccaagcattcatttattccctattttctttcatgaaggatttgaagttgctatgtaatacttcatagttcacaatatgctgtcatacataccatctgtaatcttcattaggacctgggggaagtaggtattattatcactattttcaaatgaggaaacttaggctgagacagattaattaaacttgctcatggacacattactagggaatagcagaaccagagcaataatcgatgccttctaatttcacgtccaacatctttctgttaaaacatactacaaccttgggcgcggtacaacagcttggtgtactggtacttgagattaaatgaagtgtctacagggcagtattgatgtcaaatcttgtgttttgctttgtgaacccatccgggatgttttagtaactttaagggaaaaaagtcctatagtacaatgaatgccccatgaagaggaatagagcttctgttattttaatttgtaagatctttattttttaatatcttcactcatttccaagttacttaatgtgatgttttctctcaagatagtactttactgcttgacttccttaaagacaccatcaagtacctatgagtagtcttaaggacagaccattttttaattcatagtggcataaagaaatctacattaaacaactttattttaagcttcaaatggcaaaatgtacaattgtatcagctagagcatatattgtgagctttttaaatttggctttatattttttagtcttggcccaggtacttcagagtagcatttctttatttcctttcaaataactgtcaataaatgaatatgggtttatttaaattggaaagtcctgcattaaactattctgttatcctgaaacaaccttgtctggaaatacggttttaaggatatgtgcatgttccaattccttctttttgttctcattgaagtgtatctctttaatgtctctgatagatgggaaatctgagttacatatgcaaagtcactttaggctttttaaaaggcaattagaaataagaaacttgaaaattttaaaatatatgtttaatgcactggattaatttttggactaaactggtgccctaaaattatttctatgagatctaagcatttcttaattcatttttattttttactttttttattgagacagggtcttgctctgtcacccatcctggagtgcagtgacgttctcatggctcactgcatcctctacctctcgggctcaatcggtcctcccacctcagtttcccaagtatctgagactacaggcatgtgccaccacccacgatgcccagttaattttttgtatttttggtagagacgaggtttcaccatgttgcccaggctggtctcgaactcctgagctcaagcgatctgcccacctccacctcccaaattgctgggattacaggcatgagccagcacttgctaattttataggaagaaaaaaagaactgcgtttctggccactctgagaagaaattaataatccttaaagtctctagagacttttttcttctaaaaaaatggatatttgtaccttttattgcagtcactaattcactttatgtcatattgtaattattcatgtttgcttcgcagattgtaaattccttgagggcaagaactaggtgtatagcagatgtctaaaatattggtaaaattgtttgagaagtagcggggaggggcaggttggggagaaagagatttctacaggatttaatcagaacccaactggtcagcagggataaggggggcggggggcaggaatggtttatgtccagaaccatcttatctaatttcttttttttttctttcttttttcttttcttttctttttttttttttttttttttttttgcagtgatgcactgatggctcactgcagcctcgacctctcaggctcaagtgattctcccacttcaacctccagagtagctgggattacaggcacgcaccaccactcctggataagttttgcatttttggtagagacagggtttcaccacgttggccaggctggtctcgaactcctgggctcaagtgatctgcccgctttggcctcccaaagtgctgggattacaggcatgagccactgcacccagacctaattttcttttgcatagaagtgatatggtagtgtgagagtaagctcagttgtataggtttgttttagttgttttttacccacatactttaaattattactgactcactatctgcccaaactggaaaggacctttagagataaaggagagaggccacatgttttagatttctgagatggtcttacttttaaattttctgtgccattgttctccttggtgtgtgattcatggagatgtgtaataattctttattaaaaacatgattgcttaaaaggggtgaagaaaattggaataaatcctatgtcgtatttttgtaatggggagtgttgaacatattagtgaaacagaatatttttagaattactactattcgtttgcatttaacttacgaattttaaaaaaaaatttttttggaggcgaggtctcactatgtttcccaggcttgtcttgaactcttggcctcaagcaatcctcccgcagtgctgggattgcagttctttttattcttaatctttaaaatgcctaacttcaggcctgggcgtggtggctcatacctgtaataccagcactttgggaggctgaggtgagtggattgcttgaagccaggaattcaagatcagccagggcaaaatggtgaaaccccatctctacaaaaaatacaaaaattagccaggcatggtgtcccacggctatagtctgagctacttgggaagctgaggagggagaatcacctgggagggaggagcctgggaagtcaaggtcgcagtaagccgtgatctcaccactgcactccagtctgggctacagtgtaagaccctgtctcaataaacaaacaacaacaacaacaacaaaaaaaaaacccacaaagcctaacttcattactaactgaagaactttctttccctcatagatcctgagattactctgaaaggtattttcatccaacctgtctactgagaagttatccatctttagtggcatcttgatatcatacataagaaaagtttatgaataggccagctttgttttatatcttttttaaagagtctagtgttatttaatttttttttttttttttgagacagagtctcactctatcacccaggctggagtgcagtggtacgatctccgctcactgcaacctctacctcccaggttcaagcgattctcctgcctcactcaacctcccgagtagccgggattacaggcacccgccatcacacttggttactttttgtatttttagtagagacagggtttcaccatgttggtgagactggcctcgaactcctgacctcaagcaatccacccgcctccacctcccaaagtgctgggattacaggcgtgagccagtgcgcctggctgatggttttatttaatttttaaaacaccagtcactgtatgtgtctgttacattatggtaaaaacttagctaatagcatcatatggtcattttaaaacttctccaggatttgagaaacctgagtgtgaattccagtcctgagagcccaggtcttctaataggaaaaaaaggagattagaatatttagctcataggactattgtgagggtttaggaaattaatatgcaaatgaatttgtataatgtattaataatacttggtgcatagttgttgaagggattaattttattaaagttctgttttattgagtgccttactatgtgccaggggctgtgataaattctagaaatagcaacaattctgtgaaaaagatagatgtagcccagctctcttatgaatccctccctaccacttccagcccctacctctctatactgagtgttacacttcttggccaaaacataagttggtgagtaatttgttgccttttaataaaatgtctaaaagggataaatgtaagatctcaaaatgtattttgtatagtttgtgaaatttaacccgtagtatatttttttggaaaggcaacatctttagggcagtggaactactctatgtaatatgttaatggtggatacatgtcattatacatttgtccaaacccacagattatacaacactaagagtgaaccctaatgttcaccagagtcttagggtggtaatgatgtaagttcatcagttgtaacaaacgtaccactcaggtacaggatattttggtcaatgactgatcgaatgtatgatagtagtcgcataagattataatactatattcttactgtaccttttctatgtttagatatacggataccattgcattacaattgcctacagtgtttactacagtaacctgctgtgccatttgtagcctaagaggaataggccataccgtatagtctaggtgtgtagtaagctataccatctaggtttgtgtacgtgcactctttgatgcttgcacaatggcaaaatcacttgacaatgcatttctcagaacacatctctgtctttaagcaacacttggctgtatttgggaactctctgtaacttctgcttgattttgctgtgaacctaaaactactctaataataatgtctattggccgggtacggtggctcacacctgtaatcccagcattttgggagaccgaggcgggaggatcccttgatcccaggagttagacaccagcttgggcaaggtggcaagactctgtctttacaaaaaaagagaaagaaataaagaaaaataaagtctaccaaaaaaataaatcagaagagagaaaaaacccaaaacaaaaaaggagaaaggaacatgtaatcattttcatttttctttgtccaaaattattgttataataggtttgcatttggaaattatctactgtgatacagacctcctctctttattgccaggatcagcaaagtttttccatataggttcagatcataaatattgtgtgccaagaggtaaaatcaagaatattatgatattaatatcaaggatataatatattatttctatcagtttttattgacaaaattcaaaatataataattgagtacaattttttggtaatacaattctgataagaatagaattctttttttctgggataacatttcacttaattgggttcaaagttaatgtgcccccatcatcaaaatggactgcaaaaattttcctttaataaccatatccagcttgaggtcatacaaaaacaactggtgatccagttttggcccacaggccatatgtagtttgccaacctttgttctgttagttaaatagatcaataaggccaaattggaaagggtgtatactcagataatataataatttacatgcataagaatgtgtatattagcacacatgtgcatttttatatcaaaaccagctataatttgttttgtttcctctttattcttcctttaatgagagtgattgatagatgtcagtatgctatttgaaaatcaatgtcttcacagtgaatgattctaaagtggcttaatgggaaaatgatactttccgtgaatcattggtcacataatattgacctttagctttggctcatataaccaagaatttctattatgtagctttttcctgtcactgctgggtactttggcccttccttaaactttttgaatgtaatttaagattttgtccttagaaggaaaattcagaaatattttttctcaataaattttggtaagtgatgacttctcatttgttttctttattaaagctgtatgtagagacatggtaacctattcagattgttttgatagtttgaaattctgtttaaattatccctaagatgagaacttagcaagagtgcttatatttatcacaattttttaaagtctgaaacgtttttggtttttctttagatctttaaatggatgagatggctaccactcagatttccaaagatgagcttgatgaactcaaagaggcctttgcaaaagttggtgagtattttttgtagtaaaactatagggaagcaatatttatttggtctcaaagttatttctctataaatatcacatgaatggttaatcaaaaacattagggcaagatagttaaaatagatgggataaagttttggaagctatacttaaaattgttttatttcttttttttttttttggtcgagtggtagctgatattatttccaattttatgtagtatttaatatggtcaaattttttagaccacagttccaatccttaactggtgactgttatgtatggttcctgaaattttcatgccaaattttagttattattatattttgtatctcatatctttctgaagaggtttgaaactttcaccatattctcaaagggatatgtgaccctcgaaaacattagatgatgttttacccttccttaattagtttggcgttattgacttttttatgggttttctgtgcctttggttactgcagatcgttctacctcgccacgttaaattatagcttcagtataagatgagaaggcatagcatgctatttgatttatcctttatcatcatataacatgccttacaattgagcagctatggaaggtaaatatggagtatttacattccaaattttagtgcttgggtcaagtctatagacaataatgagaaaacagggtgagaacagcctacttatgtaaatacatgaatcaacatgtgcttagagaggtagattattattatttggtatctccttgactgaagggtacagaattagctcatatgatgatttgttatgtaaatcagaatttgccgttagacctgtgtcgaaaatcccattagtggaaaatgaggaaatatacatttctgttcccatatatttatgatcaacattttctatgaaggcattcagtagtagcagtgtaccttgggaagaataatgaccccagccagagtgaccattcataatcccatcaaaattttaactagaaaaaactgaatattcctgaatctaacatgatcgcgcgcacgcgcgtgtgtgtgtgtgtataaaaatagcagttaattaccttgccatggataccacttactgtaagaaaaatgctacatagtttaatatataacagcaagtgaattcttggctgcaagagtttttttttttcaaaatgactctcattcagtcaaaatagtcttataattgttttaggagtgcatttttgaaccttttttaaaattaatattcatctttcagcattagcagcagcttaatttgttatttatgaatagaatttcagagtaggcaccatgccttattaagtactcatctcctcaagtaaatgctgaatacaggtcttgtcctcatgtgcagcatcttggaaataattacgtgcaatattccttaaaaattaaagttaattcagatattgtttacctgatgagacttggaatacatttgacgagtaaaagaacttcattgtcccttaaaagcttaatgacataaagaggattgaccaattatcttcatagaggaaggagttaaattgtattaagtaagggatcaatgagaagtttgactgcaagaaaaggtcattgtggagctattgtttaagtagagtttaagataggcgtacagtttgccaaagcccctgccaggcatatgttcctaacatactcaggctcttattactatatatgctgtaaagaattctggaatccagaatttctgcctattgtgaatattattcttttgtagtctccactcagtatctagcatagtgttgcacacatgttaggttctcagtaaatatttcattgattgaaacccaaggaactatatacatagccttttgatgtactgggatttttgtcattatcaaccatacattcagagggcctttgttgtgaagattttcattacagtggaatttattattaaaggtttttgccattaaattgtagcatataaaatttatatatatttttcagcataataaaagcttgtgtgtacactccatcttttagaaactcatttaaggacccagccgagtctttcgattttctttaaaaaatctttgtagttttaagttgttgttacttacagaaccctcaggcaaccgtcaaaggtgttatagaattttttttctaattcagggacactttattttaaaaacaagctctataacttattatcctgtgaaggacagtttttcctttttgtgggggtgggttggcagagaataggaaagactactttgtctcagttcaattgcgacaaaatatggaaatcattagatgattttccccatctattaacaataatagccttgattatctccttagaaattcagcaaaatcatagcgtgtggagaaaatctctgtaattactgctaatcataggttttgttcaatcaattaatagtgctttgaaactctctttactagcaataaattgagtattagaatttaaagttctcttttcactcactttctgcacctgcttagttttaagctccaagctcatgtaattattttaattttctcaacaattgtttccagtgcttcccagtagcagaaacgttagttatcagtttttgtacttcatgatgtttcaaatttaatttaaatgctgtaatacataactatttctaaagaagaataaataaaacctttcaaaacacttaggtattaatattttaccatctagaaactgtcttttacattctaagcctttaatcttgctatggaaactagtggtcatttggatgattacttgtcataaagaaaaattcatgtaatgtaaacctttgcagagttgctttagtactgcaaacacttaccttgccttgccttttttccctcctgagcactcactactgaggttttttaaacatgaattcagcacttttgaaataaaagaataatgggtttcttaaatgactaggaatagtatgggtgtattcctttgaggtttcccaccaaactaagcaaaaaaaaattggttgtggtgattgtagctataccagacttctctcatcctaggaagttgagttgtttcaaattacttgatattcgctagtatataaaaaccacatcaggatgatgccacaaaaaaaaacagtgctttagtttaatttactttcagtattcaataaaagaacaccagtgcatatttgtttaattatgccttaaaacaaaaacaaaactatagcccgtctaaaaaaaatgaaactaatcagtgctctttcattgtgccatctggttaattatatatggattattagaagtggaggtctcgggatagtcggaaaaccatgtttcaaaggtgtggaagctagttaggagtacacatgtgtgggtgcatgggtaaaagcaatttttatttttatttttatttttattttgagactcctgggctcaagtgatcctcccacctcggcctcctaaaatgctgggattacaggcttgagccatggtacctggccagccaggtatattttgcttcatgcactagatgcgttcctgaaaatcagcaagccaactgtaaatggattttatgtagtgggatatattttaaatgtaaagagaaaatcttatttttttaagtgaagcctgctttgaatttttttatttttttatttttatttttaattattttttgtttatttattttttttgagacggagtctcgctctgtcacccaggctggagtgcagtggcgcgatctcggccactgcaagctccgcctcccgggttcacgccattctcctgcctcagccaggtggcagactacaggcgcctgccaccacgcccggctaatttttttttttgtatttttagtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaaggtataagctgtgagaagcaaaccccatgtttagctaagcatctggagatgtttagcagctgccttttctaaggatttaatgcctaatgaaagcttgatttcactgcttagatcttgggatggaatatagtttaaattcttctgcccaagtcttttgaccgagtcttttaagtcagtattttgtgagctttcatgggcattcaggattgtgtatgtgtgtaaacccattattgttagataaatagattccttttgtcatttctttagtgcagaaaatttgtagaatatgttggtcaaaccaaattgaacttttaaatccagcttttccaaaaggatatgcatctgcacttgctaggctttcttctttaagtcctaatgagcactgtcctgagtgggctaatagagaggtcgcatgtgtattccagatgagggcacacaatatgtgacctcttcataaagaaagacaccagatttagacagattcaaggatgtttaaagcaacacacacacacacacacgcatacacacacaacccgagcgtcaaagaaaatcctagtctttcttactgtcaaatttatgagacaaagtagcaccccaaaagacgcttttgaagtgatagattgcagcacgtaccacctggacatgggcagtgtaaaacagcagctaaaatcaaaaccacttggattctggcttagctttctccagacaagtacttaaaatagcttaaataacaggatgcaaggggagggaaaacatttccttttaaggatatgcattcttggtgtgattcaaacttctgcaggaacatggctgtgtaataagtttatttactttaaggtttacttaggggagggcggcgggggagttaaatagtatttaaaataatacttggtaaaagagaataatgagatttcctttaaaacaaaatgcagatgtgaacctacacgtgtcatcagagagagagagagagagagagagagagagagagagagagagaaaggaaacagtccttttaacagttgattcttttcttatgaattcagtcagtggccaatatgaaaaatgggcctgtctggtgcagcactgggagctgcgtagtgatttttttttaagtatcataattttcttcttttaaaaaaaaacgctttgtcaatttactcaaatttagccctttactttctgccagaattgtgttcagtgataaggtagagtttcctttatccagcttctccttaatgtccagccatactgaccatattttctaaaccaaaaggttgagaagtgctggcattgaaactgcactgcacaatataggcagtatggtaatttatgtctgctttatcagctggttggaaactatgatgctgaaacagaagagtcttcaaaacacagagcttttcccactccataccaatgtatagttaatgagaaaatggcaagtgagccaaaaaggtgttgcagagtattggcagcatgaatgagaaaataaaggactgccatcattcctggtggttgtgattttagtttccagttgttaaaacgacttccaatctaggtatgttattttgggtcagtttattattaagttctcatgtttatgtcaaaactcagaataggagaaattcaccatcaaacatactgaacagcaacattctaattccaatgctctgtttttaaagtggacactgtaaccacaaataaggacatagtcttatgatttcaaaaaattaaattgtctttttgaaaaaccttgccacattattcttattctcattttgcttttgaataacaaaaaattatccaaaattcattttgggttatttggaaatcattcaggtacctcagctattttattttacacataaggaaaacatgactcaaagactatcatttagccagtttgtaaaacgaaactacttttctccgatgtagaaaattagattgaatagtcatcagcatttatgtttattttttaaaattacaagttagtcttagaagtagactaaaagttgtgagcacctgatgagatggaagctttctaaaatcccattatgctacctttttactggccttccaaaccacgttagatctttgatattgtttaaggatgtgtttttggttttttgactgagggttcgaaataaaattagcataaaactctttaagaataattgcatgctattttgtctctcaagtactttaccagctgggaggttttgtaaaattaattgctagctgcatttttaggctccctctgccttcttgtttaaattgaaattattttcttcaaaatatatgatttaagagctctaagaaaggcttgataaaattgactctaactaacactaaaatgcctttgatcatgggaggtagtgtaatttggactaacactgggggctaaactatgggaaaatggcagaataggtaaaacttttagaagacgacgcacattcttgtcatccaggaaagcctaaggatatgtattcgaagtgactcaaaatttttacaaggattttgtagccacagtttcaagtaagacccaggggttccgtttgattcatttctgtatctttggtatgtagcccagtgggtgtcttcccacagggtaggtactcagtttgctctggagggtgactcatacctaaacaagtgcacatctcctttctcagtaaagccaaagcaggtttctacatttggaacaaaagagatcctgaccagagagctatcactggtggtccacttgggccctccttgatgggtgtgttcacttagaaaaccaaattacagatctgaaggctgctgggtagggacaggattagaacaaagggaatgagattgaatgttatttaagggatatttctgtcaagttttggtttctcgatgaattgccattcagtctttgagtgctatttctgtatttctgtcattgttgtttagttttgtttctaaaatgctcatctaggattagagcattctttctttggtcaattcctgagaatcagtgattctacaaaaataatttttttccattgcttattatacacaaaagattgtgctacatattggggtgggagatacaaagatttaaaagaatctttatcgggagatttgcagcctaataaggaagtttgtcatgtaatgacaaattcttattcctccaatttcctttaaaattttcctgtccctttctaaaagcatttcttactactgcccttacttcaaaatgaaatttccaaatgtggttattttatgttaattatgttttagggtggctacttcctggcatcttttaatcacatcagtgaactgtcttctaattaatgttcaagagaggttatttcagggaggatacaggcaaatagtaatttctccctgcgacccaaacttctggagttttttgtttttgcttttgagacagtgtctcactctggtgcccaggctagagtgccatgatgccatcatagctcactgcagcctcgaaatcctgggctcaactgatcctcctgcctcggcctcccaaagcgctgggattacaggcatgagccaccagtcccagccaccagacctgtagtctaacctaatacaaataggcagccagataaactttctgggccttagtcagtttcatatagctttgaatccactgtagttctcccacatctaatttaaaacatctctaccttccacttccattataacactgagaatacaaaaagaacaaatcctgttacatacctgttatatactccagtctaaactagagtcaaagcacagtggctcatacctgtaatcccaacactttgggaggccaaggtggaaggatcatttgaggccaggagtttgagattagcctggtcaatatagtgagaccctgtctctacaaaaaatacaagaaacaaaaagttagctgggcatagtggtgagagcctgtagtctcagctactcaggaggctaaggtgggaggattgcttaagcccaggatttcaaggctgcagtgagctatgattgtgccactgtactccagcctgggcaacagaatgagaccctgtctctaaagatacttttttaaattaaaaaattggctgagcttggtgacttatgcctataatcctaccactttgggaggccaaggtgggaggatcacttgaggccaggagttcaagaccagcctggccaacatgacgaaaccccatctctactaaaaatacagaagttggccaggcatggtggcactgtaatcccagctactcaggaggctgaggcaggagaatcgcttgaacccaggaggcggaggttgtagtgagccaagatcatgccactgcactccagcctgggtgacagagtgagacttagtctcaaaataaagaaaatagcttaaaagaaaaaaagaacccactgaagtggacaacgttttgatagttaaaagaataagctatctcttcctccaaagatatcataaaaatgaaagaatattatacttaggtaataaggtgcagtagtgatcagaatgttatcactctgtatctgtatttaatatgcgttactattctatctccaggttttaaaagtgtttgtgtgaggggagggttgtgaagtcttgtgtattctgatttagaatcagtgtgatagaaccaaaaaggaactttagagattatgtggtccaaagcactccttttacagatgagaaaactaggacctgaagaggtaacttgtgcaaattaatagccaagttgagataagacattgtttcacattattcccactgtgtgtctcttcaagcatgtatgctgtgtttctttcactatgccacacttactctctagtactgaactccactgtaattttagaaaggatgtaggaaaaacaagttggtatatgcatgggagcaggtgtatttaagcccaagacattcataaaacaagagccactaaaattttgcctcagtgccatggggattactttgttctttttagcaactgcagacattattgatggattgatttctacatagaaatactttacatgtagaaataaagagtttgatgtatgaccttttataaatccaaagcaaagaaagtgaatatacatcctagggaaattaagtgctttacctcaaaggaaatctaagtgattttcacactaagtattgaatggtttgttattgatgttttaaaagtacagatattttaattagccaggcatgatggtgcccacctttggccccagccatgccggggagctgaggcaggaggattgcttgagcccaggaggttgatgctgcagtgagccatgctcgtgccactccagcttgggcaagagagaccctgtctcaaagaaatacaaaagtaaaaataaaggtacagatgttttaattcatagatttaaaatgtagtaatcaatgtttaagaaaatttaatacttaaaatagactgcattaaaactaaacagaatttcatcagcattcaaaatatttgcaagatggttccatgcagtatacttaatattttaatttaatttaatttttaatcccccagagcattcttgcaaattgcaattttagtaattgaccaaaaattggacaatgtgaactacacgtagatcacacttagaaagaaatgtcagtgtattccatggaatacattggcctagcagagcttataagatcagctagctccccgaccttatctctcattttcccccttgttcactctacccaagtcatattggatctttacttttcccgaaacacaccagacacactgcagcatcactgactttgcatttgctattttctctacccgaaatctcttgccccagatagccacatgatttgcttcccttacctcatggaagtcttcattcaaatataacctcatcaaagtggccttccttacccattctgtctaagtagtagcaccaccaccatccctgccccccaatatctctataacccagggttactcaacttcagcacaattgacattttaagctgcataactcttgtgttgtacatacaaggaaggggtcatatccattgtaagatatttagaagcatccccagcctctacgcactgtatgccaggtgcttccagttatggcaatcaaaaatgtcccctgggggcaagatagccccagtctaaccccttatgcttttttcttttttttttcttttcttttttttttttttttttttttttgagatggagtcttgctctgtcacccaggctgcagtgcattggtgcaatcttggcccaggttcaagtgattctcctgcctcagcctcccgagtaggtgggactataggcgcccaccaccatacccagctaatttttgtatttttagtgaagacggggttttgccatatgggccaggctgatctcgaactcctgacctcaagtgatccgcctgcctcggcctcccaaagtgctgggattacaggcgtgagtcactgtgcccagcctgctttatttttttattttttattttatatatttttttgagacggagtctcactctgttgcccaggctggagtgcactggtactatcttggctcactgcaacctccgcctcccaggttcaagcgattctgctgcctcagcctcccgagtagctgagattacgggtgcccgccaccacgcccagctaattttttgtatttttagtagaaacggggtttcaccatgttggccaggctggtctcgaactcctggcctcaggtgatccacccgcctcagcctcccaaagtgctgggattacaggcgtgagccaccgtgcccggccacaatacattttcttaaatgcgctaaggtcatcttgagtcatttctctgttcaggttgtttccttctattataattaagtttacatatgaaaatcagtgagacctaaggaacagaagatatttgaaattacttgtgaacatcaaactttattcacaggaaaatatatactcaagtggttacaaccctcaggacattagcctttttctcaataaattaacttttggtcattgatcaggttttttttttctatttttaaaagcttcagaataaacatcattcatttaatcagcacttcaagacatactctgagaaacttcagtagtacaaaaattaaaaggttatttatagagtcatattaaatatctgctttcctcagtagtgcatttatttttataaactctatatttgtcttgaattaatgtttgtttacattaactcttaaaataattggcactgaacatgactgcttaatttcaggtgtactttgaaacagaatcagcattaagttcatataagttctttttggagcaatggaagaataagaaacacaaaattcctatacttacagtagaaattgttctataccatggaagtgttttgtaggtttacgatctattagttctttttttaaaatcctattagcgccaagttaataataattgtattagccaactatgcttccttgaacttagggatgctctttttaagtaaatctacttacacattgcttaaatcacaggatacatgatgtaaaaccttgctttttccatttaaatgtccatttccctttcaaacaactttatgttccccacaataagaaaatattttatgtaagtgagcttatgaactgaacctcaaatgaagggaaatactctaacttctgtctttcaattttttttccttttttgcttgctctccttttttacaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatgtaagtatgtgaaaattcacaattattagaagtagtagatgttccctcgtctagtgggatgttatagtattaagtactgttatgttaagttcttaaatatatcatattagtactgttataacatttctgtcatcctgcccactaaatgtacttcttttagctgctggaatatcttaacaaacgaattgagaaaaagagcactgcagaaacaaagatataacatgataagatgttaaggtgataagttatataaggcgaacagtctcctttcatgtcatcattaaagggcagttatcaaggtgctaagtgacatctttgaagtgttctctctcccgtggtgaacagtgtgctccaaaattttaataatacaccctgactcacagtctcggaagcttcctgagctgaactttctcattaaaaagttgttttccactcttgtggtaggggtatttaactgaaccattctctctaggatgataattttgataattaaaagtttgaagcatatcttttcagtccattggaagaggcatttaacatttttgttttcttctctagtttcatcaaatattcttcaaggttaggggctgagtttttaattctttcacccccccaccccactcccagaacttagtttggtgttctctactcagtgcctggaaaatgtatacatggcacatggttcttcaatgcctaccactattggctgctagcaagtgaggtctagattttttagacttatgccattttcagtctgtatttattgacagtgtatttgagatacgtgttaaaaatagctggctgggtgtggtggctcacacctgtaactccggcactttggtaggctgaggcaggagggtctcttgaggccaggcattcaagaccaacttgggcaagttagggagaacttgtcagcttgggcagcttagggagaccccatctgtacaaaagaaaatttttaattagcccagcctggtagctcgagcctatagtcctagctactcaggaggctgaggcaggaggattgctcaagcccagtagtttgaggctgcagtgagctgtgataacaccactgccctccagtctgggtgacagagcaagaccctgtctctaaattaataaattaattaattttaaaaataaaagaatagttgttgcttcttccctcaattaaggatacctttaagattttattggtgtatttattattaatttaaggctgagtttgactagatcttactagggattcctttcagtatatcacaaactagttatcagtgcctaatatttatcacaaatgtcccagcgctcctatcctcctttgtcatggtttatttttccccaagacaactgaaacgatagcatgtacttccatcagtaactgtggctcaccatagcaagtgaaattttgaaatgttctttccaattagaattaacacctttagaacactgtagtagtccaagaagcaaattgactaagtaatgatgcctactcagctgacagcattttgtgattgtttttaaaatgcacacttgtcggccgggcacggtggctcacgcctgtaatcccagcactttgggaggccaaggcgggtggatcacgagctcagaagatcgagggccatactggccaacatggtgaaacccggtctctactaaaaatacaaaaactatctgggcgtggtggtgcgtgcctgtaatcccagctactcgggaggctggggcaagagaatcgcctgaaccagggagtcggaggttgcagtgagccaagattgtgccactgcactccagcctggtgacagagtgagactccgtctcaaaaaaaaaaaaaaaaaaaaaaaaaagcagacttgtgtcataattataatgatatcgttcctgccgttttcttttgaaatactgatttcctcccaccatttttttgtctccagttatggccaaagccttttgttttgaattctatgttcaatagtaagttgcagtttatttgcaatttgagcacttgcatgttttctgatgtatcacttgctccccttttaactgcatggttaattgtgaatttaaagtagcgcagagcagcagttaactatgattggctgtttttgataaaatgtattgctcagaattttttaatctattagaaagaacagaccaaaatcaataggatttgcagtgtgtcattatattaaggacaaaattgtaaaagtgtctttgaaaatgatcttggggaaattgttaattttgtagattttgaaatgtagtttttacacagctatttgtggcttttaagggaggaggtgtgattaccttagtatattctttaaaagtaaagaacatgcacaataattttggcaacaccagggctttaagaaaacaacattcgtgaggacattttaggttagaatatacattttagaattggaaggaatcattatgtttacactcctacacttttcaaatgaaaagaaacaaacttggatttctgaaaaaggaagtgacttttcctttttgcctaacattacacagaggactagtggctttttccagtacctccctgctattcaagaaatttgaaatatcaaggacagtaaagtaacctacctgaagttttcagatgctactactactatgactgtattaaccaaatgtctgtccgcacccatctgccttgtcatcagtgaaacatcttacaaattgtcaaacaaaatatgggtagagcttagttatccaagaaatagaaatcatgttattcctgttagatattggcataaggaaatagatacaaacatgttcttgcttgttaggtttctgctttttctttgaattgttgcttaaggggtgttaattgcaaaccagactacaaacaaaaacagtttatgttaatttcagagaaatgtctgtgtgtgtgtgcgcgcgtgtgtgtgtgtatggcaaaaaacagtcccaaaattatatgtatgtaaactttaaaggtgaaaattaaatttaataccctgctttttaaaattctaagcacttcaaaactaaaaatactggatttttatgcttacaagataatgggactttttttctttgattgttaaactagtatggcactttcagcagagaagtaagctgcccagaacagtcttggacatatagtaaatactatataggtgttagttgctggggtagttctttctttaaaaaaaaaaaaaagaagttatgtttttcaaatattactaagtttaggcctacaagacattccaaaataatggaaaaattcaatcctgcctctttggaaacattttggaaataagccccaaacactggaagccagtcaattctttttttgcaattctttctgaaatctttctttcttaagtcatatgcctctggattgttttggtttggccactcgtcctgtgttgagctaactctggggtcaaaagaagttagccggttgctgagagtctttgagagaaagaaggcgaaacttaataaaaggaataaaaaacatatatattccataacggagactgaaaaagatgtatagatcaagagtggttatggcttcctgaaaaaagtacagcaggagttagctcacagatgataaagcaagtctttccttgtggagagaaaacagcacaaaacagtgagctcattagtatcacaacgggcagctttgaaaagattcattgagaagactccagcacagtagtcagccttgtgctatctctgatttcagagatttcttgtcaagccaaagcttgtactcaaatagttttatcatccacttaagcgatttctttactaaagtagaaagtaaaatgcaaattcttgtgtagtgaatcaatatcatagacacaaatcttcagttctttcttatcatttttactttttttttttttttgagacggagtttcactcttgttgcctaggctagagtgcagtggcgtgatctcggctcactgcaacctctgcctcctgggttcaagggattctcctgcctcagtctccagagtagctgggattacaggcatgcgccaccacgaccggctaattttgtgtttttagtagagacagagtttctccatgttggtcaggctggtctcgaactcccgacctcaaaccatccgcccaccttggcctcccaaagtgctgggattacaggtgtgagccaccatacctggcccatttttacttttttaaaaccaagggaatagaggaaaatactatgaaactaaaagtttaagcttagctggaataatttatttgaaacaatttagaaaatgaaggtcatgtaacttttgcaagacctttgaaaattaacaaacttaattacaactttgcatttcattgccaagcataagaaggagttttactaaagctatgtaaataattgcattaggatatatagcagagacattctatatatatgtatatatatgtttaatttattttcctttttttttttctgagacaggatcttgctctgttgcccaggctgaagtgcagtggcccatcttggctcactgcaacctccatctcccgggttcaagtgattctcatgcctcagcctcccaagtagctggggttacaggcatgcaccaccacgcccacctaatttttgtatttttagtagagactgggtttcatcaagttggccaggctggtcttgaactcctcctgacctcaagtgatccacccactttggcctcccaaagtgctgggattacagatgtgagccaccgtgcccagcctacttttctagttctagttattagttcgaattcccagacgttctcttttttaaatatgaattaatccttttttctgtgacataaacaaatttggatttattttttagctgaaatcatgatcattgaaacaacctaagttttagaagtaaatgattcttgaagcagaagcactcgtaataagaaaaataactttacatatctcattctgaagctgtaacacttttgtcattgcagggacttgtggtatgttaggcatgaagaaatgcacacctttcagattttaacttattagacaatgaagtagagttcagaaagaagtagactagtgactattgtcttttcacagagcagctgcgttgttatcaaaaggagagctataggatcaaaatgcatcacagttaaggcacagttggactaaaaaatcagattgtaaataaaaatattttaatcatttgaaaactgcctgaagtgtgtgcgtaagctccatactgttgatacttagtgaaagtcagtataatggccatagagcaggaagggtgatttcattggttgtgtttagtatttagagtagtgtgtatgtgtgtgtctgcatacatatacaaacatagacacacacagacatttattctaaaattccacctccaaaattactggtaaagctagcacagaatcacaggtatggaaatactgagtaagcttgattttgtaaaatttaagtgcttactaactattctctcaaacaaaattttatttgtaagtccaaagaaagttaggatttaatttaagaaaggtaacaggaaaaaatgactaagtaatagggccactgacaacacatacagcaacttttctaccagttactaaaagtcactttctctagatggattaattacaaaaaggtaccctcctggaaagacaaaatacaacaaggcactcctttcggtctgacacagtcctgtgcgagacacaaggcttggttagtatagcttgggctggatttctgcttctgctcgtgcctgctctgacacatacaacctgaactgttatgtatattgtaaccctgttctatgaaccgcagacataggctgcatcttcctgagatgtgtgtgtgaatacatatctgtcacgaatgttaaaggtctttgaattgcatttgttcagcaacttttccattaagtcttaagttttctttcaatgaatccacttaaatggaattctaaacgccatttaaagaaagttgtatacggtttctacatcttgctcctgttttactggctttgactaatttagccacgcacattggtggatcaggaacacatttggaattaggtacattccaatacctcagaaaaatatagacagatagaatgtccaatcagatagctacacagtactaggatgtgaaacttactgtgttataacttgcttttgtacaattagaatgttccttactgtgaagagaagctggacttcataaatgccccaataagacaatcactgaaaagcctctttttggtgtttattcttgatagtcatctattactaccagcttaacacattttttaactgcattattctgtaacttttgatttaatgaattcttaatgagctaccccattatactgtaaaatagttttttggttaaatcataaaattttatctttctttgcattaagaatttttattaaagtagggggattcttcaatgttttctctccaggaaaagaataaagccttccttgtttgtagaaaattaacagatttacctgtgcctttgaaccacattagtttttggcttaaagtgagttcaatgcatgtagcgcttaatgtttttgacaagtgtgtgcaattgacattctggtgcttcattttcagaaggggtattgtagtacttgtttagcatttcaaaaactcaagcccagttttttgtatcttttaacatcagctatggaaaaaatgtaagtgatcaagatataaaagaatataaatatgcttattgtgcatagtttgaaattaattgtgaatcaacaaaattactttaattaatagatttttcaagaggtaaaaagtagtgatattgccaagaccttccgcaaagcaatcaacaggaaagaaggtatttgtgctctgggtggaacttcagagttgtccagcgaaggaacacagcattcttactcaggtaatcattttatatgcaataggttaacacaatgtgctaagtgggatggttgctgtaatgtcaaggacgggctctagaaaaacattaccttctaattaagaatacagtagaagtcctttgtgacatgtatttaggcttgagactaatacttgtcataaaggcattataagtgtttattgtatggctttgttagcttgcaagagacaggatacaatccatgtaatgacaggctttattacagtgcattatacagtaatataaatataatttttaaggaattttgtaacttttctgaggactggttaacgtgttctattctttttcttaattttgtaattcctaataaccactgtgttgcatccaagtgtctgggtttccacacagaataaccacatgtttctgacacattaactttcagcactactgcacaactattttaggctttggagtcaaatatttaataagttagagtatgaactaatgtcttgttatttaacataattttagaggaagaaaaatatgcttttgttaactggataaacaaagctttggaaaatgatcctgattgtagacatgttataccaatgaaccctaacaccgatgacctgttcaaagctgttggtgatggaattgtgctttggtaagatgttagcttgttttatatccagatatccaaaaatagccttccatataattgatatatttgtttctgcatgcttgacaggttcacctcaagaaataactagaatggaaaattatccaggttctgcctttttcatttaatctctaggtctgtccatgaatctaaaattcagccataaatcgacaacctctttatagggaagctctcagcctccattttcttctcaacaccaggccagcagaacattacaactttgttgaacttaagtatgtcagtgtctctttattctaaagtaccacagcttccaaaagaaaaaaagaggctactcttcagttctcactctccaatgacctatttctaaaaaatgcttttgtcactgctgctgccccacagccaacagcatcttggcagacataacacaacattatcaacactgccagtcgatgttccaatttatagaggcagtgtcacacagtggttaatagcatgctccataatcagtctgcctgacttctttctattcagtcctgccactctgaagcggtacaactgtgatcataatactcaacccctttgcatttcagtttccatctgttatgatctccacattattatacttatctcacagggcttttgtgagcattaagtaaattactacatacaaagtgcttagggtagtgcaactgacatatttcagataactatatatatataaaatatatacatatatatgtatatatatacatatataaaatatatgtgtgtatatatatttacacatatatattttatacacatatatacaaaatatatatgtatatatacaaaatatatatgtataatatatataatacatgtatatatgtatatatatgtataatatatgtatattatacatgtatatatgtatatatatgtataatatatgtatattatacatgtatatatgtatatatacaaaatatatatgtataatatatataaaatatatattatacatatatgttatataatatatgtatatatacgtatataaagtatatattatacatatatgttatatataatataacattatatatatatatatatgttgtgtgtgtgagatggagtttcgctcttgttgcccaggctggagtgcaatggcgcaattttggctcaccgcaacctccgcctctgggttcaagccattctcctgcctcagcctcctgagtagctgggactacaggcatgcaccaccacacccggctaaatttttttattattatttctttacttttagtagagatggggtttctccatgttggtcaggctggtctcgaactccagacctcaggtgatctgcccgcctcggcctcccaaagtgctggggttacagatgtgagccaccgcgcccggctgacagtatatattatagtatacacaattcttctttttgcagtagggtcattttggttgtttgaaaagctgatattaaaaatgtaagataggctggtcatggtggctcacgcccagccctttgggaggcagaggcagcaagatcgctgaagaccaggagttaggtccagtctgggcaacaaaacgagaccctgtctctacaaaaaaattaaaaattaacccaacatggggttgcacccctttagtcccagctacttgagaggctgaggcaggaggatcacttgagcccaggagtacaaggcggcagtgagccaggatttgcaccactgaactccagcctgggtgaccctgtctgtctaagaaataagaatatatatatatacatttcctttgtgttctgtttacaagcagtgaagaaataatttcccatgtgtgtgttttgtttttgtttttgagatggagccttgctctgtcgcccaggctggagtgtagtggcgtgacctctgctcactgcatcctccacctcccagtttcaagcaattcttatgcctcagcctcccgagtagctgggactacaggtgctcaccaccgcacccagctaatttttgtatttttagtagagacagggtttcaccatgttggctaggctggtctcgaactcctgacctcaagtgatcctcctgcctcagcctaccaaagcgctgggattacaggcatgagccaccgtgcccggcctcccttgcattttaatatagagagaagactgcaagtttccctctctggggactcaccctgcagaactcaaaaaatctataaattgtaaaaataataagagataatcatattgaactaactaagatttgaattttgcatggaaagaagcatggctttctttctgtagaaaaaaatttattagggcagtattatgaacatctaatatgttagagccaggcatagtggctcgcacctgtaatcccaggtacttggaggctgaggttggaggatcccttgagcccaggagttcgaggctgcagtgattcgagctacgatttgggcctctgtactgcagcccaggcgagagttagaccctgtctctaaaaaataacaaaataaaaaataaaatgttaaagtctaaatctagattttaccaaatgagatttttcctaatgagtcacagactatagcctacctaatctttctctcgccactatactgccagcaccaaatatagtgtctggctcattgttgaggcactcggtaaacatttggtgaatgaaagaatctcatgctcaactaattttactgttttgtggaaaagactcatttccaatgcaggattttatctgtctttaaaatatattcaataaagttccaccccccacttttttttttttctttgagacagggtcttgctgtgcagtgattcaatcatggctcactaccgccatgacctcttgggctcaatcagtcctcccacttcagtctccaaagtagctaggactacaagcatgcgccactatgcctagctaattttttttttaactttttgcagagatggggtttcaccatcttgcttaggctagacttgaactcttgagctcaagcaatctgcctgccttggcctcccaaattgctagggttacaggcgtgagccacactgtacctggcccaagttttgttttcaatatccaagttattttctttcataaaagaatgagaaaaaattaaaaaaaattgaaagagaaagcatgctacaatcctctgctcagagatacccaactactatgcacatattttggtctttttgggtttttttttttttaacggcatcttgctgtgttgtccaggatgaagtgcagtggcatgatctccgctcacttcaacctccgcctcccaggttcaggcaattctcctgccgcagtctcccgactagctgggactacaggtgtgtgccaccacgctgtgctaatttttgtatttttagtagagacggggttttcccatgttggccaggctgttttccaactcctgacctcagatgatccacctgccttggcctcccaaagtgtgggattacaggcgtgagccaccatgcctggccagggttttatttatttatttatttatttatttttcttttgagacggggtcttgctctgttgcccaggctggagtggaatggtgtgatcgtagctcactctaactttgaactcctgggctcaagctgtcctctttcctcagcctcctgggtaacctgtactacaggcacatgccaccatgcccggctaatttttttatcgtttttgtagagacagggtctcactatattgcccaggctggtctggaactcctggcctcaagcagtcctcctgcctcagcctcccaaagtgctgggattatagacatcagccaccacatcaggccttggccttttttatttttagtttttattttccatatgtgtagtttattatgatcaacatgataaaagtcatctagctgcattttttagagtacatgaaagagatgttatagtaagctttaaaatatttgtaaatatttacagccactttataaaaggaaatcagctctttttttttacatcagcctttttttaaatttttgtttcagtaaaatgattaacctttcagttcctgataccattgatgaaagagcaatcaacaagaagaaacttacacccttcatcattcaggtatgcattgttctcccctccctttaacatgaaattactgtttgaggacctgttctgcagacttcagcctctgcactctgtaggctcccaatcaatccttgtaaaaactgttgagtgtgggattgttatccagattatacagacagaactgggactcagaaaggtttctgagcttgcctgagattaatgttggaactgaggttcaaatcccattctaatttcaaagccccatgttcttttcatttcataatgtgttcaagcactacagagataagcagaagtatataagctcttaattaactggcgtgcttaagaaatggagcatttttttttctatcaagtgaatattagattattagcaaaattccctcagagaagagcacctcttgggatgtggacattgataacttctaaaactcttttgggcatatgcagtactgttggtctctcacccatttaggcatttttggaattataacactttactcacatggatatatttactgtggtactcagccttttcatttagtgccagcatacttcaaaaggtaccaaataaaaatacaaagttaacttctcatgagattctgcaaaaggcaatagcaataaggctgaaatttgtcttagctaggctttctaacacaaaactctggaatttgttttttgtgacacatatatggatgaaattaatacagggtattaatttcctcattgaatgttattttcagtgaagggagaaagtagactgctaaaaaatggaaaggtcaagaagcaagtgtgtaatttggctgtcttgcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaaggtaatggaacacagtcattctggcagttgtttattggttatttttttctagtcatgcagactttcgtgctctcacttaatggaggtgattaaatggtggtaactagaatgaacataaggtaatgctatagagttattcaggaaaatagcctaattacatgactctcttctttactagtaattcacatttgtctggcactttacaattcattttgcaataatgacacaaaagcacagagagattaaggagctttcctgaagtcctcaaacttgattatctatttttttctgttctgcctacacaacttctaccccgttgccaccctcagctccaccattttgcaccatcttcttttttggagacagggtctcactctgtcacccaggctggagcgcagtggcacaatcagcctggctaacatggtgaaaccccgtttctactaaaaatacaaaaaattagccaggcgaggtggcacgtgcctgtagtcccagcttctccggaggctgaggcaggagaattgcttgaacccggaaggcggaggttgcagtgagctgagattgtgccattgcactccagcctgggcgaaagagtgagactctgtctcaaaaaaaaaaaaaaaaaaagaaagaaagaaaaaaaaagagagaaaatgtaagattgcaaccgggtgtgttggaccatgcctgtaatcccagcactttgggaggccgagacaggtggatcacttgaggccaggagttggagaccaccctggctaacatggcggaaccccgtctctacaaacaatagaaaagttacctgggcgtggtggcatgtgcctgtagtcccagctagtcaggaggctgaggcaggagaatcgcttgaacctgggaggcagaggttgcagcgagccgagatcatggaggcagaggttgcagtgagccgagatcacgccactgcactccagcctggtcaatagtgcgagactctctcaaaagaaagaaaagaaaaagaaaatataaggatgaattatatttctgttaaaataggattgagccttcaagagttaattgattaattttacttaaatacaaataccaccgtgtttctagactactttaatcaaaaggttaagtaaaagattcccaaattgtaaacatctttcccccaaatccctgactttttttttttttttttttgagacggagtctcgctctgttgcccaggctggagtgcagtggtgcgatcttagctcactgcaagctccacctcccgggttcacgccattctcctgcctcagcctcccaagtagctgggactacaggcgcccgccaccacgcccggctaattttttgaatttttagtagagatggggtttcagcgtgttagccaggatggtcttgatctcctgacctcgtgatccgcccgcctcggcctcccaaagtgctgggattacaggcgtgagccactgcacccagacccaaatccttgactttagaagtgttaaataagaacaacttatacaaacatatgacataatgtgaagcttgcattaagcttaaaggccataacctcatttggtatttgaaatgtgaagaataacagagaaaagaataaattgtagtattatgttattatatctgttatatatttatcttttttagtagattatgagtatcttgaaactaggaactatgtcatagtagtttttgcacctctattacttaacagtgtcaaaagactgaatgaacttggcatgaccattattgtgtcatataataactgtgggatttttttttttttcttctagccttggctgctttactccgagatggtgagactttggaggaacttatgaaattgtctccagaagagcttctgcttagatgggcaaactttcatttggaaaactcgggctggcaaaaaattaacaactttagtgctgacatcaaggtaactgttgaaagaatcacaacattttggggggatataatagctggaagatttcatcccagcttaacagagagaaaatcctaacactgtatcaccaagccttgttgtctcttggccctgaaggtagattttagaagagtaatagagccagataaggtacattagcacctatgttttattttgtgggaaaaggtaaaaatattatgctaatttatcatattataatgctaatttgttatatcctgcctattggtaaacatggagtattaaagaataggacatgactattctattcttaactgcctttcccaagcctcagtgtacctgttagtaaacacacctagaagagataggaagggcctcatgatttcctcttcaccttttttatttggcttctctcctgtcattttatcctacctttagttgtgagttcctcgaggatagcaatgagctcttatttatgtctgtgtatcctacctcagcccctgctccagggccctcctactaaagccaacttaaaacatagtatgtggcatatacaagaccctcatatttcttgcattgaattgaatttttttttcactcactgtttatcatgagcagtgggggaaaactaacaatggaggaagacatttattacatgttgcctttggcttctcatgcagagggccaacattaccatagcaaacattgtgtggagttctccttaactgcctcaattctgtgtgacatccagatgttggtacacagggaataaacttaaggatcttcatcagatgtcactgaccagcaaggctgtgaaaacaatactatgtgatgatatgattttgttcagtgatgagaggaagcagtgagttgcctgtactactgatttcatccatgaaaattaagagtagccccaaaattataagaccaactgaccctgccctctcttttaattacacaatatgtttggccaggtttgttgttgttgctgttgttgttgtgacagggtctcacttcgtcacccaggctggagtgcagtgctgctaacatggctcactgcagcctttacctcccaagctcaagcaatcttcccacttcagcctcccaagtagctgggactacaggtgcacaccaccaagcccgattgatttttttttctttttctgagatggagtctccctctgtcactcaggctggagtgcagtggcactatctcggctcactgcaacctccgcctcccaggttcaagagattcttctgcctcagcctcctgagtagctggaattacaggcatccaccaccacgcctggttaatttttgtatttttaggagagacagggtttcaccatcttggtcagactggtctcaaactcctgacctcatgatctgcccacctcggcttcccaaagtgctgggattacaggcatgagccactgtgcccggcctgatttttttattatttgtagagatggggtctcactgtgttgcccaggctggactcaagctcctgggctcaagtgatcctcccacctcggcctcctaaaatgctgggattacaggcatgagccatggtacctggccagccaggtatattttgcttcatgcactagatgcgttcctgaaaatcagcaagccaaccataaatggattttatgtagtgggatatattttaaatgtaaagagaaaatcttatttttgtaaatgaagcctgctttgaatttttttattttttattttttaaattattttttgtttatttttttttttgagatggagtcttgctctgtcgcccaggctggagtgcagtggcgccatctcggctcactgcaagctccacctcccaggttcacgccattctcctgcctcagcctcctgagtagctaggactacaggcacccgccaccatgcctggctaattttttttgtatttttagtagacatggggtttcaccgtgttagccaggatggtctcgatctcctgacctcgtgatctgcctacctcggcctcccaaagtgctgggattacaggcatgagtcaccgcccccggccatcaatatttttaaaaaggaaataattgtttggtaatgtgaaaactaacttccagtttatctgtattcaagttcaaattttcacctgtaaagcccttttcagggtagtaaatacagattttgctgggtctgctctttacttgttcttctcaagagcataggtttattataaattgtttgtgtagctttagcaagtaattggaagtgaaagcactttcgcaattgtagtacactattccttaagaggtaaatgctatgcccccaaatgatagaatcggagttggcattttatgaattgctctgaaatagctttcaattacctgattttccccattcttagaatcatttatggcaccaagtttcaaactcacctgggtaactggtttaaaaggcacctttctgggcagctcccagacatttatatttggtagctcaggaattggattcagtaattcacatattgagtaacttcctcaggggttagtatgcacatagactatgagaaacactccttcatagcctgtctggaccttcaaagcccagtaacaggaaactattaatatcgtagctggaaggtggtcttcacatatggcaggattaaggaatcttgactcaaattccggtcctctagcattccaaagatgcaggaatttacttgacacgtgtgtaaaggttcttaataagcgtttgtgcaagtacaatagttttcaagctgtgttttgtggagttgtccacacaacctgaattcatgttgactgtgagccaaccccattgttttatgtattgggattctaagaaaacaacattcaagtgatttagtccaggggtttaaaacgaaaagagacctttgttttgttaagtacattcagatcatagagggttcagtgttattttagcaactaaaatgtttaccatttaatgcttttgtcatttaaatttacaattaaatacatctttaacatagctaatctcttcttcgtaggttgtggtatatgcattgtgctttgtaatgatataacctgtttattttctctttcttctatgcttcctggatttctgctctcctacttttttaaatgcttgttttgtctgtcaagcttattgacttcagtaattcagtgaaggtacagaactggttatatgtttattagcattattgtattgatgactttaataattgcgaagtcatgtcaaaatccagttcatccatatgcaagacagatataaggcagatagatggacttttctggggaaaacacctgttaaattaaaaggcagagatttgtgccatttattctcaaaaaatccaatgcaaatagccttccaaacatgggacaataggatacattcattccttgtaactgtgatctcactgacattttcaattctttgtaggattccaaagcctatttccatcttctcaatcaaatcgcaccaaaaggacaaaaggaaggtgaaccacggatagatattaacatgtcaggtttcaatgtaagtataagtgctcttttgaattctacaatcttgcaaaattattgtcaatttcttataagtacaataatttttataatcgtatgaagtagagttggcaattttaagcattattttaaaatgtattactgtacatgtaattcagaggccagaaaactagctttgatttattttgattgttagtgaattccatcgttgttgtggtattgatttatatggatggcataaaatattcaaaacaagtatggggaaataagtaactagaagctaaccttttccaagtatttggattacaaccacagtaatagatttagtgactatatgaaaaccttttccaagtatttggattataaccacagtaatagatttagtgactatatattcatattcctgtgttgagagtaatgtgattatgttttacaaactcccaatctatgaaatctaatttagggaattactctcagagaccatgttccctggttatgtcactaatttgtttagtgacattggacaagttccttctcaaaattggatttcactttgttcatccataaagtaaggagttagagtgaactatttagtcccaagtttctaggaatctgtggtttttgtacccattagatatggaatgcatgctactaattaacaaaatccacatatctagcctattatgccataggatggagtggattacattggctaaaccatttttcttctctttcttttttttttttttttttttgagacagagtctcactctgttgctgaggctggagtgcagtggcaccgtgtcggctcactgcaacctccatctcctgggttcaagcaattctcctgcctcagcctcccgagtagctgcgattacaggcgcccaccaccatgcccagctagttttatatttttagtagagatggggtttcaccatgttggccaggctggtcttgaactcctgacctcaggtgatccactcgcctcggcctcccaaagtgctgggattacaggtgtgagccaccgtgccttacgtggctaaaccatttttatgctgcccttatcagaactgaatttgtaactgacttgtgtgcttatatttctgtctgtatgttaaatgcaaaactcttcagctcaggtcactcttggtagggatgaggggccatcttgtccaagaagggagctgtctgggttggctagccatgtgatctgataccagggtaaatggcatcagtatgctaaccgattctgatacaccccttctctagtcaatcctttccaattgatcttaaaacactcttttgtctcttccctcttcagaatccgacaaggattcttctgttgactctagaattcagtctgaaatgttctgcttggcactcaccctacaaatcttgctctaaaatctagccagtgttatttccccaaaagtctgtgttccccaccccaaccttccttcccaccaccacccaggtgcctttgctcatgctgttctcatggttttcagtgtccttcatctttttcagctttacaccttctttagggtcttttttttttttttttttttttaagagacgaggtttcgccatgttggccaggctggtttcgaactcctgggctcaagcaatccttctgcctcggcctcccaaagtgctgggattacaggcgtgagccaccacgtccaaccaaggcctaattttaactctgaacagttttacctgttttttatttcaatttaacttttttctcttcgtctttgtaatggaaaaaatcccttcctttcgtcctaacttttttaatccttcaattccctgagattaatccttggtcttgccttccaccattctccctacgctcaaaagaaatcagtggaaatagattctctgcttctcttcaattcaagcaacagttcacaagcatttcccttgggatttgagcatgacatgaatgaaggtgtctgtcttctccctcagccagggaagcctacttccacagctcagcacaacttcctctctctctagctcgctctccagcagtgccctcctttctagttccttctgctgcataacacagccccagaggttccagggttccaaggagtccactctgtcatgaagctcattgacttaatgcacagtacccagaagcctcagtgaagttcagctgagagccagtagaaaaaaggagaaactccaaagcagaaagtagtaaatcagcaaaataaaataaaataagccaggttgaagagaatgaacccacaatttacagaaaatgaacaccattttctaaaggagacttaagtaggactacagttaataccctttcacatttaataattaattgagattcattgtagataaagtacatttgaaaaaaaattttaacataattctactgaaaatatctgaatatttaacttgaggtggcttaaaaggacaattgaagctgttttcctattgagaaggaaaaaaggaaaagtggaaccagagaaagtgaagatggtgaatgtatatttttctctacagattttcaaacaaaatctgggagtttcccccaaccttttacgtaacttctttcttaatgcaatttagttaaatgtactcagtagtttgctgtgtgatctggcgccatctagtgtatattacaggtactgcatctccaagagggccaacctttttttttgcattcaaaacaattttataataagtaccatatgttagctaaaagaaagtagaactgtatacccagactatgacagtggggaaattttctatatttttagtgtggcctttgacaaagtcttccgattttgtttcaacaggaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggtaactaaaaacctcaatttcgaatgtgtgggactatagagtagaaatacataggccacaatgattttacaatctagacttaataagtttttttatatctacaagaagtagatggcagatgctgagtaaaaactggcaggaaagtacgatacaagtgaacttttaaagtaaagtagtcgaggccgggcacggtggctcacagctgtaatcccagcactttgggaggccgacatgggcggatcacctgaggtcagtagtttgagaccagcctgaccaacatggtgaaaccccgtctctacgaaaaattaaaaaattagctggggcgtggtggcacatgcctgtaatcccagctactcgggaggctgaggcaggagaatcacttgaatctgggagacggaggttacagtgagccgagatcgcgctattgcactccagcctgggcaacagagtaagactccatctcaaaaaataaataaaaaaaataaaaagtagtcgagtcgcttaatgtaaagccacttagtaaatcagtatttagttttaatatttagggttagaccactttttaatcctctcatcaggaaaaagtgcacatatgcattcagtttgacctgtaaatttagcatatatttatgtttcattcatccacagtcaatgtaactggaactaaccccaactcctttcacctttacctcctcaagaaacaaatgataatatatactaatttttttttaagttttggaaaggcagagtttaccttttccagattatatatgtgtgaagcgtagtctataaaaattaagaaatgcagccaggcgcggtggctcacgactgtaatcccagcactttgggaggccaaggtggccagatcacctaaggtcaggagttcgagaccagcctggctaacatggtgaaaccccgtttccactaaaaatacaaaaaattaggcaggcattgtggtgcgcacctgtaatccagatactcgggaggctgaagcaggagaatcccttgaacctgggaggcagaggttgtagtgagctgagatcgtgccattgcactccagcttaggcaacaagagcaaacctccatctcaaaaataaataaataaataaataaataaataaataaataaataatgcaaatagtaattcattgagtgtccactgatatttctataaaaccagtaacttaactgataacatcagttactttgagggatgcagattcgaggaaatattggagaaagatttgagaaggagactataaaaagttcataaacctctaaattgcttaactggttagaataaggttgtattctttaattttaaaataaattcaaattttaaaaataagcctgtacctagagagaatgtatgtacttagaagaatgcttggaaactcgtattatcgaaaaattctagatctgaatagagagataaaataatctaatatgtgtattggcactatatgcacatacataaagtgtttaatgaatcagtaaattttgtgaatattcttaacaggagaaactcgtgaagaaagaaccttccgtaactggatgaactctcttggtgtcaatcctcacgtaaaccatctctatgcgtaagccttcctactgctattgtaaacagttacgaatgtcatgaatggatgttaaataatgacagctctaaagattttctagatattaatttgtagctattatttatattggaaaatgtcaagtggtgatttccatcatcattttccaaatacacaaaagctttaagtattcctttacatgatcgttaactgtaagtgatagaatatataaatgtctttatagtaccctagggagcaaatactttatattttgaaacagctgtttgggaggttgaggtgggggcattgcttgagcccaggagtttgaggcttcagtgagctatggttgtgccactgtactccagcctgggcaacaaagtgagatcctatctctaagagggaaaaaaaaagaaaggtaaaaaagaaagaaacagagaccagggaatcctttaagtagaccatccacaacaactcagggactttggttcattgttctctcagcctggaacgttctttgctcgcatatagtggctcgtatccttactgtattccagtcactgattcaaagatttcctgactaccacctgctactctctaacccctaaccctagttcctttttttcttaatagcacttacatacacccctaaaattgtttgtttattgtcaacaaaccaataccccccgtattgtttgtttatccatgtacttgtttattgtctatctctctgactctaatgcaaggacagggatttttgtcctgtgggcccagcctctagaacagtgccttgcttacagtaagctctcaataaatacttataaatgaatgggatggtcttagctctgttttcagcacagattgatagaaaatatgagtcttgggtattatttatggttttatatatcttgtttgacaatgtagtgttactgtttttaaggaaagtcaagtcccagcttcctgaaaacactgattacattatttttaaatcattagtgacctgcaagatgccctggtaatcttacagttatatgaacgaattaaagttcctgttgactggagtaaggttaataaacctccatacccgaaactgggagccaacatgaaaaaggtagataattaagttgctgtatatatttgttagagtatttttattctcgattaatttcttttgtttctaaaactcttgacgctgagcttcttgaggacaaaactgtgtcttatttgtttttgtgtgctgatacctagcattatacaagacacacacacacgtatgcagattaaacaaatggaagtctttaaccatttactcttgtgcctttgcagctagaaaactgcaactatgctgttgaattagggaagcatcctgctaaattctccctggttggcattggagggcaagacctgaatgatgggaaccaaaccctgactttagctttagtctggcagctgatgagaaggtatagtacacaattttagctgtttagtctttactatcatacaggtctgtgatttagtccttactgtgtttaataagtggatatgtcgataactacacttttgaaatatgttatatttacactccgaaatgagtttaattaatgaatatatgttggatgttaagtgggagatgcttccttgcaagttaggcagcagaactatggttagtcccttttttaaaaaataggaagcctgacacacagatttcggcctcgtttagtgtcagtgaattaaaaaattgtcagaacaaaattatgaacatcttcatgctcatttgaaaataaagatctctctctgtaatgctgatgaagatcactataatgctgaaaagcattcattatgactgggcaccagccaaagcacagcttattttatgccattaccgctattggaatagtacaaaatgtgcctacagtgggctgttggacctgctcattaaagcactgtcaatctgctcctctctcaccactacaaagagtagatcagtagcaagccactactgcttgaaatatttttttcacatagtgtgaatctctttccatgaaatctttagtccttgaaatttaaggaatataggggccaggagtggtggctcacgcctgtaataccagcactttgggaggccaaggagggtggatcacgaggtcaggagatcaagaccatcctggctacacggtgaaaccctgtccctactaaaaatataaaaaattagctgggcgtggtggtgggcacctgtagtcccagctactcaggaagctgaggcaggagaatggtgtgaacccgggaggcggagcttgcagtgagcaggagattgcgccactgcactccagcctgggcgacagagcgagactccgtctcaaaaaaaagaagaaaaatttaagaaatataaaaagtggaagataaagcatctttctgatgtttgcatttttcctcataaagtagatggtgacgttttcttctgctgcctctcttagatataccctcaatgtcctggaagatcttggagatggtcagaaagccaatgacgacatcattgtgaactgggtgaacagaacgttgagtgaagctggaaaatcaacttccattcagagttttaaggtcagaatccatatttgactattaaatattatgtttgctggataacatctatcatttgggaaggcaacttttggcttctttgtgagtgagaattagtgttgggctaatggcacaattctttacgaattcactgggctttgtttttggcacttgatataagtaagcacatgttaatttgtatgtatcaaaattctcagatttgttctcctttcacactaggacaagacgatcagctccagtttggcagttgtggatttaattgatgccatccagccaggctgtataaactatgaccttgtgaagagtggcaatctaacagaagatgacaagcacaataatgccaagtaagggagactgctaatagtatgaaaagaacgcagctttgtagctggacagatctgaattctaattcaggttctgccatttaagagtggtgtcaccttgggagaaacctcttggagcctcagattcctcatcaataaactgggggcaataatacttaccttagattttataaagattaaatttttaaaaattataagagcctagccttgtgcttggcctactaggtgcttagtcggttgttgcttcagtggattacagaaataatgtagcatgtattttaatgcaaatcaggtaaaactttacaaggaaaataagagcttagggtgttcatctgtctgtctcattctttttttaaaaaacgcattatccacttatgtctcttttactatacatagatcattcttactacatttattgaatttatcttcatcagttcccatattaacagaatgcttgctagccctccacagaagactatgccttgaaagtttcttgcatttcaacaatattcagaaggtcttttccaccagcctattttcttcttcaccaaaggcctagagtgtgacctggcttcatgggtgacccatgaaaaccttactagttagacattgaaaatccatccacagtcctgcattaccgaacagctaagaagcattcctgcaaaactttggagttaggcacattatttcttttttccttgaaaaatatttctagcagatatgacaaaggtctaatatccacaatatatcaagaactcttgaaatctctttttctagaaactcgatgatttaattatctttaaagattctggttccaacacacctagaaatacttcacggattagttgagatgtgttcctgaaaatttccctacctggacatctcagttcttctgtcccttcgtctaccttttctagtttttggtccagccactctgtccacgtaccacgtagactgtctcccctctcatgaatacttggaagtattcattgcatctgcctaacaacttgggttttgcatctagcatgattttccacctcatatctctaagatgacttgagtgtgtgttattatgtgtgcaatgagaatattaacatggattgtatagacagcctaggtaattatatatataaagttggtgcttcaagcttaattctcacctcacattggagaaaaagagtgaataaatattattagccccaaataatagagcttaaaaacctactgtaacttcaaagtgaaatcaaaacccaaatcaaaagaaaacaaaaagcaaaactgttctaattggaactatcaatatggaatttttgcatcccagcataataattatatatgaggaaatagatgtcttacgtggtgtccttaactgacaagaatttcatcctgattttgtttccccctaaaataggtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcag

SEQ ID NO: 4940 - DNA, 88523 bp, human
gtcgggccagacccaggactctgcgactttacgtaagtgctttgtaggcgccggcgggcactaggggagcgggtttcctgggcgtgggcaggagtgggtcccggggagagcatctcggttaagctcagcaggaacgtgcggcgcaccgtggggcgggggttgggggagagggaggtcggagaaatttcagttggagccctcgggcgcccgggcgatcggtcgcaaccgaaatgggtgtgagtgacggggagtttccctactagcatccgccgcagacacgttttctgcacttcactgtattaagtggtgttttcttactagttgctcttaacttgttgccagtcttgggctggagtcctagacgccagcccttgccctgattcccctccgcggctgcggccccgaagtggaaagggagcgcacaacttccctctgtcgtccttctccagctactgccatcccctcttccctcccgcccggactcaggaaatcccggagccagcagcctgctactcctccagcccccacacgcccgcctcgggtgacctggctggcttaagccgaccctggggctctggagagggggggccgtggccgagggaaggcacgaggtttgggttgcctgccttctgcctgcttccctcccttgtccttagcgagggcgtcgcgaacgcacctagtctccctatgagtaagcactttttttcctttcagtaggagaacatctctgggctagtaggacagtacctttccgttctcccctggccccacaccccctgtccttttttcagctcctttgactttgcggccccgggcgcgcggtcggggcggcggcagtcccggacctctcccgactcttggagagagagaggcaaaggggcgacgggagggaggtaatagtctacccccccgccctttccccgcacagctgcacttgcctgtgtttacttttctccacccgcagtacttaagcgctgtaatgagaggcccggggacgccgaccacccccgccctggcttctcgccagtcccaaagttgctgccgccgtcgctgctccagtgtgctggcggttccgaccgccgggctccgggacgtaagatgatcccagcccgggaggtggagtgggggttaatggcatctgactctagccttatgcgatgctccttgcctctcacctgagctgcacgatatccccagtggtgcagaaggttgaacttttgcagaaggttgagcttggagctaagtgggttggagagcctcgccatttagcgtcagacagacgggatgctgggggcgcccggcctgttaagagggattgggaggagggaagggagcctggctaacagtaggtagaaaatgtagggaaaagtaaaaaccattgaggggcaagcacttactccactttgctggatgtcacaatggactggggagcctaaacttgatcctcgagatgcagttcatggtgaattccaactaagtggctggagccccacacataccagttggaatcacgtgccccaagtctctgatggtcacatgacgtctttttactttaaagctggaatgtaatggttgaggcccatattccaaaaaccacctctacgtttgaaaaaaaaaaggtggggaggagtgtgaactagcttctaatcaaggaagtctactaggattttggatgaggggaccagaaagggaatttggtgctcagcttttatccaaaacaaaaacaggagctgtttttaaaataagggattgaaatatatgtgagctgggacatgtatctcctctcttcttcaatctcatggtttttctaaatttaaaaaacatcttactaattattttctagggaagtcatcctattactcatgcctcattttgtccctgaatactagatttgaagctaaatcccacaagatagtgttaaaaagtaaggctctgttcatcttccttggtctggcctatattctaattgaactgttccctattttaggcaactacttaaaggtagtaaataacctcttgactaaaattaaccaccagttatttgtggttttcaattaactggattagaaatcatgcacaaaaacagtggatagtaaatttgatacatcgagttggttgggtttttgcctgtcagtggtttggtagaataatgagaggacactgaaacaactttcccatattgacctatacccgcccaagtggcccaagttaaggttgcttctgggaaaacgtggcaatttggctattcagattatatattacagagtatagaagagaggcagaggagcctctgaggtcaggagtttaaaagctttgcttatctgaaaaaaaaagaaaaaacggacctggttgatgcatattcagtcttgaaaacaactagggcagaagatatttaagagattctgactttgtattcttttgccaaaaaccctttgtctcctgcagcagcctctgaatgaccggagcactccagtttcttgctgttcatccgtttctgagcctgaaaactagaacaaccttaaagcacattgttctgaccccaaggctagccttgtggcacagatgagctggaaatggatttaaggtgcacctgagttactagagttaactacactggtagatagacccctctagtggaagtgaggtgataatataattttagatcgaaataataaatgtttaacctcaaaaaaaggaagttattaccactcaactaggttacagtggtagggggataagttcttttttaagtattgtgaaatcatgtctaaacagaatcatcgctaggctctagtccacagcttttcattgtcttgggatgcctactcattgaacaccacccccaatattgctgactttttttggtggtatgatctaatgagcccaaatttttattgaaattagggggctgggagtcaaattcttgatttttactgttagatctagcagatagcaacccctttacctgaggtggggagctattaataaataaataacactttgccttgacttaatacagacgatcaacattgaagtccaaagtctctagtctgatgtaaccatttagattcaattgataaaaatgactaggcttatggcattttgggtagaaggattaattataactagtgagtaataatttgggtgagattaagcctcttccacaagtggttacacgcacattagactttgactgtgactgtttatactggcagaatgtcagtatctagggcactatcagaaacccaatgagatttttctcccaggagaacagaattctgttactgaaaataaaagggcagcttggccatggtgcttgagcaccaaagtggttctttttggtgacactgagagggtacaagaagaaagtccatttgccattatcccatattctgttttaggcattatttctacttggattttcatgaaatgtactgacagtgttcttagcacatatgataaattcatgagtttgctgttgtgtttgatctagcataatctatgtggaatgtataagctgaactgtttcttttttgatgtttggtacagattatgaaagtagctggtataaaataaaatttgaaaatgaatatctctcaatacatgacaacaatggggtatctgtttttagaatcatgttgtctttggtcatatggcaatttttcttttggtgaagagtgatccagaaggcaaaatttttgatctgtgaaaataatacaactcatttagaagaagtcagctgggtcatgttttgagtctgtattattttagacagtgatataccatataatgtatattcagtgtgttggaggtttcaaagctttttggatacattacaatgttggaagatttttatataccagtggtcatgactagctgattttagttatgagagcgctttggttaaagttatggaaacagtctaatcgtgaaatgtcagtcttagaagatctgatcatacttgggccaatttattttagttacggaggtgagacaatttcagaagattcacgataaatttaataataccaaattttgccttagtcttgacacttggaagataaatattagtgagtataaactgttttagggatgaagaagtattgttagtatacaaaaatgaaaatactaattattttagcatgggtcttttagtcctttgcagtctggacagatagattatcttaagtaaatcattgaacttgccctcagaggaattagattctagatagtgctctgccattgactcataatttgaccttcggaaagtcatttaaaattattatattaataactaattgagtacatacatgtgccagacaccattcatgcttttgtttataaaaagagaggattgctcaagctttttggtttgctgggttttattttttcaaatattcataatctggcttatttcacttatcagttgacttttcaaactttgatgcaattgcattgatccaagctaaatactttgttggcaaattgatgactattcaggaaagtgatcaccagtgggttattccatgactaatgttagttctttaaaataaagaggtgccatttatttaattccttgacagggatttttggtgcattaagcctactgattttataatatgagaaaccttacattttcttaaaagtttagaaacgtatttgataataaggaggtagtgttgtttattggaaaagcattgagcatagaatttagggtcttttagtcctttgcagtctggacagatagatgatcttaagtaactcattgaaattttctgtggtcatatctgggtttcactttatttttaagccatgtgattccaatctacatatttcacaggcatggtaaaaggataagtgagaaacgtgaagccttggcttttaagcagacaggtgctatataaattcaaagtactgcagcagtgtatcatagaaacactaaagctttaacaagagtttacagaaatggcagggttctcatcacgtaagtcttgccacatttttctttgtctgtaaaagttctgcacccatccaatttttacaagcaaaggaaaaataaagccagacatattataatgaaaaataagagactaggttgataacaatagaataaaaacctacatgtgatactttcttcttcttttgttttgttctgttttgttttgttttaaagacggagtcttgctttgtcgcccaggctggagtggtgcagcggcgtgatctcggctcactgcaagctcctcctcccgggttcaggccattctcctgcctcagcctcccgagtagctgggactacaggcgcccgccactgtgcccagctagtttttttgtatttttagtagagacggggtttcaccgtggtctcgatctcctgacctcgtgatccgcccgcctcggcctcccaaagtgctgggattacaggcgtgagccaccgcgcccggcccgttttgttttgttttgttttgagatggagtctcgctctgtcgcccaggctggaatgcaatggcgtgatctcggcccactgcaacctctgcctccgggttcaagtgattctcgtgcctcagcctcctgggtagctgggattacaggcgcgtaccaccacgcctggctaatttttgtatttttagtagaaatggggtttcaccatgttggtcaggctggtctagaattcctgaccttgtgatccgcccgccttggcctcccagagtgctgggattacaggcatgagccaccgcgcccagcccatgtgatactttcttctatttcttacctcaaatattgtgcaaggtagcccgttaaagccattaattgggtggtgtttttcccctttttaactaactactgagtagaattttggtcttcagtggtaattgttacagagtccattggcttaccatacctcatttttagttttgtgattgcccataatgggaggtttcgtgtaaaaaacctcataaaaaatcaagtttttcctcctcataattgcagtctaaaggaggacaacacgcaggtctgggaaactgcatagtggaagagataatctatacatttaagtagcatgccatgaataacacaaaaaatggcctggcacggtggctcacatctgtcatcccaacactttgggaggccgaggtgggtggatcacttcaggccaggagaccagcctagccaacatggtgaaaccccgtctctactaaaatacaaaaacttagccaagcacggtggcacgggcttgtagtcccagctacccaagaggctgaggtgggaggattgcttgagcctgggaggcggaggttacagtgagccgagattgcgccattgcactccaagcctgggctaccgagtgagaccccatctcaaaagaaaaacagaaaaacaaacaaacaaacaaaaaaaaacagaaaatgtgggaagttaagttgaaaaataaacaccttcaaagctattaacttggattttcttttcttttcttcttcttttttttttttttttttttgagtcaggttctcactctgtcgcccattcatactctgtccagttcattgaaaatacaagtctgattcccttgagttgtgatattcatacacacacgagtatatatacacttatgtgtgcatatgtatattatataaagttttacgtgatatataatataagtttttactttctgtaaaataaaatttgttagggccgtataatagttttgaatattcatattattgtgttccacattataagctctaattacatcgtgttgcactcagattgacattctgctgttgacactgaaaataacgctttcattcatagatgaatgtaattttcaagctttttttctatatttcttaacttgcttgaatgttcccatttttgccatttcttgttgttcattttaacattttggggcttgtgtttcagatcaggaagaatcaccattatagggtgcaaagagtttgctcagaggtgaaaatgatacgaaattgtccctagagcacatcctattgctatactattcaacatgtatgaattaatctactgggaaagtgtcttgtgtagtgtgtactttaaagatgttttcaatcactttgctttggattagaaaaattcaaggtaactataattttaaatgctcatatttttatgtttattttatatgtaggaagagaaatttttaaaaattggaataacactatatcccattcttttcatttattacattataaacatgtttccaagtgatcaaatatttttaaaaatgtttaaaatcactgcagtatattttatataatggctgtttcataatttatttcactaattccaagttgttgaacatttgtttccatatcttatagataatgcttcagtaagcattcttgatcgaacatcattttgcactctatcattttttagaagtcaccaagaatgttttaaagatgaattcctttgatagtccctgaaatttaaacattggcttaaacaaaaagatagccttgatttcagtggcatttaaaaaaagaaggctgggcatggtggctcaggcctgtaatcccaatactttggaaggccaaggcaggcagatcacttgaggtcaggagttcaagaccagcctggccaacatggcaaaactccgtctctactaaaaatacaaaaaaactagctgagcatggtggcgcacgcctgtaatcccagctacttgggaggctaaggcaggagaatcgcttgaacccaggaggtgaaggttgcagtgagccaagattgcaccactgcactccagcccgggcaacagagcaagactccgtttcaaaaaaaaaaaaagaagaagaaaaaagaaaaggccattctttatatagtgtattgtatcatatgtgactctaaactggaacttgtttaggtaaagtatatgtcttggaagtattttggttttctctgatctagttagcaggtgcagagcaggatgaggtaggattctgtgctgtgtacaatcataggaagttctgttttttgaaacggaactgttaatgggggaagggagacacgtttgtttttaagaagcctttatgtttaatattattataaaactcagttcaagtatacaaagcttatttgtgcctatgaacattcagtatcctaaagaaacatttaatcctggtgttggctaaatgactatttgctgatatgcccttttatctcaaggctattagtttcttaaagtactttgatatcactcaataaactacagttaaactcagagttttacatttcattcaggttgcttaaataatataactaaacataggtccaataatagtaaaaattctgatgctgtcacttaatttgtgcctggtttcagtatatggcgattgcttaaattacaagcacttgaatttacaaatattttgtgtatttaaatggctcattgtacattacatatccctcctgaaacttaacccatgccatttcacagacccttccatggtgtttttctctttcctccagttcactagcctcactcaccaaagactttattggtctgggaattctattatgacccagaagtgacttggaaggttcctttcacccaacaacacattctcactacctttcttttcttttcaggggcatcatttacatgctatgttgcacagtcagaatggattttagcataaagtatgggttccaatagctctcgcattttattatttatttatttgtttagagacagagcctcactttgtcgcccaggctggagtacagtggcacaatctcggctcactgcaacctccatcccccaggttcaagcgattctcctgcctcagccttgtgagtagctgggattataggctcctgccactgtgcccggctaatttttgtatttttagtagagatggggtttcaccgtcttggccaggctggtcttgaactcttgacctcgtgatccacctgcgttggcctcccaaagtgctgggattacaggcatgagccaccgcgcctgggccagctctcccattttatatctctgtggcattgaggaggtttcttaactctctgaacttcagttaccccatgaataaaatgaagataatccactcacttttcactttgttctcataattattatatgagaacacttataaagcaactagcatatggtaggtgctcaataagtattttcatttacaggttgattaatgttgccttagatgatttttgtcaggcatctatatctacctctttttctctaatttgagtaccttcctaccttcctttttttttttttttttttggacagagtcttgctttgtcgcccaggctggagtgcaactgtgcgatctcagctcactgcaaccttgacttcccggggctcaagcgatctccgtgcctcagcctcccgagtagctgggattacaggcgtgtactaccatgcctggctaacttttttttgtagtttgttttttagtagagatgggatttccccatgttgcccaggctggcaagattttagaaattagtggggttttttgtgttttatttaatggtattggaaaaacactccttttattgtttttcattgtgaatgtgaaggattctagccatgtttcaggttgaagaagcttcttcgcttagctcagaaacctgtttatcgtttaatttattctttttttttttttttttttgaaacggagtctcactgtgtcgtccaggctggagtgcagtggcgcgatctcagctcactgcaacctccgcctccgggttcatgcgattctcctgcctcagcctcccgagtagcagggactacaggtgcccaccaccatgccctgctaattttttgtatttttagtagagacggggtttcactgtgttagccaggatggtcttgatctcctaacctcatgaccacccacctcggcctcccaaagtgttgggattacaggcgtgagccactgaaccctgccatttaatttattcttttgtgaggatatgtggagaactagccaagacccgtcacagtggtttacgcgtgtaatcccaacactttgggaggccaaggcgggcaaatcacttcagctcaggagttcgaaaccagcctggccaacatagcaaaactctgtctctactaaatatacaaaaattagccaggcgtgttggcccatgcctatgtacccagctacttggaaggctgaggcacaagaatccctcgagtctgggaggcggaggctgcagtgagccaagatcgtgccacttccctccagcctgggtgacagagcaagactctggaaaaaaaaaaaaagaaaaagaaagagagaaagagaaaaggaaagaggaaaaggaaaaggaaagaaacaagaactcaccttcaaaggaaaattggaaacatggctcagtaaattacagacaccgttataaactcaaggccgctaacaaatacagcttaaatcagaatgaaaggtaataggtagtgttgatacctgacttgtggaggaggaaaaaaaagtaggggcaaagagaaaatatattattgaaaacttaaaatgctgaggatggcagagggttataaagtaaaccaatatgttttcatgatgacatgtagcctttaaaaatggctgaatctaaaacatatttatgatgcccattattttatctagtggaaattttcaaaagcaaaaaccaggaaatgatgaaggctattgacacattcagaaaatattctgagcagtttgtgggtctccattgtaaagctacagttgaatcatttttacaagtgggtatgaataattacaattttatattttgtcctgtggtaattaaaaagcaaatagagccaaattatcattaagcgtaactaacagaaaagtaatattgatagatttacatgtttaaaaatataagccaacccatgcattcagtattttatcctcaaacaaggtgttccagctttagttgacactcagataaaaagcaaactagtggctgggcatggtggctcacatctgtaatctaagcactttgggaggctgaggcaggaggattgcttgagcccaggaattcagaaccaacctgggtaagatatcaagaccctgtctctattttttaaaaaataaaaatagaaaataaattttaaaaaagcaaactagaatatatctagtaggtgctagcagaaggggaaaaattctctaagcagagatttgtgtaaaaatgaagggaaggttaataagtatctagaaactgtaagtgttgtataaaagaaggcttatagaccattggtaaatagatgtaaaactcaaggaaacttttaaacgtgcccaaagttcttaagtatatattaagatggtacaaactacagatgaagtaatagttaaccaaatatactaacatgcacaattgcttaattagtctatttgtggaatggtttcattattcattcaactaccataagtttaatgcagactgttaggtgctagggctacaaagacggataagatactcctccagtctagtagaacagaaagacacaaaaataatcttggttctcatgaaacctaaaaatattcataaatgtagaaaatgaatttagaccgtgcccggtggttcatgccagtaatcccagcaattagggaggccgaggcaagtggatacctgtggtcaggagttcgagaccagcctggccaacatggtgaaaccccgtctctactaaaaatacaaaaattagccgggtgtggtggcaagcgcaagtaatcccagctacttgggaggctgaggtgagagaattgcttggacctgggaggcagaggttgcagtgagccgggattgcgccattgcactccagcctgggtgacaagagtgagactccgtctcaaaaaaaaaaaaaaaaagaaaaaagaaagaaaggaaaaaaaaagaaaatgaatttaaatacagccttttttctcagcataaaataatttctaaatataaaccttgtgtgaacaaagaaattcacttataacccaatataatcaaatctaaactaagaacaaatctcatttaaacattgttatttctttgcaataattattgcataccaaaaaagagcccactatgagttaatgttacttaaatagaacattgctcagcctacaaatgaaggtcagcagacaccagtgtcttggaataaaatagccctttggcaagaaaacgagccacaccccattaagtttttacaaaaataaaattctttccagctttactaaattgtagatgttgcgcccagcatgtacttctgcagtagttgattctgcagctgtggaaatattcatgtatgcagaagtccccaaaaacatctattcaccattacttgcacatgcagctcttatactttctgtagtaaagtattccgttaagttttattttgactcgtggataatagcaagcaactacaggtatagctgacaccttaatttcctgccttgaacttctggccacagactttatttttttattttttgagatggagtatcgctctgttgcccagactggagtgcagtggcataatttcggctcactgcaacctccgcgtcccaggttcaagcaattctcccgcctcagcctcttaagtgcctgggattatggtgcataccaccatgcctggctaatttttgtattttttagtagagatgggttttcactgtgttgaccaggctggtctcgaactcctggcctcaagcgatctgcccacctcgacctcgcaaagtgctgggattacaggcatgagccaccttgcctggcccattgtcacagaattcaaattgagcaggaatacgtaggatttcaaatctaacagttgtttcatttggtgggatagcatcaaagccatgtactgtgaccactgtatatggttttcttcaagagcagcaataaatttctgccatgtaccatgggaaagagctgtacttttagggagaaaggaaataagccctgagaaaaagccccattttcctagttcctttcacagttcacctggcacacaacgggtcttgatatttatatttgaaagagtgaaacatggatggccataaatgctccttgctgataacgattgaattgggaaaatctaatcaggaaatcagtgatttatgaattacattgcataaaatacataatgatgggagcctgtaagaagactaaacaaatggcttccttagtttatttttcctttaggttttagttgttttcagtgaatattatgagtgaatgttatcgatagtgttttcattgtgagaactgctaaactgtagagtcaaagaagaaattgggacatattaatattttgacttttatgccagctttattgagacataatatcatactttttttttttttgagacagagtttcgctcttgttgcccaggctggagtgcaatggcacgatctcggctcaccgtaacctccgcctcccagattcaagcgattctcctgcctcagcctccctagtagctgggattacaggcatgtgccaccacacctggctaattttgtatttttagtagagacagggtttctctatgttggtcaggctggtctcagactcccgacctcaggtaatccgcccacctcggcttcccaaagtactgggattataggcgtgagccaccgcgcccggccccataccatctatttttatagattttagtatattcacagataacatgcaaccttcaccagtcaattttcaaacattttcatcacctcagaaagaaaccccatacactttagctatcaccttccacagcactctacccctgcaaccctaagcaaccactgaactatttcctgtctccattgagttccctgttctggacattacatataaatggagtcatataataggtggtattttgtgactagtttctttcacttagcctaacattttcaaggttcacacaccttgtagcaagtatcagtactctattcctttttatggctggataatatttcattgtacaccatattttgtttatccatttgtccatcgatggatatttggggttgtttctacactatggctatcataaataatgggacatgcaaacattaagtgtctatccatgagtcccctaatgagttagaggtggtgctgacaagataacatttcacttattaccactctgctcttaatataaatccttgctttgattaagcactaccgatttttccatctaagtttttttgttattttttgttccttgagacggagtctggctctgctgcccaggctggagtgcagtggcaccatctcggctcactgcaagctccgcctcccgggttcacgccattctcctgcctcagcctcccaagtagctgggactacaggcgcccgccaccacacctggctaattttttgtatttttagtagagacggggtttcaccgtgttagccaggatggtctcaatctcctgacctcgtgatccacccgcctcggcctcccaaagtactgggattacaggcgtgagccaccgcgcctggcctctatctaagtttagctattttttttcttgtttcctgatgcttattggcttatcatcgacttgttctcaataacgttttccttagtagtatttatactggaataatagaaagcctgtaaatgctgtataatcatcttttctaaaacttattgtataataaacatttagcacagttttgtttaatcacattttttgaacactaaggagcaaaggcaagcagtattaaggagtacaaaagtacatgataaatgctttgaaatgcaatgggttcaatcaaccaaaagcattattgagcacagctaatatatttacttttaaatgtactattcaagtgtgaaatatatccatatagaacaaaattcaaaactcacaaagggccataatgataagtaaattagcctctaacacttaatatttttaagaagacattagtgttttacgtttaggtattttgacagtaagtttgagggagtctttatcttttgaccttttggggtgaatatgagaatgaaggaatataaaaagatgattaaaagaatcaccaggccggaaatgacggctcatgcctgtaatcccagcactttaggaggccgagacaggagaatcacttgagctcaggagtttgacaccagcctgggcaacatagcgagacctcatctctactaaaaataaaacaaaattagccaggcatggtggcgtgcgcctatagtcccagctactcaggaggctgaggtgggagggttgcttgatcccgtgatcacgcctctgtatttcagcttgggtgagagagatcctgtctcaaaaaaataaaataaaataatttcctgcaatttcagattattcttttaagcacccttgaccccagattcaccagatcaaaacagctaatgactcatagaactttactctgtcattattttccagattcaacccacagcgaaatttttgggatccagtctccttactcttatgggcaggcggaaccttgcagatcctttaggaaaggataggcttccctgagaaaggtgggctggagttaagtcaaaaaaaaggtgcaactttctggagtcccatttagaacttcctgcgtatttaataggcctttgctaattattaacaatgtgcctggcacactaacataaataaaacagtgtgccatcgtttgaagagctgagtctaatccacctactgatttttacaaaggaggcaactgaagtctgattttggcttgcctcagcatagagtgctccaggacaatggtggaggatcaggtcgccatcactggagacccagattgtagtaatggaactgatccatcattcttctcactatatatttaaactccatgtccagggtcaactttgtttagtagcagtgcctcttccctgaatcagtttgtatctacacttaatttctttcagagattaataaaatgacaaatgctatctcaataaagttaccatgaactctctgaaactcatatcacccatgactaaagcaacttgctttgagtctgacaagctcttccctagctaatggaaatgcattagcaatagctttacagtggtaagctatttttctaggtcatattcaacccagagtagtcacatgctgacaaaacttcaatcctaaacactgatcataaagagtttcctatattgtatgtaatatatccaaaagtttttgaaaactctaattccagtatattgaatatacattatagggtttatcactcctgatttttttttaattgagacggaatcttgctctgttgcccaggctggagagtagtcccgtgatctcggctcactgcagcctctgcctcccaggttcaagcagttctcgtgcctcagctccccaagtagctgggattacaggcgtgcaccaccacgtctggataatttttgtgttttttgtagagatggggtttcgccatgttggccaggctgatctggaactcctgacctaaactgatcctcccgcctcggcctctaaaagtgctgggattacaggagtaaaccaccatgcctggcccactcctgatttcttctaaactggattttatcattctcagagtcagtgtttcctctctgtattactccttgcctagaaaaaaaaatgtccatttcattcatctattcattgacttattcaagtacttaccgagcaccttatatatgtcagatactattctaggcactggggattacagccgtcaatgaaacagacaaaaatcaccgtctttatgaagcttacatcctactaggggagagatagaaaataaacaatgattttatatattagatgctaatgtgttatggagaaaaagtaagattaatggtataggaagtgggaagaagggtattgccatttcaaaatatgtggtcacagaaggcattactgagagggagatatttcaggcaagatatgaaggaaatcaaggagtatccatgtgaatgtttggggagaagtgtcacttgaacaagtaaaaaatatttctaataacagatacctaaatcatcatacattgatgtgtttcagccctgaaattttcctttatgacaactcctttttattttggtattgaacagaaaaaaataactttcacccagatcaaacactctagtggagtcatgaactgactatatatgctaagaatattgtgtcagaagttatgtcaaaaaagttttgaaaagataaagctaggcgtggtggctcacgcctgtaatcccagcactttgggaggctgaggcaggcggatcacgaggttaggagatcgagaccatcctggctaacacggtgaaacctcgtccctactaaaaatacaaaaaattagactggcgtggtggcgggcgcctgtagtcccagctactcgggaggctgaggcagaagaatggcgtgaacccgggagacggagcttgcagtgagccgagatcacgccactgcacaaaaaaaaaaaaaaaaaaaaaaagataaagtgggaataatgtttaaagcaggatatagaattaatacaagtaaatgttcttcattttccctattaatttaattatactatattctgtgtttaattctgaattagattttttaattaaactttttattttgagataattgtagattcacacctacttgtaagaaatggcacaaagagatcctgtgtacctttacccagtttcttccaatggtaaactcttaaaaaaccatagtacaatagcaaaaccacaatgttgacactgatacagacaagaggcaaatgagtttcattaccagtagaatcccttttattgtcctttgataacaacacacacctccttcctcccctgacctccatttttgaccccaggaaaccactaatctgttctccatgtctataattttgtcatttaaaaatattatataaatggaatgatatatagtatgtagcctttgggaattagctttttttctctgagcgtaattctcttagagattcaacctaagttgttgtgtatgtcaatacctcgttccttttcattgttgaatagtattccatggtgtgtatgtaacaaagtttatttaaccattcacccattgaaggatatctgggccatttccagttttttagttatcacaagtatttgtatacaggtgttagtgtgaacttcagttttcgtttctctgggattaatgccggaagagtgcaaatgctgagttgtatgagagttgcatgtttaattttataagaaattgccaaagtgtttgcccagagtgactgtaccattgtgtgcttccaccagcaatgtatgagtgatccagtttttccacatccttgccagcctttggtggtgtcactgtttttcattttagccattctgataggtgtgtagtgatagctcattgtagttgcattttcagtttcataataactaatgatgtttaacattttttatgcacttatttcccatctgtttgccctcttcagtgaaatgtctgttcatgtcttttacctattttctttcatttttgagacagggtcttgctctgttgcccgggctggagtgcagtggcgcaatcacggctcgctgcagcgtcaacatcctgggctcaagtgattctcctgcctaagcctcccaagtagctgggactacaggtgcacaccaccattttattttttgtagagttggggtcttgttatattgcccaggctgatgtgaaacgtctggcctcaagcagtactccgcccttggcctcctactgtgctgggattacagacatgagccaccatgcctggcccttttgtctgttttctaattggattatttgtgtttttactgttgtggaattttaagaggtctttatgtattctagagtctaattctttatcagatatgtggcatacaaatattttctcctcgcctgtagcttatcttttcatcttctgaacagaatctttcatagaacaaaaggatttatttggtgaggcccactttatcagtatttccttttatggattgatttttggtgtcatgtccgagaactcttcatcaaatcaggttcctgaagaatttctctttcccccctaaagttttatagttttatgttttacatttaggtctgtgatctgttttgagctaacttttgtgtaaggtgtgaagtttgggttgaagtttcttattttttgttttggactgtgtttgtcctcgtctactgacatggttttttgcacccttgtgaaaaatcattgaatatatttgtgtaaatctgtttctgggttctcttctgttccgttgttttgagtatctgttgctctgtcagtatcacactgtcttgattactgtagctacatagtctgacttaatgccaggtggagtctattcaccttatttttcaacagttttagatgttctaaggcttgttcctttccatgttaatttttaaaagaagcttgtctataactacaaaaactgttctaggattttgagaggaattgatttaatgaattagacttttgaaattgcatatgtaatgttaataaagttaaaaatggtaattctgttaaggaaaacaatttagttccttccaaagtctaacgctagttcttattttctgaagaaatgtgtatttttatgattttgaaattattgaatgaatattaattagcagtttcttttttattttttaaattttttgtgtggagatggggtcccactatgttgcccaggctggtctcaaactcctggtctcaagcaatcctcccgcctcagcctcccaaagtcctggtattacaggcgtgaaccaccatgcccggccagcagtttcctttcagccataacatgaatgaccttttttaatggccaaaattgaagtttgtcaggttctaaatcactaatatgtttttgaatttaaaaatttttgaaggtttacttctggaatttttaagaccaaccattagatttataaggctgttaataagattcctaaacctattgttttgccttaaggaaagtatggtttaccttttgtgttatcccaaacaaattcatctccccatatagcaaaatggaatatgctactaaatagttgaaatttagggtaatggagtttgggatatgtttattattcatgaatagtaagtcaaaagtttttaaatgaaaacatttgtgtattctcatgctttgattgttgattctgcaaaataaaatcttaaaaattacaaaaagcatctgataaacttcttaatttaaaagaacactcagaaatttactttcaggtatttaaaaaaagagggaggctatcaaactgattaggactgaagaagaactgaagagataatgtcaccttgttggttttgggtgagggaaaattgaatgagatcatgctttctttctgtcttgctttctcaagataaagcttttccactcttctgtctgcttactgattcagggtggcaggcacaaaacaaaacgttccggttatattttccatcctgtttatatttaaattggctgtttattctttaataaagtgtataactgttggtctataacattatgaatgtgggattaagtggttagacttagcaggaatttgaaaatcagggtccaaatgtactaccctaagtacagtagcagaattacttctataaagaaaacttccctaagttacagcatctggctcatagcattatcattacagtgaagtttaccatcactcatattagtgatgtgttacttcccacttactcctaaccctgcttaggtaatgcaaaactataatttagaaagtgtgatttaaagaagatgcaatataatggtactcattgtaaacatatatccagatttctttcttcacatataatttatctgtatttttaaatttattttgtctaatgaaagacttttaaaagctcattctctcgagcagtgaattctcagctagtgagccaggacagtctgcctcatcaaaagaattctgctaattgctttagccaatttctgaggtaataagctgggagagggaagaggttggttactcatgcataggtgactttttgctaacagtgtgatttttaggaagtgaagaccacaaaagctttttgacttgtggcagaattcattatgatgagactttagctgtaccaggtaacagattgccaaataaaacaccaaacaagcaagattggtcagttacaatccagtctgtagtagtctgatccagcatagtgttatgtttatggattcaattccctcctcgaagtcatacaattgaggcatctcagtagaaataaaacaaaataaacaaattttgtagggaagctcctatacatttgaatggtaagggcatataactattaatactttatgagaccatggtattttgcagccaatcttaaggataaatctacattgtgttcaggattctgtgttgggccagacttaacaatgaccattatgtgtagaaaatagcaaccattgttgctgaattaaactctctctggagatttaaacatttttttaaaaaattaagctaataggccaagcgtggtagctcacgcctgaatcccaacactttaggaggccgacgcgggcggatcacttgaggacaggagtttgagatcagcctgggcaacgtggcgaaagcccgtctctactaaaaacacaaaaagattagccaggcatggtggtatgcatctggtcccaggtactcgggaggccgaggtgataggatcacctgagcctgggggaggttcaggctgctgtaagctgtgattgcaccacggcactcagcctgagtgacagagggagactctgtctttaaaaaaaagaaaagaaaagaaaaagctaataaaaccttgatgacaacatagccaaagaaattaatcagagaagagtggtgattagaaacagaaagcatagtggaatagatgaattacacctggcaaaggaactctaaactatattatgtaaagctcaggacagtctacttgtctgaaaaagaaataccaaaagtatacacatgcaaaaatttggatttttcagctggactttttgtgaaaggttccctcccaccccaaattcaaaagaagtataaagcaggccattcatggcaaactcccaatgaaatggaattaatttgtattgtgttttgaaagtgtatatatgtgcttgcaggaattacatggaagaattatactgacatagagtggctctcaaagtgaataatggaatcttaaggatgttttattaaacagcgagtcaactatttttctccgtgaatgtgactccacaatgatagtggaagtcagaaaatatttcacatgcaaatatatctgaaattcttcatggatgtatttaacgctttgaagtgatggcaacatctggtagcaagtagaagccagcgtcttaaaagctatggcttcatgttactacttcatctgaattagtcatttaaaggggattttatatgtcttcctaaaaactgacgaggttaatcttagactagggcaggctggcaggaaatgctaaagcggctctttcttttgaaggttttgttattccttgtgaggtcaaaaagtagttgttttaaagtttggaaagctaaagcagtgatgttttgactcttgacagtgagatgtttttctttttttttgggggagggtgtgtgtggcaagtttgaggaaaaacttgatacactgagagttctttatactttccactccacttattttctctcaaatgaatttattttctaaaggtgcagaatttagaaattcgtttcaattaccaaatctgagcatggatttggtgctattagaagatgtaaccaccatgtgtttggccagattagctttcaggaatgatcgtatcttacagagttagccaatggaacaagagtagatgccttttatccttatttatttgctttgcattaaaaagacaaatgctgaaagtttattcttgactatgaaataaaccactataatatatgacactgagttaattcctttaggatgctatgtcttccacatacatccatttaataaatatttgttgagtgcctactgtatgccaggcactgttctataagctgaaaatagattgctggacaaaacagacaaaaaatcactgccctcttagagcttattaaatacgaaaacagtagagcaatttaaaattatttaatgctatcactcagcttttaaagatcttcactgaatgagttttgagaacttttgcacatattatctacagcttgaatagggaaaaaatgacattttgtttgaaatctagttcaagaagctagaagctgataagtaaagtaaatattttattctgtgatgatcattttcagttttcatttatcagtgttatacttaggcctcttgaggaatgttactagtttaacttgtggatttcctcctgaggatgggcttaatttgtattgggggaggtggtgaaaggacctagtagccctggaatttaatgtaaagtcgtggcatttgtaaaactatcttctgtcatttgaaaaattatagaatacttaaatgtatttaatgctccctgtggaaaatgaatgtattgctcagttatttttgcctatgtgagtagtacaagagctgactcaaaggagatgacatgatggttcctgtcctgaagtgaaataagatgatgggttgtggtggaaaaatgatgtggtcatgcccatatttgctcacatctcttgttcgtttccttttatagagggaaaccagggaaagtctcatttcttattttttgtttcctttttgtattttctttcatacgccatttccctttctttttttcttaaaattgcattatagtgacttccaattcaattggctcaagttgtacttggtaatgacataaagaaataccgcttagaaaggtcatagtggaagcattatacccattttagggaattgattatatatatagacacagccactctgagccccttgaggatatgaaaagcatgttgcagaaatcctcatatttcctgatgccaactagtatagtgccttttacagaatatatgcttaatcggtatttatctattgaacaaatatgagccatgaaatttaattttgctctccaaaatcccaagtcctttatataagtaggcagaaattttaaaaagtctttttttttgtttgtttgttttttgagacagagtcttgcactgtggcctgggctggagtgcagtggtgcaatctcagctcactgcaagctccgcctcctgggttcaagattttctcctgcctcaggctcctaagtagctgggattacaggcacccgccaccacgcccagctaattttttgtatttttagtagagacgggatttcaccatgttggccaggctgatctcaaactcctgacctcgtgatttgccctcctcagcctcccaaagcactgggattacaggtgtgagccactgcacccggtctaaaaacttatttttatggaattattcaaatacataatgtaaaatagcattaaaaacccccagctttaacaattaccagtatttcatgttcttatttcatctttgctctccccttttttgagatttgctttaaaataatccgcatattgttttaccgataaatactatagtatacttcttagtttttaatattttaagatagtagtgtttgcatttcatatggagttttacttttaaaccctttctgtgctactttatgcaagagaaagaaattcttaaccgcttatcagaagaaaaatctaatttttttttttttgacggagttttgctcttgttgcccaggctggggtgcaatggtgtgatctcggctcacagcaacctccgcctcccgggttcaagccattctcctgcctcagcctccgaatagctgggattacaggcctgtgccaccacacccggctaattttgtatttttaccggagacggggtttctccatgttggtcaggctagtctcgaactccagacctcaggtgatccacctgcctcggcctcccaaagtgctgagattacaggcgtgagccactgcgcccggccaagaataatctaatttgctgtgtatgagtaggatgttaactcattttgtaacatatatttcctttcttaatcttttaaaaaattttattaaaagtttctaaacaggccgggcgctgtggctcacacctataatgccagcactttgggaggctgaggcggacaggtcatgaggccaggagttcgagactagcctggccaacatagtgaaacccggtctctactaaaaatacaaaaaaaaaaaaaaaatagccatgtgtggtggcaggtgcctgtagtcccagatacttgggaggctgaggcaggagaatcgcttgaactcgggagggggaggttgcagtgagccaagattgtgccacgcactccagcctggaggatggagtgagactccgtctcaaaaaaaaaaaaaaagtttctaaacaacattgtacatgttatgtcatgactgtcatgataaagtcttgccttttagacatgaacctgattcagcaaaatgtgctttgaagtagataagctgtagatttttgtcttgcctgaattgatattaaagagatgttttttcttttcacagttcaaaagtacagaactcaggttaaaacctagatatgtaattttgttaattttattttcagtttgaaaattcttgttaaaacctgcatactttataggtttgctgtctctaaaattagatggctccttcataaatattactgaataaagcaccagttttcaaaaagtgtggcacatgggctcatgggggttaaaattactttcatgataaaactaaattgttatttgttttttcactgtgttaacatttgcactgatgatgcaaaagcagtagtgggtaaagctgctgaatcaagatagtggccccacactgtagtgatagccactgtattcctcagcaccataccatcacctttagaaaaaaatcttacaacatgcatttcatttacaaatgtacttgatgaagcaggaaaaaataattgtattaaatctcaattcttaggtatgcatctttttaaatattgtgtgtgatgagataagacatacccataaagtatttctgctgcatatggatatatgacgattgtcttgagggaaagcacttgcgcagctgtttgagttgtgagctaaactagctgcctttttaaaaatagaaaaccaggccgggcgcggtggctcacgcctgtaatcccagcactttgggaggccgaggcgggcagatcacgaggtcaggagatcgagaccatcctggctaacacggtgaaaccccgtctccactaaaaatacaaaaaattagctgggcgtggtggcgggcacctgtagtcccagctacttgggaggctgaggcaggagaatggcgtgaactagggaggcggagcttgcagtgagccgagatcgcgccactgcactccagcctgggcgacagagcgagactccgtctcaaaaaaaaaaaaaaaaagacaaccagttttactttgaaagattgaattaactgattattcagacccgagtatctaacagatactttatttttaaaaaatgaaccaagtgtgcctctcactgcaagggaaacaactaagagtatttgttgccaatgctaaaattagagctttcaagcaaaattcaaatttttgagaacttgcattggtcaccattttatccgatcaatacttaggcttttctagtgaaatcgacagtataattaatgaaaataatgtgttagattttgtataatgaaatgtatcagcatttggaagacccacataacttactgaaacaatatttttccaaataactaatgtatgatgttacaaaatcaagcatgggtaaaaggcccattctaagtgcaagacagacaaatagattttgaaaaaatcattgatattgtatcagactctacattgcaaccaacctttgaaaaactaccacttctctcgagttttggtgtagtattgaagaatatctgtaagtatctggaaagcctcttaaagtatttctttctttttacaacagtttatctgtaggaggccagatgttcttcatgcactggaaccaaaaccggtattgcaaaagattgaatgcagaagcagatatgaaaacccagctttcttgttctaggttaaacattaaagcgatttgcaacaatgtaaacaatgccacccttgtcactacactttttttgaaaatatagttatttttcattaaaaagcttatgttaacatgtaatgggcttattcttatttttaaacaaataaatatcttaaaagtttcgtagtcgcaatttttgatgtgacaaatacactgatagatctaacccatgtgtcaccaaactctttgggatcctcagatcctgaggccaaaaagtttaggaactgctgagttgggttttttgttgttgtttccctccttatccctttgccccacccctccacttttctcctattcccctctcctttcttttctttttttgagtgagagagagaccctcaggatagaaaattgtagagcatgtgagttattcctttgtatgtttttattagctacgaactgaacatgtatgtcttttaaattcattcattgccccatgtgtagttcgatgtattttgaccttttcttttatttattttaaaattttgattacttagttacacaaataaagagctaataaatactatcagggagacagcccttggaatattgaattttatattttcttctgcgacagtcttgctctgtccgtgcagtggcaagatcacagctcacctcctgggctcaagctatcctcctacctcagcctcccaagtagctgggactacaggcgacagccaccatgcccagctaatttttttgtattttttttgtaaagacagggttttgccatgttgcccacgctgctctcgaactcccgggctaaagtgatccacccacctctgcctcccaaggtgctgggattacaagcaccagccaccacgcctggccagaatattgaaattaagatatattctgacttatttttccccaaatatgaaaaaaatgattacatatatgacttgattattaaaattgacacatccatgcaacaagtttatatacctaatgctgtgcctggtatgaatttcctaaactttccaatatagtcccaaaattacagtagtagtttcttgaatgtaaacttgttgcctgttttatatgttagatccctttgcttctatgcttcactcactatgtttgtttgttcgctttgtttttataagtcatgaagatggaaaaaaaactgtttcatgaaaggaaaatagatgagtgttgttgaggtgtgtcattaagcacagtgggagaggcctccaatgtacgtgtcacacatggaaagtatacctagtactgggtgtggtggagagcatgacgtctggatgaaagttgtaagagactttaaaaatactatgcctagcttttgtgttacaactacatattccactgatacttatgtgaaactcccataacttttcgggttgtacctcttttttccaccctggggtgggagtgtgtccacaagtgcatgtgtgtgaactcttaactttgtgtttgtattttgagatggagtctctgtggcccaggctggagtgcagtggtgcaatctctgctcactgcaacctccacttctggggttcaagctgttctcctgcctcagcctcccaagtagctgggactacaagggcacaacaccaatctggcttttttgaatttttggtagagacggggtttcaccacgttggccaggcttgtctggaactcctgacctcaggtgatccgcccacctcagcctcgcaaagtgctgggattacaggcctgagccaccgcgcccagcccggcctgaactcttaactgtatggtttctgtttgtaacatctagagagagtgacagtgagaatttggtttccgtcggctttccttagcattcattttgatgaatttgggatgcaatttaaaagctgttttcattctgtggcctgctgatgaaaatgtagaatttattgcagaacccttgccaccgtcttgcattcccaaaccagtgttcattacccatagtaaaaaccgagatcctgttcacacacatgcacatacacagacacgctccccaccgcccccgtcacgcacacacccacacacacctcggatggtgagtgagatagaagtttagtttacatgctaaaactggttaaattactgatgtggtagaactgtcttttagcccgggcacagttgctcacacctgtaatcccagcactttgggaggccaaggtgggtggatcacctgaggtcaggagttctagaccagcctggccaacatggtgaaaacccgtctctactaaaaatacaaaaattagccgggcatggtggcaggtgcctgtaatcccagctactcgggaggctgaggccagagaatagctggaacccgggaggcggaggttgcagtgagctgagatcgaaccactgcactccaacctgggcgacagagcgagactccgtctcaaaaataataataataaataaaagaaacaaaaaactggccgggcgcggtggctcacgccttgtaatcccagcactttgggaggctgaggcgggcagatcccaaggtcaggagatcgagaccatcctggttaacacggtgaaatcccgtctctactaaaaatacaaaaaaattagccgggcgtggtggcgggtgcttgtagtcccagctactcaggaggctgaggcaggagaatggcatgaacccgggaggtggagcttgcagtgagccacgatcccgccactacactccagcctgggtgacagagcgagactccgtctcaaaaaaaaaacaaaccaaaactgtctttatgtcctacctagcatttactaagtagaagatgtgcccttttgaagggcatgtctattcctagaactttaactacaatgctttgcagtagaaatatatgctattgtattaaggtgaagtgactttagaattagtaactcggtgttgacagatcatgctgatcgaagattagccttggagtttggaaagctggagagcatgtatattccagatgaccaggaaaggaaaagtcagaaaaacagtttttaagtagtactgttataacgacctgtaaaacttgaaacgagagaaagctgtcttctaaaatgaagaattacatatttaaaacattaatttcctcaatgatactgctacatatctgaaaagggtggttacgtagcatttgggacagacccgtctcagtggtttgaggcaacaggtgtggctgaagaaaaggtaaggctggggaaaaaccaacatttctggtctaaactgatactgtcttcttacctgaggcagtttcctatgccctggttttctctgtctgaaaaatgcatgataacacatactcttcaaattagctcaaaatgcttggtagttacctactattccctgacaggccacaggcagatagttctatgcttgttttagaaatggagaatttggtactcagaaaagttgaagaagcttcatttcattcacatagtgagtcagcaacaaggacagacggaaaaacatgtcctatgactcctgccattgtattccttctcttctgcattgtgttgccttttgatatttcacgaaggttttgtgattggtgaaataaattaaagcacttccatgaaggagacaaaatgtaacccagtgtctgctgatggtggttagtgacgaggacaggagaacactgcctcataatggggactatccggtgagggctccttttcacaggtgcccacactgtgagtcacctccttatgctgagagttcggtatgctatcataaaatactttgttgtgtattatttatgaaggactagagtatctattgtctcactttctttcattctcatgaggtagattacagcagcagatggcattatgcatgctttatcccagacacaagaaaataatatctgccacttactgagtaccttgctggacccagacactcttacatatttatatcttcccattgggtcatcccgtggaccttgtgaaatatgtggaatagctccattgttatagatatgaacccggggctcagagaagctaagtaatttgttcagggtcacacagacttacaggtctgtcagactcctaagaccctgatgctttcattgtgctgcatttccttcaaattatgaacttgccctatgtcagcacagaaacggcctcttcagcctagcccagtgctccaactgattgttctctctcataaaaggcactcacaactaaccacttgcttgatttaggaattcactgattagattgctagaccagttaaaggcaaatttcaataatgagagcagttatcacgtatctagtacttaccatgcgccagactatgatctaaatttatgacacatattaaatcatttaagccttacaaccatgtataaaatagtgaactgcgatatgatggagttgctcttatcttcatcccgggatgagaaaatagaggcagaagagttttaagcaatttgcacagttaataaagtgtggagccagaatttgaacccaatctggctccagacctctttactacagctctcagttagaaaattatttctaactgagatatttcggttcagcaagtgttggcttagttcctgtgtgctatgccagcagaaaatatagttcctacacagaagagcttacatttttgacataaatcaaaatgtatatacttgaaataaatgctacaacaccttagcatatggggtgtaaatgttgtgtatggatcagcatgaataatagagactgttagtgagtggcttgagagttaatttgccttcgcaagtaatgttcttgactatggacgagtgacttgggcactggggagaagctgttccatgtgttctaaaataagcaggttacttggctactgttcaaactctaaataggtatatgggttgtagctatttgacctgaactaactttaaattcccctgagtccttatatgattttggggaaaaaaaaaaaaggaagaagaaaaaagaaaacttttctctgtaaatgctgcatttaaattagaatttattaaattctctgcaaaataccgccaggctgacaggaaggggattcgtaagtattgtatcattcttttgtcagggtgttctctttttctagcaggaagtgttgtgacttgctctctaaagttgcaattgtaagaagaatgttgggtttccagattgctcttctgggcgtgggagaaggttctgtctatcagtgctgcgagaaaggaaagaaacaagtttgctctcagcgggtaactattttaatattattttgacaggctctaactttgagattactaaatctaaatttaaatactaaatgattaagcaggaatttacgtcaaaaagcttgaaattcctgttatttatttgggtaaacatttggagtcactttaaaaatattatttattcaagtagaataaaatttttgttaagagaaaattttgaagtttagattctaacctgttctgtgtgtattctgtatttttctttatttagagaatgtttagggagtttatactttttaaaaatgggttttgaaatcctaattatacagccgtatttatcaagttaagtatctaaaacactaaataatagaaattattgtctatatttgtggtgggggtgggatttcaaatgcttttgatcccagttacatggtttttcaaaattctgtaaaatggaggttgaggtggctgtcatgacagaacatgtcacgattagattgatattatactcttcctacgtgagttaaatcaaacagttgtcttagtgtttataatttacaaaataataaacatcactggtgattaaattttgatggcgttattggtacttggcagcaatagtgatttctggtgctcacatacattaggattttccatcacatggttgtcatataagtttaatttccccatatttctggcaaagggaagtatagctagttatacagtcaatcctcactctgagttgagtcacctctcggactggttgtacttaatatgcgcatatgaagtaaaaagtgaagcatgaaacaaaacaaaccagttttttcaattaacaagtgctgtatttgctaacatataagcaaggtatataacactgcaagaggcattttcagtgacttgccgatagctttctgcttcgtgtatatagtgatttgagttgtaggtcacaatattttatggcatttttattttgaattgaagtgaagcatggtaactagtctgatcttgcctagcctctctctctctctctccctccctctctctctctctctctctctctcacacacacacacacacacacaccccacacacacatatccctgaaagttgcccttggcttcactcaaacatatgttaattttcataagaaaggaaactggtggaaatacttcttaggtatgaaaattaattaatttcattagcagcagatttattttcccataaattattcagattttgggggtagatgtaaaagtttacttaggcatggaagacattagaccttttaaaagcaaagtgggctatttcaatctaagaagttagttaatgtaccttagctttctgaagctaggggaaggagaggtgtctttttgttgtgtctttgggtttgaaatagtattcttcatcctaggaaaaagggcttttagactataattgagacttgcattaaatagctgcaaaattcttgcctgagaaacgtttaaatgatgtctttaatctgaccaaattgaattgaatatttctattattggaaaaagctacgtattaatttatttttaaatagccattgctttcagatcttatctttgtttattaagtataaaaagaggaaaggaaacttttacctaaaatggaggtatttgatattcctccaggaaatgacacaggattgggcaccctttggggtttaagtgactcatagatattggtactgaaaacaaaacaaaacaaaagatcagttagaatctagctaatgatcaattatagcacagaatagaagtatttccagaaaaatgaactcatttcttaatagctatgtaggggtgaaatcacaggatttctgagatttgctttaaaataattcatggaagagagacagggaaggagggagggagaagaaaggacaggaagagagaatagatgaaccaagcaaatgtggggaaatctggataaatgtagaatctgtgatgggtttatgggtgttttttgtgctattttctcttgtatatattgaaaatattgacaataaaaaatgttagtagacctttagtttggggcaatttatatttattttctttcttttttttttttttttttttgagatggagtctcactctgttgcccaggctggagtgcagtggcacgatcttggctcatgcaacctccacctcccgggttcaagcagctctcctgcctcagcctcccgagtagctgggattacaggcacccaccaccacgcccggctaatttttgtgtttttagtagagatggggtttcaccatactggccaggctggtcttgaactccttatatttacttctaaatgtcaacttttatctataaattgcaggcctgtcaaaacatgatgtatgcatgatgtgtatgactgtaaaggtgaaatgtgctgcttgaatgccaaaatggttgaaagtaaaaactgcttctgaaaaggtttatttctgtttgattttcagctaaattcaaaggacaggtcacaaacatcttgaagagttttttagtatcttgaagtattaaacaagggtagttaaagcatgataacaggccaattgtatgtgaagaatgtgaagacgttattgaacttgactattttgttcacagctttctccaatagagtatgtgtttttaaaaccacgtgagaggactatatagcctgcatgatgtataggtctgcgcactttccctactcacctccatcgaagtttatttattgaacaaacattcggtaggtgcttgtggtgagccaagatacaaagtcaaataagataccaaccgtgcttttaaggagctcacaggctcgtggaggagatagagaaagaaatagatgtcatcacgctgaaagctgaaaagggctataggaatatggggaaggggaggaacgggttagcaactatgaccctatgacgcatctcctttaaaataatacaaggctgggcacagtggctcatgcctgtaatcccaacattttgggaggcctaggtgggcagatcacttgaggtcagtagttcgagacaagtctggcccacatggtgaaaccccgtctctcctaaaagaataaaaactagccagatgtggtggcgcatgcttgtaatgctagcaactgtgaaagctgaggcgggagaatcgcttgaacccaggagtcggaggttgcagtgagctgagatagagccactgcactcaagcctgggtgacagagcaagactctgtctcaagaaaataataataatataaaataaggctgggtgcggtggctcactcctgtaatcccagcactttgggaggccgaggcgggtgggtcacctgagatcaggagttcgagaccagcctgatcaacctggtgaaaccccatctctagtaaaaatacaaaaactagccaggcatggtggtgggcgcctgtaatcccagctacccaggaggctgaggcaggagaatcacttgaacccaggaggtggaggttgcagtgagccaagatcatgccattgcactccagcctgggcgacagagtgagactctgcctcaaaactaataataataatataatgtaatataatacagacagaaaattggagatggtttaattggttgtgggtattacagtggtagaagagggctaaaatggcttagtctaaccccatgcataactttgcaaataactcttctgctctcatctctcttccccgcccttcttaataaacctttatatctttcttatgcatccacaggggttattggagcagtgtacgtgcagaacagagcaatctcttcttcacattaaagagtagactgatgtttaagtctcccttaaaggttttagatatatccaaggccgaattatagttattaggtaggcagctacttggagttggataaagggtagagttagccttcagtcacagatagagccttctaaagttcatttctcaattgatttggaatttgaaacatattttgtcatggaaatagtagtagggtttttcaggttactttacaagtattcctgaaattttatattatgttatctggcatgatatggttttgttctatgatatcttattttattttcattgtattctatgtgaattgtagaagcacagttgctaaatatatccagatttatgttccatcagccagttactttattctctagttcctgatactatacaatctaatcagtgtatataataatgcctcatgagaaaatactgtcaattttatttgaggtacctaatgatgtcctctgtttagttgtacaatttgcagctgaaatgttaagtagaatgaacagaagagctagacctgaaaaataactttccgaagtaaagtctgctatacgtggtgattatttctttcatagatgtttgctcaccacattgactataagaagaaatttttggctgggcatgatggctcatacctgtaacctcagcacttttggaggccaaagcagacaaatcacttgagcccaggagttcaagaccaacctggagaacatggcaaaaccccatctctccaaaaaatacaaaaattagctggggtgatattgcgtgcctgtaatcccagttactcagggggctaaggtgggaagatttcttgagcccaggagttggaggcttcagttaccatgacactgcactccagcctgggcgacacagcgagattctatttcaaaaaaaaaaaaaaaagaagaaggagaagaagcaatttttgataatgctgatgtgctagaattaatgcacagtaaaacacttcaccactttttcttctgcttcaacctttcctagacttttaggactaggaacctatgacacacgtgagggcatttaggttttgactcccttattttgactttcagagcaacaaatcattaaataaaaattatgcatatagcctcttaagcctttacaattactcctttaccaagattccgtgaaagttttctaaaatgagtcaagcaaaattccaagccacttgttcttgagaaaaatcttgaaagaaaaaatttttaaatgaaaagtaaatcacatagatacttgagtgtttgttttatattaagactaagttattagcactgatacaatgggagtggttgttcacaatacttagcattcatgaggctgaaattaagcagtattaacaaagagaagcagaagcctgtcatatgtaggaatgaatgtgtcataggagaaagtaagcgtttgtgtgcttttttttcagaatattgcctgttttatgatcagtgccaatttaacaccaatgttttaaataaatgacttttagaactctgtatgagtctttactgaactcattgtctatattctgtatgttttatacaattaaagttttggttattttagttcaaggcttaagtgaatcccttatccttttaaataatgaaaacaagttagtattagctggagggggttactatctccattttctggcaactgttcttatttctcgatatcatggtcatatttgttaggagctttttaagttattttccaaaggctatatatactaggcatggaccttctctctgcaaagcaatgtgtagtctctttgtttttgtttttctgggaagagtagttaattggctgggcactgcagctcaagcctgtaatcccagcactttgggaggctgaggcaggaggatcacttgagccctggagttttagaccagcttggcaacatagtgagatcctgtctctacaaaaaaaaaaaaaaaaaagaaataaaaattaaaaattagccgagtatggtggtgcatgcttgtagtcctagctactgggggtgggaggtgctgaagcaggaggatcacttgaggccaggagttggaggctgcagtgatcatgccactgcactgcagcctggacatctcagcaagactctatctcaaaaaaaaaaaaaaaaggaaagagggaaaaaacagttaattacctttcctccaacacatgcttttgctttttttttttttttccagctatgcttggagaaacacattattattattattattattattttgaggtggagtcttgctgtgtcgcccaggctggagtgcagtggtccaatctcggctcactgcagcctccgcctcctgggttcaagcaattctcctgcctcagccccttgagtagctgggactacaggcacgtgcagccaggccctgttaatttttgtatttttagtagagacggggcttcaccatgttggccaggatggtcttgatctctgaccttgtgatctgcccgcctcggcctcgcaaagtgctgagattacaggcatgagccactgcgcctggctgagaaatacatctttttaattgtgcttcacagctttgtgtcctgggcaaagtcaacgactatcccaggcacttgtttattccctaatacaatttagggaatgaagttatggaactctacagacttcttagctttcaaattctcattgctgtgatcactggatattgggaatactgggaattttcactccctctaaacattgcagttggttggagtattttattcattttttatgtttatttttttagaggcaggcaaccatagctcactgcagcctcaaactcctgggcttcagtgatccttctgccccagccttcctagtagctaggactacaggctcaggccaccatgctggctgatttaattttttttttttttttaagagaaggagtctcgctatgttgtacaggttggtcccaaactcctggcctcaagcagttctcccacttctgcctcccaaagcactgggattataggcatgagccaccaccctcagcctcagttggtatattttgtaaaccatgcctgtgtaaccaacatccagcaatgagagtaaaaggtgaagtttagactgttctccagaaacaaacaatcatgaaatgagacttgcaaagcaaagaattacacaagtttttgtgtgctgttcgtgaaagaaggattttcttttattgaagaagattgttctctttgaccaagtttaagaatctatgtaaagaaggtagataaactgaaccaagtaggacaatggaagtcccagttagactgactgtcctcatatccacttatgtaactatagggagaagtctataattaaatttcaaaattttgtggcaagattctaaattctctgggagttgaagagaaagatcagtgggaggtggagtcattgggaaacgtgctttgggagaggatgaggcttctgaaccttgcttgaagggtgagtagaatttggatagagagagaggaaaaatagaggagagtattctaagcatgagacgcagatagagagagaggaagttcttaatggaagacaggaaaagcagaagagaccagaataaaacaaaaggtactgatagaggagaatccagaaccagctgtaatagaaacacagttctgtgagagtactgggaagataaattttatcttgggtgcggacaatctgaagatacttcctgaaataggcttttgaagtgtctagatagatgggtgaagagcattccactggagagacccagtggtctctccagggagtggaagaagcgggaaaatacatggcctgtttggggaataaggtctcttgagagtgttgggttcaagggtgtagtacatataatgggaagtagcattggaaagatgggcagacataaagctagaagtcaagtcagaaaagtgtagggccttgaatgctgtcctaaaaaggtgggacctccttttgcatggaatgtttataagatccgctcttcaggagattatcaggagattagcagtgtaaagattgcactggaggaagacagaacagcaggcagatctgataaaaaaaaaaaaaaacttttgtggggttgggggagggggaagggatagcattaggagatatacctaatgtagatgacgagttaatgggtgcagcacaccaacacgacacatgtatacatatgtaacaaccctgcacgttgtgcacatgtaccctagaacttaaagtataataaaaaaaatatataaaaagataaaaaaaaaacttgtggagtaggccagacatgaggtgataaacagatatgacggaagaatctcagatattgcaaggcaagaatccagagggatgggtggttgactgatcctccctttgttttttatggtcaaactgcagtctggagacagaggaaagtgggaaagttgaaaacgagacctgatttggcagaagaaagagttagaaaaaaacagggaaaataatgtggcagtaagttagattggagacacttagactttcctaacttgaatcgtcctcactgactttccttctcccttggccacttctaaattggaccctgatctgctgctgcgagtgtgtctgtcactaacacaaggcacaatacccttaccagtgatgtctctctgagaatgcccttactggggatgtctatctgagaaaatcctacttgcactcaaagacagagttcaagcctcacctcggaaaaaacttttctgacgcctaccatttagtatatatgactgtgatggcatgattgcactaatgttgtatctttgtttttccatctgtttcccccactagacagtaagctcttccagaaagaaggggatttggatcctaattgtctcttatctggagcacccaacacagtgcctggtacatactaagccttaagttaatgcttgattaatataaataaataagtgggtgagtgtggtagacattcaagctgggaatcttctaaagtcattaggaaacatgagactggagctttagtaatcatagtatgaataggtgagttttagcccacagtgttgcacacccatctaagctagagactagtgttgagctgttcacttacctaactagggaggtggcagggtggcagtttctattggtaaaggtaggtatgcaaagtgtgggtgttcaaaagcactgcctgttttggatggaggaaggtgacaacaccccttttctgatcattcttgaactgttcacacataatggtggctaacttgtttattttcatttatagtgaaataatgtatttcttccatgttttgtcccctctttgttgctttcttgttcattttaggacctcaagtatgtgttgcccagtctctgatttaagtaatgagcttctcttttccaattctatttaccatactagtggctgggatgaagcctgtggtgaatatcctgtttttatcttttggctgcctttcaatttaaaaaaaaaaaaaatcaagtttatgatcaaagttggttacccccagatgagtttcccacgtgcattctctttctcctggacctcatggtactgaatgacacagatgaataagtagattattcagtcagctgcattcctaaagtgagtgagtgctttaggagataaaataggcacccccgtcccccttcaaatacctttcagaatttgaataatagtttcaggtagttgtaggtatacctttctcagcaaagatctgtgtttagggtttatgtatagttaaatgagccggtggagtggtttcataattgcagtattgttagtcaaactctgtaattagagatgacttcataggcataagattcttctatgggtgacgccctgaattcatacccaattgtacactatatccttttatgaaaaaacaaacaaacaaggttttgtttgcttttgttttactcccttatttgaaaatctgttttcctgtgtcttatatgtttagtgaagaagggctggcttttttctacagctttcccttttcctttacagaaatggcaggcataggagctaaggaggaaacagaatttgggacagatcaaagtgctttgcagatgagcgaattcagaaaaacgtagagactccaggaggttttatttttgataagtattaaaattgctgagtttaaatggaggaaaaatatatctctatttctttgaatgtcagttctctttctctctccctctctctcatcatgtaaataaagtccgcttttgcttggtggcacacatctgtattctcagctactcaggaggctgaggcaggaggattgtttgagcccagaagattgaggctgcactgagctgagattgcaccactgcctgggtgacagagtgtaaccctgtctcaaaaagaaataaacacataaagtccacttttgtgggaagacagactgggaaagaggacatatttgaaaatcagggtttttttccttttgcctgtcaatcacatattgtgaaatcggggttaaacttttattcagcaagtaatactttctcttcacctttttctagtactcatgaaaaaatttgcaaattaggaggaatgtgacaatattgacaagctgttagctattttgaaaagtgatcctaaaatatttaaagaaaaattgttgtttgtttgtatatctcctgtctgctctttaaattgtgtttagaaactggccttacggaggaaccaaattgagtcatggataaaaagtgactgacaggttttcctttaggcccatccttcttaaattactttgactaaagacttgtaatttttatatatgagggagacctattatactctgtagtcagtaattatagggagatgagataacttttcatttatcccatgtaaaaggctattagtagaactaatgccttatatttatttatacagctcttcacaattaacccaagcattcatttattccctattttctttcatgaaggatttgaagttgctatgtaatacttcatagttcacaatatgctgtcatacataccatctgtaatcttcattaggacctgggggaagtaggtattattatcactattttcaaatgaggaaacttaggctgagacagattaattaaacttgctcatggacacattactagggaatagcagaaccagagcaataatcgatgccttctaatttcacgtccaacatctttctgttaaaacatactacaaccttgggcgcggtacaacagcttggtgtactggtacttgagattaaatgaagtgtctacagggcagtattgatgtcaaatcttgtgttttgctttgtgaacccatccgggatgttttagtaactttaagggaaaaaagtcctatagtacaatgaatgccccatgaagaggaatagagcttctgttattttaatttgtaagatctttattttttaatatcttcactcatttccaagttacttaatgtgatgttttctctcaagatagtactttactgcttgacttccttaaagacaccatcaagtacctatgagtagtcttaaggacagaccattttttaattcatagtggcataaagaaatctacattaaacaactttattttaagcttcaaatggcaaaatgtacaattgtatcagctagagcatatattgtgagctttttaaatttggctttatattttttagtcttggcccaggtacttcagagtagcatttctttatttcctttcaaataactgtcaataaatgaatatgggtttatttaaattggaaagtcctgcattaaactattctgttatcctgaaacaaccttgtctggaaatacggttttaaggatatgtgcatgttccaattccttctttttgttctcattgaagtgtatctctttaatgtctctgatagatgggaaatctgagttacatatgcaaagtcactttaggctttttaaaaggcaattagaaataagaaacttgaaaattttaaaatatatgtttaatgcactggattaatttttggactaaactggtgccctaaaattatttctatgagatctaagcatttcttaattcatttttattttttactttttttattgagacagggtcttgctctgtcacccatcctggagtgcagtgacgttctcatggctcactgcatcctctacctctcgggctcaatcggtcctcccacctcagtttcccaagtatctgagactacaggcatgtgccaccacccacgatgcccagttaattttttgtatttttggtagagacgaggtttcaccatgttgcccaggctggtctcgaactcctgagctcaagcgatctgcccacctccacctcccaaattgctgggattacaggcatgagccagcacttgctaattttataggaagaaaaaaagaactgcgtttctggccactctgagaagaaattaataatccttaaagtctctagagacttttttcttctaaaaaaatggatatttgtaccttttattgcagtcactaattcactttatgtcatattgtaattattcatgtttgcttcgcagattgtaaattccttgagggcaagaactaggtgtatagcagatgtctaaaatattggtaaaattgtttgagaagtagcggggaggggcaggttggggagaaagagatttctacaggatttaatcagaacccaactggtcagcagggataaggggggcggggggcaggaatggtttatgtccagaaccatcttatctaatttcttttttttttctttcttttttcttttcttttctttttttttttttttttttttttttgcagtgatgcactgatggctcactgcagcctcgacctctcaggctcaagtgattctcccacttcaacctccagagtagctgggattacaggcacgcaccaccactcctggataagttttgcatttttggtagagacagggtttcaccacgttggccaggctggtctcgaactcctgggctcaagtgatctgcccgctttggcctcccaaagtgctgggattacaggcatgagccactgcacccagacctaattttcttttgcatagaagtgatatggtagtgtgagagtaagctcagttgtataggtttgttttagttgttttttacccacatactttaaattattactgactcactatctgcccaaactggaaaggacctttagagataaaggagagaggccacatgttttagatttctgagatggtcttacttttaaattttctgtgccattgttctccttggtgtgtgattcatggagatgtgtaataattctttattaaaaacatgattgcttaaaaggggtgaagaaaattggaataaatcctatgtcgtatttttgtaatggggagtgttgaacatattagtgaaacagaatatttttagaattactactattcgtttgcatttaacttacgaattttaaaaaaaaatttttttggaggcgaggtctcactatgtttcccaggcttgtcttgaactcttggcctcaagcaatcctcccgcagtgctgggattgcagttctttttattcttaatctttaaaatgcctaacttcaggcctgggcgtggtggctcatacctgtaataccagcactttgggaggctgaggtgagtggattgcttgaagccaggaattcaagatcagccagggcaaaatggtgaaaccccatctctacaaaaaatacaaaaattagccaggcatggtgtcccacggctatagtctgagctacttgggaagctgaggagggagaatcacctgggagggaggagcctgggaagtcaaggtcgcagtaagccgtgatctcaccactgcactccagtctgggctacagtgtaagaccctgtctcaataaacaaacaacaacaacaacaacaaaaaaaaaacccacaaagcctaacttcattactaactgaagaactttctttccctcatagatcctgagattactctgaaaggtattttcatccaacctgtctactgagaagttatccatctttagtggcatcttgatatcatacataagaaaagtttatgaataggccagctttgttttatatcttttttaaagagtctagtgttatttaatttttttttttttttttgagacagagtctcactctatcacccaggctggagtgcagtggtacgatctccgctcactgcaacctctacctcccaggttcaagcgattctcctgcctcactcaacctcccgagtagccgggattacaggcacccgccatcacacttggttactttttgtatttttagtagagacagggtttcaccatgttggtgagactggcctcgaactcctgacctcaagcaatccacccgcctccacctcccaaagtgctgggattacaggcgtgagccagtgcgcctggctgatggttttatttaatttttaaaacaccagtcactgtatgtgtctgttacattatggtaaaaacttagctaatagcatcatatggtcattttaaaacttctccaggatttgagaaacctgagtgtgaattccagtcctgagagcccaggtcttctaataggaaaaaaaggagattagaatatttagctcataggactattgtgagggtttaggaaattaatatgcaaatgaatttgtataatgtattaataatacttggtgcatagttgttgaagggattaattttattaaagttctgttttattgagtgccttactatgtgccaggggctgtgataaattctagaaatagcaacaattctgtgaaaaagatagatgtagcccagctctcttatgaatccctccctaccacttccagcccctacctctctatactgagtgttacacttcttggccaaaacataagttggtgagtaatttgttgccttttaataaaatgtctaaaagggataaatgtaagatctcaaaatgtattttgtatagtttgtgaaatttaacccgtagtatatttttttggaaaggcaacatctttagggcagtggaactactctatgtaatatgttaatggtggatacatgtcattatacatttgtccaaacccacagattatacaacactaagagtgaaccctaatgttcaccagagtcttagggtggtaatgatgtaagttcatcagttgtaacaaacgtaccactcaggtacaggatattttggtcaatgactgatcgaatgtatgatagtagtcgcataagattataatactatattcttactgtaccttttctatgtttagatatacggataccattgcattacaattgcctacagtgtttactacagtaacctgctgtgccatttgtagcctaagaggaataggccataccgtatagtctaggtgtgtagtaagctataccatctaggtttgtgtacgtgcactctttgatgcttgcacaatggcaaaatcacttgacaatgcatttctcagaacacatctctgtctttaagcaacacttggctgtatttgggaactctctgtaacttctgcttgattttgctgtgaacctaaaactactctaataataatgtctattggccgggtacggtggctcacacctgtaatcccagcattttgggagaccgaggcgggaggatcccttgatcccaggagttagacaccagcttgggcaaggtggcaagactctgtctttacaaaaaaagagaaagaaataaagaaaaataaagtctaccaaaaaaataaatcagaagagagaaaaaacccaaaacaaaaaaggagaaaggaacatgtaatcattttcatttttctttgtccaaaattattgttataataggtttgcatttggaaattatctactgtgatacagacctcctctctttattgccaggatcagcaaagtttttccatataggttcagatcataaatattgtgtgccaagaggtaaaatcaagaatattatgatattaatatcaaggatataatatattatttctatcagtttttattgacaaaattcaaaatataataattgagtacaattttttggtaatacaattctgataagaatagaattctttttttctgggataacatttcacttaattgggttcaaagttaatgtgcccccatcatcaaaatggactgcaaaaattttcctttaataaccatatccagcttgaggtcatacaaaaacaactggtgatccagttttggcccacaggccatatgtagtttgccaacctttgttctgttagttaaatagatcaataaggccaaattggaaagggtgtatactcagataatataataatttacatgcataagaatgtgtatattagcacacatgtgcatttttatatcaaaaccagctataatttgttttgtttcctctttattcttcctttaatgagagtgattgatagatgtcagtatgctatttgaaaatcaatgtcttcacagtgaatgattctaaagtggcttaatgggaaaatgatactttccgtgaatcattggtcacataatattgacctttagctttggctcatataaccaagaatttctattatgtagctttttcctgtcactgctgggtactttggcccttccttaaactttttgaatgtaatttaagattttgtccttagaaggaaaattcagaaatattttttctcaataaattttggtaagtgatgacttctcatttgttttctttattaaagctgtatgtagagacatggtaacctattcagattgttttgatagtttgaaattctgtttaaattatccctaagatgagaacttagcaagagtgcttatatttatcacaattttttaaagtctgaaacgtttttggtttttctttagatctttaaatggatgagatggctaccactcagatttccaaagatgagcttgatgaactcaaagaggcctttgcaaaagttggtgagtattttttgtagtaaaactatagggaagcaatatttatttggtctcaaagttatttctctataaatatcacatgaatggttaatcaaaaacattagggcaagatagttaaaatagatgggataaagttttggaagctatacttaaaattgttttatttcttttttttttttttggtcgagtggtagctgatattatttccaattttatgtagtatttaatatggtcaaattttttagaccacagttccaatccttaactggtgactgttatgtatggttcctgaaattttcatgccaaattttagttattattatattttgtatctcatatctttctgaagaggtttgaaactttcaccatattctcaaagggatatgtgaccctcgaaaacattagatgatgttttacccttccttaattagtttggcgttattgacttttttatgggttttctgtgcctttggttactgcagatcgttctacctcgccacgttaaattatagcttcagtataagatgagaaggcatagcatgctatttgatttatcctttatcatcatataacatgccttacaattgagcagctatggaaggtaaatatggagtatttacattccaaattttagtgcttgggtcaagtctatagacaataatgagaaaacagggtgagaacagcctacttatgtaaatacatgaatcaacatgtgcttagagaggtagattattattatttggtatctccttgactgaagggtacagaattagctcatatgatgatttgttatgtaaatcagaatttgccgttagacctgtgtcgaaaatcccattagtggaaaatgaggaaatatacatttctgttcccatatatttatgatcaacattttctatgaaggcattcagtagtagcagtgtaccttgggaagaataatgaccccagccagagtgaccattcataatcccatcaaaattttaactagaaaaaactgaatattcctgaatctaacatgatcgcgcgcacgcgcgtgtgtgtgtgtgtataaaaatagcagttaattaccttgccatggataccacttactgtaagaaaaatgctacatagtttaatatataacagcaagtgaattcttggctgcaagagtttttttttttcaaaatgactctcattcagtcaaaatagtcttataattgttttaggagtgcatttttgaaccttttttaaaattaatattcatctttcagcattagcagcagcttaatttgttatttatgaatagaatttcagagtaggcaccatgccttattaagtactcatctcctcaagtaaatgctgaatacaggtcttgtcctcatgtgcagcatcttggaaataattacgtgcaatattccttaaaaattaaagttaattcagatattgtttacctgatgagacttggaatacatttgacgagtaaaagaacttcattgtcccttaaaagcttaatgacataaagaggattgaccaattatcttcatagaggaaggagttaaattgtattaagtaagggatcaatgagaagtttgactgcaagaaaaggtcattgtggagctattgtttaagtagagtttaagataggcgtacagtttgccaaagcccctgccaggcatatgttcctaacatactcaggctcttattactatatatgctgtaaagaattctggaatccagaatttctgcctattgtgaatattattcttttgtagtctccactcagtatctagcatagtgttgcacacatgttaggttctcagtaaatatttcattgattgaaacccaaggaactatatacatagccttttgatgtactgggatttttgtcattatcaaccatacattcagagggcctttgttgtgaagattttcattacagtggaatttattattaaaggtttttgccattaaattgtagcatataaaatttatatatatttttcagcataataaaagcttgtgtgtacactccatcttttagaaactcatttaaggacccagccgagtctttcgattttctttaaaaaatctttgtagttttaagttgttgttacttacagaaccctcaggcaaccgtcaaaggtgttatagaattttttttctaattcagggacactttattttaaaaacaagctctataacttattatcctgtgaaggacagtttttcctttttgtgggggtgggttggcagagaataggaaagactactttgtctcagttcaattgcgacaaaatatggaaatcattagatgattttccccatctattaacaataatagccttgattatctccttagaaattcagcaaaatcatagcgtgtggagaaaatctctgtaattactgctaatcataggttttgttcaatcaattaatagtgctttgaaactctctttactagcaataaattgagtattagaatttaaagttctcttttcactcactttctgcacctgcttagttttaagctccaagctcatgtaattattttaattttctcaacaattgtttccagtgcttcccagtagcagaaacgttagttatcagtttttgtacttcatgatgtttcaaatttaatttaaatgctgtaatacataactatttctaaagaagaataaataaaacctttcaaaacacttaggtattaatattttaccatctagaaactgtcttttacattctaagcctttaatcttgctatggaaactagtggtcatttggatgattacttgtcataaagaaaaattcatgtaatgtaaacctttgcagagttgctttagtactgcaaacacttaccttgccttgccttttttccctcctgagcactcactactgaggttttttaaacatgaattcagcacttttgaaataaaagaataatgggtttcttaaatgactaggaatagtatgggtgtattcctttgaggtttcccaccaaactaagcaaaaaaaaattggttgtggtgattgtagctataccagacttctctcatcctaggaagttgagttgtttcaaattacttgatattcgctagtatataaaaaccacatcaggatgatgccacaaaaaaaaacagtgctttagtttaatttactttcagtattcaataaaagaacaccagtgcatatttgtttaattatgccttaaaacaaaaacaaaactatagcccgtctaaaaaaaatgaaactaatcagtgctctttcattgtgccatctggttaattatatatggattattagaagtggaggtctcgggatagtcggaaaaccatgtttcaaaggtgtggaagctagttaggagtacacatgtgtgggtgcatgggtaaaagcaatttttatttttatttttatttttattttgagactcctgggctcaagtgatcctcccacctcggcctcctaaaatgctgggattacaggcttgagccatggtacctggccagccaggtatattttgcttcatgcactagatgcgttcctgaaaatcagcaagccaactgtaaatggattttatgtagtgggatatattttaaatgtaaagagaaaatcttatttttttaagtgaagcctgctttgaatttttttatttttttatttttatttttaattattttttgtttatttattttttttgagacggagtctcgctctgtcacccaggctggagtgcagtggcgcgatctcggccactgcaagctccgcctcccgggttcacgccattctcctgcctcagccaggtggcagactacaggcgcctgccaccacgcccggctaatttttttttttgtatttttagtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaaggtataagctgtgagaagcaaaccccatgtttagctaagcatctggagatgtttagcagctgccttttctaaggatttaatgcctaatgaaagcttgatttcactgcttagatcttgggatggaatatagtttaaattcttctgcccaagtcttttgaccgagtcttttaagtcagtattttgtgagctttcatgggcattcaggattgtgtatgtgtgtaaacccattattgttagataaatagattccttttgtcatttctttagtgcagaaaatttgtagaatatgttggtcaaaccaaattgaacttttaaatccagcttttccaaaaggatatgcatctgcacttgctaggctttcttctttaagtcctaatgagcactgtcctgagtgggctaatagagaggtcgcatgtgtattccagatgagggcacacaatatgtgacctcttcataaagaaagacaccagatttagacagattcaaggatgtttaaagcaacacacacacacacacacgcatacacacacaacccgagcgtcaaagaaaatcctagtctttcttactgtcaaatttatgagacaaagtagcaccccaaaagacgcttttgaagtgatagattgcagcacgtaccacctggacatgggcagtgtaaaacagcagctaaaatcaaaaccacttggattctggcttagctttctccagacaagtacttaaaatagcttaaataacaggatgcaaggggagggaaaacatttccttttaaggatatgcattcttggtgtgattcaaacttctgcaggaacatggctgtgtaataagtttatttactttaaggtttacttaggggagggcggcgggggagttaaatagtatttaaaataatacttggtaaaagagaataatgagatttcctttaaaacaaaatgcagatgtgaacctacacgtgtcatcagagagagagagagagagagagagagagagagagagagagagaaaggaaacagtccttttaacagttgattcttttcttatgaattcagtcagtggccaatatgaaaaatgggcctgtctggtgcagcactgggagctgcgtagtgatttttttttaagtatcataattttcttcttttaaaaaaaaacgctttgtcaatttactcaaatttagccctttactttctgccagaattgtgttcagtgataaggtagagtttcctttatccagcttctccttaatgtccagccatactgaccatattttctaaaccaaaaggttgagaagtgctggcattgaaactgcactgcacaatataggcagtatggtaatttatgtctgctttatcagctggttggaaactatgatgctgaaacagaagagtcttcaaaacacagagcttttcccactccataccaatgtatagttaatgagaaaatggcaagtgagccaaaaaggtgttgcagagtattggcagcatgaatgagaaaataaaggactgccatcattcctggtggttgtgattttagtttccagttgttaaaacgacttccaatctaggtatgttattttgggtcagtttattattaagttctcatgtttatgtcaaaactcagaataggagaaattcaccatcaaacatactgaacagcaacattctaattccaatgctctgtttttaaagtggacactgtaaccacaaataaggacatagtcttatgatttcaaaaaattaaattgtctttttgaaaaaccttgccacattattcttattctcattttgcttttgaataacaaaaaattatccaaaattcattttgggttatttggaaatcattcaggtacctcagctattttattttacacataaggaaaacatgactcaaagactatcatttagccagtttgtaaaacgaaactacttttctccgatgtagaaaattagattgaatagtcatcagcatttatgtttattttttaaaattacaagttagtcttagaagtagactaaaagttgtgagcacctgatgagatggaagctttctaaaatcccattatgctacctttttactggccttccaaaccacgttagatctttgatattgtttaaggatgtgtttttggttttttgactgagggttcgaaataaaattagcataaaactctttaagaataattgcatgctattttgtctctcaagtactttaccagctgggaggttttgtaaaattaattgctagctgcatttttaggctccctctgccttcttgtttaaattgaaattattttcttcaaaatatatgatttaagagctctaagaaaggcttgataaaattgactctaactaacactaaaatgcctttgatcatgggaggtagtgtaatttggactaacactgggggctaaactatgggaaaatggcagaataggtaaaacttttagaagacgacgcacattcttgtcatccaggaaagcctaaggatatgtattcgaagtgactcaaaatttttacaaggattttgtagccacagtttcaagtaagacccaggggttccgtttgattcatttctgtatctttggtatgtagcccagtgggtgtcttcccacagggtaggtactcagtttgctctggagggtgactcatacctaaacaagtgcacatctcctttctcagtaaagccaaagcaggtttctacatttggaacaaaagagatcctgaccagagagctatcactggtggtccacttgggccctccttgatgggtgtgttcacttagaaaaccaaattacagatctgaaggctgctgggtagggacaggattagaacaaagggaatgagattgaatgttatttaagggatatttctgtcaagttttggtttctcgatgaattgccattcagtctttgagtgctatttctgtatttctgtcattgttgtttagttttgtttctaaaatgctcatctaggattagagcattctttctttggtcaattcctgagaatcagtgattctacaaaaataatttttttccattgcttattatacacaaaagattgtgctacatattggggtgggagatacaaagatttaaaagaatctttatcgggagatttgcagcctaataaggaagtttgtcatgtaatgacaaattcttattcctccaatttcctttaaaattttcctgtccctttctaaaagcatttcttactactgcccttacttcaaaatgaaatttccaaatgtggttattttatgttaattatgttttagggtggctacttcctggcatcttttaatcacatcagtgaactgtcttctaattaatgttcaagagaggttatttcagggaggatacaggcaaatagtaatttctccctgcgacccaaacttctggagttttttgtttttgcttttgagacagtgtctcactctggtgcccaggctagagtgccatgatgccatcatagctcactgcagcctcgaaatcctgggctcaactgatcctcctgcctcggcctcccaaagcgctgggattacaggcatgagccaccagtcccagccaccagacctgtagtctaacctaatacaaataggcagccagataaactttctgggccttagtcagtttcatatagctttgaatccactgtagttctcccacatctaatttaaaacatctctaccttccacttccattataacactgagaatacaaaaagaacaaatcctgttacatacctgttatatactccagtctaaactagagtcaaagcacagtggctcatacctgtaatcccaacactttgggaggccaaggtggaaggatcatttgaggccaggagtttgagattagcctggtcaatatagtgagaccctgtctctacaaaaaatacaagaaacaaaaagttagctgggcatagtggtgagagcctgtagtctcagctactcaggaggctaaggtgggaggattgcttaagcccaggatttcaaggctgcagtgagctatgattgtgccactgtactccagcctgggcaacagaatgagaccctgtctctaaagatacttttttaaattaaaaaattggctgagcttggtgacttatgcctataatcctaccactttgggaggccaaggtgggaggatcacttgaggccaggagttcaagaccagcctggccaacatgacgaaaccccatctctactaaaaatacagaagttggccaggcatggtggcactgtaatcccagctactcaggaggctgaggcaggagaatcgcttgaacccaggaggcggaggttgtagtgagccaagatcatgccactgcactccagcctgggtgacagagtgagacttagtctcaaaataaagaaaatagcttaaaagaaaaaaagaacccactgaagtggacaacgttttgatagttaaaagaataagctatctcttcctccaaagatatcataaaaatgaaagaatattatacttaggtaataaggtgcagtagtgatcagaatgttatcactctgtatctgtatttaatatgcgttactattctatctccaggttttaaaagtgtttgtgtgaggggagggttgtgaagtcttgtgtattctgatttagaatcagtgtgatagaaccaaaaaggaactttagagattatgtggtccaaagcactccttttacagatgagaaaactaggacctgaagaggtaacttgtgcaaattaatagccaagttgagataagacattgtttcacattattcccactgtgtgtctcttcaagcatgtatgctgtgtttctttcactatgccacacttactctctagtactgaactccactgtaattttagaaaggatgtaggaaaaacaagttggtatatgcatgggagcaggtgtatttaagcccaagacattcataaaacaagagccactaaaattttgcctcagtgccatggggattactttgttctttttagcaactgcagacattattgatggattgatttctacatagaaatactttacatgtagaaataaagagtttgatgtatgaccttttataaatccaaagcaaagaaagtgaatatacatcctagggaaattaagtgctttacctcaaaggaaatctaagtgattttcacactaagtattgaatggtttgttattgatgttttaaaagtacagatattttaattagccaggcatgatggtgcccacctttggccccagccatgccggggagctgaggcaggaggattgcttgagcccaggaggttgatgctgcagtgagccatgctcgtgccactccagcttgggcaagagagaccctgtctcaaagaaatacaaaagtaaaaataaaggtacagatgttttaattcatagatttaaaatgtagtaatcaatgtttaagaaaatttaatacttaaaatagactgcattaaaactaaacagaatttcatcagcattcaaaatatttgcaagatggttccatgcagtatacttaatattttaatttaatttaatttttaatcccccagagcattcttgcaaattgcaattttagtaattgaccaaaaattggacaatgtgaactacacgtagatcacacttagaaagaaatgtcagtgtattccatggaatacattggcctagcagagcttataagatcagctagctccccgaccttatctctcattttcccccttgttcactctacccaagtcatattggatctttacttttcccgaaacacaccagacacactgcagcatcactgactttgcatttgctattttctctacccgaaatctcttgccccagatagccacatgatttgcttcccttacctcatggaagtcttcattcaaatataacctcatcaaagtggccttccttacccattctgtctaagtagtagcaccaccaccatccctgccccccaatatctctataacccagggttactcaacttcagcacaattgacattttaagctgcataactcttgtgttgtacatacaaggaaggggtcatatccattgtaagatatttagaagcatccccagcctctacgcactgtatgccaggtgcttccagttatggcaatcaaaaatgtcccctgggggcaagatagccccagtctaaccccttatgcttttttcttttttttttcttttcttttttttttttttttttttttttgagatggagtcttgctctgtcacccaggctgcagtgcattggtgcaatcttggcccaggttcaagtgattctcctgcctcagcctcccgagtaggtgggactataggcgcccaccaccatacccagctaatttttgtatttttagtgaagacggggttttgccatatgggccaggctgatctcgaactcctgacctcaagtgatccgcctgcctcggcctcccaaagtgctgggattacaggcgtgagtcactgtgcccagcctgctttatttttttattttttattttatatatttttttgagacggagtctcactctgttgcccaggctggagtgcactggtactatcttggctcactgcaacctccgcctcccaggttcaagcgattctgctgcctcagcctcccgagtagctgagattacgggtgcccgccaccacgcccagctaattttttgtatttttagtagaaacggggtttcaccatgttggccaggctggtctcgaactcctggcctcaggtgatccacccgcctcagcctcccaaagtgctgggattacaggcgtgagccaccgtgcccggccacaatacattttcttaaatgcgctaaggtcatcttgagtcatttctctgttcaggttgtttccttctattataattaagtttacatatgaaaatcagtgagacctaaggaacagaagatatttgaaattacttgtgaacatcaaactttattcacaggaaaatatatactcaagtggttacaaccctcaggacattagcctttttctcaataaattaacttttggtcattgatcaggttttttttttctatttttaaaagcttcagaataaacatcattcatttaatcagcacttcaagacatactctgagaaacttcagtagtacaaaaattaaaaggttatttatagagtcatattaaatatctgctttcctcagtagtgcatttatttttataaactctatatttgtcttgaattaatgtttgtttacattaactcttaaaataattggcactgaacatgactgcttaatttcaggtgtactttgaaacagaatcagcattaagttcatataagttctttttggagcaatggaagaataagaaacacaaaattcctatacttacagtagaaattgttctataccatggaagtgttttgtaggtttacgatctattagttctttttttaaaatcctattagcgccaagttaataataattgtattagccaactatgcttccttgaacttagggatgctctttttaagtaaatctacttacacattgcttaaatcacaggatacatgatgtaaaaccttgctttttccatttaaatgtccatttccctttcaaacaactttatgttccccacaataagaaaatattttatgtaagtgagcttatgaactgaacctcaaatgaagggaaatactctaacttctgtctttcaattttttttccttttttgcttgctctccttttttacaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatgtaagtatgtgaaaattcacaattattagaagtagtagatgttccctcgtctagtgggatgttatagtattaagtactgttatgttaagttcttaaatatatcatattagtactgttataacatttctgtcatcctgcccactaaatgtacttcttttagctgctggaatatcttaacaaacgaattgagaaaaagagcactgcagaaacaaagatataacatgataagatgttaaggtgataagttatataaggcgaacagtctcctttcatgtcatcattaaagggcagttatcaaggtgctaagtgacatctttgaagtgttctctctcccgtggtgaacagtgtgctccaaaattttaataatacaccctgactcacagtctcggaagcttcctgagctgaactttctcattaaaaagttgttttccactcttgtggtaggggtatttaactgaaccattctctctaggatgataattttgataattaaaagtttgaagcatatcttttcagtccattggaagaggcatttaacatttttgttttcttctctagtttcatcaaatattcttcaaggttaggggctgagtttttaattctttcacccccccaccccactcccagaacttagtttggtgttctctactcagtgcctggaaaatgtatacatggcacatggttcttcaatgcctaccactattggctgctagcaagtgaggtctagattttttagacttatgccattttcagtctgtatttattgacagtgtatttgagatacgtgttaaaaatagctggctgggtgtggtggctcacacctgtaactccggcactttggtaggctgaggcaggagggtctcttgaggccaggcattcaagaccaacttgggcaagttagggagaacttgtcagcttgggcagcttagggagaccccatctgtacaaaagaaaatttttaattagcccagcctggtagctcgagcctatagtcctagctactcaggaggctgaggcaggaggattgctcaagcccagtagtttgaggctgcagtgagctgtgataacaccactgccctccagtctgggtgacagagcaagaccctgtctctaaattaataaattaattaattttaaaaataaaagaatagttgttgcttcttccctcaattaaggatacctttaagattttattggtgtatttattattaatttaaggctgagtttgactagatcttactagggattcctttcagtatatcacaaactagttatcagtgcctaatatttatcacaaatgtcccagcgctcctatcctcctttgtcatggtttatttttccccaagacaactgaaacgatagcatgtacttccatcagtaactgtggctcaccatagcaagtgaaattttgaaatgttctttccaattagaattaacacctttagaacactgtagtagtccaagaagcaaattgactaagtaatgatgcctactcagctgacagcattttgtgattgtttttaaaatgcacacttgtcggccgggcacggtggctcacgcctgtaatcccagcactttgggaggccaaggcgggtggatcacgagctcagaagatcgagggccatactggccaacatggtgaaacccggtctctactaaaaatacaaaaactatctgggcgtggtggtgcgtgcctgtaatcccagctactcgggaggctggggcaagagaatcgcctgaaccagggagtcggaggttgcagtgagccaagattgtgccactgcactccagcctggtgacagagtgagactccgtctcaaaaaaaaaaaaaaaaaaaaaaaaaagcagacttgtgtcataattataatgatatcgttcctgccgttttcttttgaaatactgatttcctcccaccatttttttgtctccagttatggccaaagccttttgttttgaattctatgttcaatagtaagttgcagtttatttgcaatttgagcacttgcatgttttctgatgtatcacttgctccccttttaactgcatggttaattgtgaatttaaagtagcgcagagcagcagttaactatgattggctgtttttgataaaatgtattgctcagaattttttaatctattagaaagaacagaccaaaatcaataggatttgcagtgtgtcattatattaaggacaaaattgtaaaagtgtctttgaaaatgatcttggggaaattgttaattttgtagattttgaaatgtagtttttacacagctatttgtggcttttaagggaggaggtgtgattaccttagtatattctttaaaagtaaagaacatgcacaataattttggcaacaccagggctttaagaaaacaacattcgtgaggacattttaggttagaatatacattttagaattggaaggaatcattatgtttacactcctacacttttcaaatgaaaagaaacaaacttggatttctgaaaaaggaagtgacttttcctttttgcctaacattacacagaggactagtggctttttccagtacctccctgctattcaagaaatttgaaatatcaaggacagtaaagtaacctacctgaagttttcagatgctactactactatgactgtattaaccaaatgtctgtccgcacccatctgccttgtcatcagtgaaacatcttacaaattgtcaaacaaaatatgggtagagcttagttatccaagaaatagaaatcatgttattcctgttagatattggcataaggaaatagatacaaacatgttcttgcttgttaggtttctgctttttctttgaattgttgcttaaggggtgttaattgcaaaccagactacaaacaaaaacagtttatgttaatttcagagaaatgtctgtgtgtgtgtgcgcgcgtgtgtgtgtgtatggcaaaaaacagtcccaaaattatatgtatgtaaactttaaaggtgaaaattaaatttaataccctgctttttaaaattctaagcacttcaaaactaaaaatactggatttttatgcttacaagataatgggactttttttctttgattgttaaactagtatggcactttcagcagagaagtaagctgcccagaacagtcttggacatatagtaaatactatataggtgttagttgctggggtagttctttctttaaaaaaaaaaaaaagaagttatgtttttcaaatattactaagtttaggcctacaagacattccaaaataatggaaaaattcaatcctgcctctttggaaacattttggaaataagccccaaacactggaagccagtcaattctttttttgcaattctttctgaaatctttctttcttaagtcatatgcctctggattgttttggtttggccactcgtcctgtgttgagctaactctggggtcaaaagaagttagccggttgctgagagtctttgagagaaagaaggcgaaacttaataaaaggaataaaaaacatatatattccataacggagactgaaaaagatgtatagatcaagagtggttatggcttcctgaaaaaagtacagcaggagttagctcacagatgataaagcaagtctttccttgtggagagaaaacagcacaaaacagtgagctcattagtatcacaacgggcagctttgaaaagattcattgagaagactccagcacagtagtcagccttgtgctatctctgatttcagagatttcttgtcaagccaaagcttgtactcaaatagttttatcatccacttaagcgatttctttactaaagtagaaagtaaaatgcaaattcttgtgtagtgaatcaatatcatagacacaaatcttcagttctttcttatcatttttactttttttttttttttgagacggagtttcactcttgttgcctaggctagagtgcagtggcgtgatctcggctcactgcaacctctgcctcctgggttcaagggattctcctgcctcagtctccagagtagctgggattacaggcatgcgccaccacgaccggctaattttgtgtttttagtagagacagagtttctccatgttggtcaggctggtctcgaactcccgacctcaaaccatccgcccaccttggcctcccaaagtgctgggattacaggtgtgagccaccatacctggcccatttttacttttttaaaaccaagggaatagaggaaaatactatgaaactaaaagtttaagcttagctggaataatttatttgaaacaatttagaaaatgaaggtcatgtaacttttgcaagacctttgaaaattaacaaacttaattacaactttgcatttcattgccaagcataagaaggagttttactaaagctatgtaaataattgcattaggatatatagcagagacattctatatatatgtatatatatgtttaatttattttcctttttttttttctgagacaggatcttgctctgttgcccaggctgaagtgcagtggcccatcttggctcactgcaacctccatctcccgggttcaagtgattctcatgcctcagcctcccaagtagctggggttacaggcatgcaccaccacgcccacctaatttttgtatttttagtagagactgggtttcatcaagttggccaggctggtcttgaactcctcctgacctcaagtgatccacccactttggcctcccaaagtgctgggattacagatgtgagccaccgtgcccagcctacttttctagttctagttattagttcgaattcccagacgttctcttttttaaatatgaattaatccttttttctgtgacataaacaaatttggatttattttttagctgaaatcatgatcattgaaacaacctaagttttagaagtaaatgattcttgaagcagaagcactcgtaataagaaaaataactttacatatctcattctgaagctgtaacacttttgtcattgcagggacttgtggtatgttaggcatgaagaaatgcacacctttcagattttaacttattagacaatgaagtagagttcagaaagaagtagactagtgactattgtcttttcacagagcagctgcgttgttatcaaaaggagagctataggatcaaaatgcatcacagttaaggcacagttggactaaaaaatcagattgtaaataaaaatattttaatcatttgaaaactgcctgaagtgtgtgcgtaagctccatactgttgatacttagtgaaagtcagtataatggccatagagcaggaagggtgatttcattggttgtgtttagtatttagagtagtgtgtatgtgtgtgtctgcatacatatacaaacatagacacacacagacatttattctaaaattccacctccaaaattactggtaaagctagcacagaatcacaggtatggaaatactgagtaagcttgattttgtaaaatttaagtgcttactaactattctctcaaacaaaattttatttgtaagtccaaagaaagttaggatttaatttaagaaaggtaacaggaaaaaatgactaagtaatagggccactgacaacacatacagcaacttttctaccagttactaaaagtcactttctctagatggattaattacaaaaaggtaccctcctggaaagacaaaatacaacaaggcactcctttcggtctgacacagtcctgtgcgagacacaaggcttggttagtatagcttgggctggatttctgcttctgctcgtgcctgctctgacacatacaacctgaactgttatgtatattgtaaccctgttctatgaaccgcagacataggctgcatcttcctgagatgtgtgtgtgaatacatatctgtcacgaatgttaaaggtctttgaattgcatttgttcagcaacttttccattaagtcttaagttttctttcaatgaatccacttaaatggaattctaaacgccatttaaagaaagttgtatacggtttctacatcttgctcctgttttactggctttgactaatttagccacgcacattggtggatcaggaacacatttggaattaggtacattccaatacctcagaaaaatatagacagatagaatgtccaatcagatagctacacagtactaggatgtgaaacttactgtgttataacttgcttttgtacaattagaatgttccttactgtgaagagaagctggacttcataaatgccccaataagacaatcactgaaaagcctctttttggtgtttattcttgatagtcatctattactaccagcttaacacattttttaactgcattattctgtaacttttgatttaatgaattcttaatgagctaccccattatactgtaaaatagttttttggttaaatcataaaattttatctttctttgcattaagaatttttattaaagtagggggattcttcaatgttttctctccaggaaaagaataaagccttccttgtttgtagaaaattaacagatttacctgtgcctttgaaccacattagtttttggcttaaagtgagttcaatgcatgtagcgcttaatgtttttgacaagtgtgtgcaattgacattctggtgcttcattttcagaaggggtattgtagtacttgtttagcatttcaaaaactcaagcccagttttttgtatcttttaacatcagctatggaaaaaatgtaagtgatcaagatataaaagaatataaatatgcttattgtgcatagtttgaaattaattgtgaatcaacaaaattactttaattaatagatttttcaagaggtaaaaagtagtgatattgccaagaccttccgcaaagcaatcaacaggaaagaaggtatttgtgctctgggtggaacttcagagttgtccagcgaaggaacacagcattcttactcaggtaatcattttatatgcaataggttaacacaatgtgctaagtgggatggttgctgtaatgtcaaggacgggctctagaaaaacattaccttctaattaagaatacagtagaagtcctttgtgacatgtatttaggcttgagactaatacttgtcataaaggcattataagtgtttattgtatggctttgttagcttgcaagagacaggatacaatccatgtaatgacaggctttattacagtgcattatacagtaatataaatataatttttaaggaattttgtaacttttctgaggactggttaacgtgttctattctttttcttaattttgtaattcctaataaccactgtgttgcatccaagtgtctgggtttccacacagaataaccacatgtttctgacacattaactttcagcactactgcacaactattttaggctttggagtcaaatatttaataagttagagtatgaactaatgtcttgttatttaacataattttagaggaagaaaaatatgcttttgttaactggataaacaaagctttggaaaatgatcctgattgtagacatgttataccaatgaaccctaacaccgatgacctgttcaaagctgttggtgatggaattgtgctttggtaagatgttagcttgttttatatccagatatccaaaaatagccttccatataattgatatatttgtttctgcatgcttgacaggttcacctcaagaaataactagaatggaaaattatccaggttctgcctttttcatttaatctctaggtctgtccatgaatctaaaattcagccataaatcgacaacctctttatagggaagctctcagcctccattttcttctcaacaccaggccagcagaacattacaactttgttgaacttaagtatgtcagtgtctctttattctaaagtaccacagcttccaaaagaaaaaaagaggctactcttcagttctcactctccaatgacctatttctaaaaaatgcttttgtcactgctgctgccccacagccaacagcatcttggcagacataacacaacattatcaacactgccagtcgatgttccaatttatagaggcagtgtcacacagtggttaatagcatgctccataatcagtctgcctgacttctttctattcagtcctgccactctgaagcggtacaactgtgatcataatactcaacccctttgcatttcagtttccatctgttatgatctccacattattatacttatctcacagggcttttgtgagcattaagtaaattactacatacaaagtgcttagggtagtgcaactgacatatttcagataactatatatatataaaatatatacatatatatgtatatatatacatatataaaatatatgtgtgtatatatatttacacatatatattttatacacatatatacaaaatatatatgtatatatacaaaatatatatgtataatatatataatacatgtatatatgtatatatatgtataatatatgtatattatacatgtatatatgtatatatatgtataatatatgtatattatacatgtatatatgtatatatacaaaatatatatgtataatatatataaaatatatattatacatatatgttatataatatatgtatatatacgtatataaagtatatattatacatatatgttatatataatataacattatatatatatatatatgttgtgtgtgtgagatggagtttcgctcttgttgcccaggctggagtgcaatggcgcaattttggctcaccgcaacctccgcctctgggttcaagccattctcctgcctcagcctcctgagtagctgggactacaggcatgcaccaccacacccggctaaatttttttattattatttctttacttttagtagagatggggtttctccatgttggtcaggctggtctcgaactccagacctcaggtgatctgcccgcctcggcctcccaaagtgctggggttacagatgtgagccaccgcgcccggctgacagtatatattatagtatacacaattcttctttttgcagtagggtcattttggttgtttgaaaagctgatattaaaaatgtaagataggctggtcatggtggctcacgcccagccctttgggaggcagaggcagcaagatcgctgaagaccaggagttaggtccagtctgggcaacaaaacgagaccctgtctctacaaaaaaattaaaaattaacccaacatggggttgcacccctttagtcccagctacttgagaggctgaggcaggaggatcacttgagcccaggagtacaaggcggcagtgagccaggatttgcaccactgaactccagcctgggtgaccctgtctgtctaagaaataagaatatatatatatacatttcctttgtgttctgtttacaagcagtgaagaaataatttcccatgtgtgtgttttgtttttgtttttgagatggagccttgctctgtcgcccaggctggagtgtagtggcgtgacctctgctcactgcatcctccacctcccagtttcaagcaattcttatgcctcagcctcccgagtagctgggactacaggtgctcaccaccgcacccagctaatttttgtatttttagtagagacagggtttcaccatgttggctaggctggtctcgaactcctgacctcaagtgatcctcctgcctcagcctaccaaagcgctgggattacaggcatgagccaccgtgcccggcctcccttgcattttaatatagagagaagactgcaagtttccctctctggggactcaccctgcagaactcaaaaaatctataaattgtaaaaataataagagataatcatattgaactaactaagatttgaattttgcatggaaagaagcatggctttctttctgtagaaaaaaatttattagggcagtattatgaacatctaatatgttagagccaggcatagtggctcgcacctgtaatcccaggtacttggaggctgaggttggaggatcccttgagcccaggagttcgaggctgcagtgattcgagctacgatttgggcctctgtactgcagcccaggcgagagttagaccctgtctctaaaaaataacaaaataaaaaataaaatgttaaagtctaaatctagattttaccaaatgagatttttcctaatgagtcacagactatagcctacctaatctttctctcgccactatactgccagcaccaaatatagtgtctggctcattgttgaggcactcggtaaacatttggtgaatgaaagaatctcatgctcaactaattttactgttttgtggaaaagactcatttccaatgcaggattttatctgtctttaaaatatattcaataaagttccaccccccacttttttttttttctttgagacagggtcttgctgtgcagtgattcaatcatggctcactaccgccatgacctcttgggctcaatcagtcctcccacttcagtctccaaagtagctaggactacaagcatgcgccactatgcctagctaattttttttttaactttttgcagagatggggtttcaccatcttgcttaggctagacttgaactcttgagctcaagcaatctgcctgccttggcctcccaaattgctagggttacaggcgtgagccacactgtacctggcccaagttttgttttcaatatccaagttattttctttcataaaagaatgagaaaaaattaaaaaaaattgaaagagaaagcatgctacaatcctctgctcagagatacccaactactatgcacatattttggtctttttgggtttttttttttttaacggcatcttgctgtgttgtccaggatgaagtgcagtggcatgatctccgctcacttcaacctccgcctcccaggttcaggcaattctcctgccgcagtctcccgactagctgggactacaggtgtgtgccaccacgctgtgctaatttttgtatttttagtagagacggggttttcccatgttggccaggctgttttccaactcctgacctcagatgatccacctgccttggcctcccaaagtgtgggattacaggcgtgagccaccatgcctggccagggttttatttatttatttatttatttatttttcttttgagacggggtcttgctctgttgcccaggctggagtggaatggtgtgatcgtagctcactctaactttgaactcctgggctcaagctgtcctctttcctcagcctcctgggtaacctgtactacaggcacatgccaccatgcccggctaatttttttatcgtttttgtagagacagggtctcactatattgcccaggctggtctggaactcctggcctcaagcagtcctcctgcctcagcctcccaaagtgctgggattatagacatcagccaccacatcaggccttggccttttttatttttagtttttattttccatatgtgtagtttattatgatcaacatgataaaagtcatctagctgcattttttagagtacatgaaagagatgttatagtaagctttaaaatatttgtaaatatttacagccactttataaaaggaaatcagctctttttttttacatcagcctttttttaaatttttgtttcagtaaaatgattaacctttcagttcctgataccattgatgaaagagcaatcaacaagaagaaacttacacccttcatcattcaggtatgcattgttctcccctccctttaacatgaaattactgtttgaggacctgttctgcagacttcagcctctgcactctgtaggctcccaatcaatccttgtaaaaactgttgagtgtgggattgttatccagattatacagacagaactgggactcagaaaggtttctgagcttgcctgagattaatgttggaactgaggttcaaatcccattctaatttcaaagccccatgttcttttcatttcataatgtgttcaagcactacagagataagcagaagtatataagctcttaattaactggcgtgcttaagaaatggagcatttttttttctatcaagtgaatattagattattagcaaaattccctcagagaagagcacctcttgggatgtggacattgataacttctaaaactcttttgggcatatgcagtactgttggtctctcacccatttaggcatttttggaattataacactttactcacatggatatatttactgtggtactcagccttttcatttagtgccagcatacttcaaaaggtaccaaataaaaatacaaagttaacttctcatgagattctgcaaaaggcaatagcaataaggctgaaatttgtcttagctaggctttctaacacaaaactctggaatttgttttttgtgacacatatatggatgaaattaatacagggtattaatttcctcattgaatgttattttcagtgaagggagaaagtagactgctaaaaaatggaaaggtcaagaagcaagtgtgtaatttggctgtcttgcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaaggtaatggaacacagtcattctggcagttgtttattggttatttttttctagtcatgcagactttcgtgctctcacttaatggaggtgattaaatggtggtaactagaatgaacataaggtaatgctatagagttattcaggaaaatagcctaattacatgactctcttctttactagtaattcacatttgtctggcactttacaattcattttgcaataatgacacaaaagcacagagagattaaggagctttcctgaagtcctcaaacttgattatctatttttttctgttctgcctacacaacttctaccccgttgccaccctcagctccaccattttgcaccatcttcttttttggagacagggtctcactctgtcacccaggctggagcgcagtggcacaatcagcctggctaacatggtgaaaccccgtttctactaaaaatacaaaaaattagccaggcgaggtggcacgtgcctgtagtcccagcttctccggaggctgaggcaggagaattgcttgaacccggaaggcggaggttgcagtgagctgagattgtgccattgcactccagcctgggcgaaagagtgagactctgtctcaaaaaaaaaaaaaaaaaaagaaagaaagaaaaaaaaagagagaaaatgtaagattgcaaccgggtgtgttggaccatgcctgtaatcccagcactttgggaggccgagacaggtggatcacttgaggccaggagttggagaccaccctggctaacatggcggaaccccgtctctacaaacaatagaaaagttacctgggcgtggtggcatgtgcctgtagtcccagctagtcaggaggctgaggcaggagaatcgcttgaacctgggaggcagaggttgcagcgagccgagatcatggaggcagaggttgcagtgagccgagatcacgccactgcactccagcctggtcaatagtgcgagactctctcaaaagaaagaaaagaaaaagaaaatataaggatgaattatatttctgttaaaataggattgagccttcaagagttaattgattaattttacttaaatacaaataccaccgtgtttctagactactttaatcaaaaggttaagtaaaagattcccaaattgtaaacatctttcccccaaatccctgactttttttttttttttttttgagacggagtctcgctctgttgcccaggctggagtgcagtggtgcgatcttagctcactgcaagctccacctcccgggttcacgccattctcctgcctcagcctcccaagtagctgggactacaggcgcccgccaccacgcccggctaattttttgaatttttagtagagatggggtttcagcgtgttagccaggatggtcttgatctcctgacctcgtgatccgcccgcctcggcctcccaaagtgctgggattacaggcgtgagccactgcacccagacccaaatccttgactttagaagtgttaaataagaacaacttatacaaacatatgacataatgtgaagcttgcattaagcttaaaggccataacctcatttggtatttgaaatgtgaagaataacagagaaaagaataaattgtagtattatgttattatatctgttatatatttatcttttttagtagattatgagtatcttgaaactaggaactatgtcatagtagtttttgcacctctattacttaacagtgtcaaaagactgaatgaacttggcatgaccattattgtgtcatataataactgtgggatttttttttttttcttctagccttggctgctttactccgagatggtgagactttggaggaacttatgaaattgtctccagaagagcttctgcttagatgggcaaactttcatttggaaaactcgggctggcaaaaaattaacaactttagtgctgacatcaaggtaactgttgaaagaatcacaacattttggggggatataatagctggaagatttcatcccagcttaacagagagaaaatcctaacactgtatcaccaagccttgttgtctcttggccctgaaggtagattttagaagagtaatagagccagataaggtacattagcacctatgttttattttgtgggaaaaggtaaaaatattatgctaatttatcatattataatgctaatttgttatatcctgcctattggtaaacatggagtattaaagaataggacatgactattctattcttaactgcctttcccaagcctcagtgtacctgttagtaaacacacctagaagagataggaagggcctcatgatttcctcttcaccttttttatttggcttctctcctgtcattttatcctacctttagttgtgagttcctcgaggatagcaatgagctcttatttatgtctgtgtatcctacctcagcccctgctccagggccctcctactaaagccaacttaaaacatagtatgtggcatatacaagaccctcatatttcttgcattgaattgaatttttttttcactcactgtttatcatgagcagtgggggaaaactaacaatggaggaagacatttattacatgttgcctttggcttctcatgcagagggccaacattaccatagcaaacattgtgtggagttctccttaactgcctcaattctgtgtgacatccagatgttggtacacagggaataaacttaaggatcttcatcagatgtcactgaccagcaaggctgtgaaaacaatactatgtgatgatatgattttgttcagtgatgagaggaagcagtgagttgcctgtactactgatttcatccatgaaaattaagagtagccccaaaattataagaccaactgaccctgccctctcttttaattacacaatatgtttggccaggtttgttgttgttgctgttgttgttgtgacagggtctcacttcgtcacccaggctggagtgcagtgctgctaacatggctcactgcagcctttacctcccaagctcaagcaatcttcccacttcagcctcccaagtagctgggactacaggtgcacaccaccaagcccgattgatttttttttctttttctgagatggagtctccctctgtcactcaggctggagtgcagtggcactatctcggctcactgcaacctccgcctcccaggttcaagagattcttctgcctcagcctcctgagtagctggaattacaggcatccaccaccacgcctggttaatttttgtatttttaggagagacagggtttcaccatcttggtcagactggtctcaaactcctgacctcatgatctgcccacctcggcttcccaaagtgctgggattacaggcatgagccactgtgcccggcctgatttttttattatttgtagagatggggtctcactgtgttgcccaggctggactcaagctcctgggctcaagtgatcctcccacctcggcctcctaaaatgctgggattacaggcatgagccatggtacctggccagccaggtatattttgcttcatgcactagatgcgttcctgaaaatcagcaagccaaccataaatggattttatgtagtgggatatattttaaatgtaaagagaaaatcttatttttgtaaatgaagcctgctttgaatttttttattttttattttttaaattattttttgtttatttttttttttgagatggagtcttgctctgtcgcccaggctggagtgcagtggcgccatctcggctcactgcaagctccacctcccaggttcacgccattctcctgcctcagcctcctgagtagctaggactacaggcacccgccaccatgcctggctaattttttttgtatttttagtagacatggggtttcaccgtgttagccaggatggtctcgatctcctgacctcgtgatctgcctacctcggcctcccaaagtgctgggattacaggcatgagtcaccgcccccggccatcaatatttttaaaaaggaaataattgtttggtaatgtgaaaactaacttccagtttatctgtattcaagttcaaattttcacctgtaaagcccttttcagggtagtaaatacagattttgctgggtctgctctttacttgttcttctcaagagcataggtttattataaattgtttgtgtagctttagcaagtaattggaagtgaaagcactttcgcaattgtagtacactattccttaagaggtaaatgctatgcccccaaatgatagaatcggagttggcattttatgaattgctctgaaatagctttcaattacctgattttccccattcttagaatcatttatggcaccaagtttcaaactcacctgggtaactggtttaaaaggcacctttctgggcagctcccagacatttatatttggtagctcaggaattggattcagtaattcacatattgagtaacttcctcaggggttagtatgcacatagactatgagaaacactccttcatagcctgtctggaccttcaaagcccagtaacaggaaactattaatatcgtagctggaaggtggtcttcacatatggcaggattaaggaatcttgactcaaattccggtcctctagcattccaaagatgcaggaatttacttgacacgtgtgtaaaggttcttaataagcgtttgtgcaagtacaatagttttcaagctgtgttttgtggagttgtccacacaacctgaattcatgttgactgtgagccaaccccattgttttatgtattgggattctaagaaaacaacattcaagtgatttagtccaggggtttaaaacgaaaagagacctttgttttgttaagtacattcagatcatagagggttcagtgttattttagcaactaaaatgtttaccatttaatgcttttgtcatttaaatttacaattaaatacatctttaacatagctaatctcttcttcgtaggttgtggtatatgcattgtgctttgtaatgatataacctgtttattttctctttcttctatgcttcctggatttctgctctcctacttttttaaatgcttgttttgtctgtcaagcttattgacttcagtaattcagtgaaggtacagaactggttatatgtttattagcattattgtattgatgactttaataattgcgaagtcatgtcaaaatccagttcatccatatgcaagacagatataaggcagatagatggacttttctggggaaaacacctgttaaattaaaaggcagagatttgtgccatttattctcaaaaaatccaatgcaaatagccttccaaacatgggacaataggatacattcattccttgtaactgtgatctcactgacattttcaattctttgtaggattccaaagcctatttccatcttctcaatcaaatcgcaccaaaaggacaaaaggaaggtgaaccacggatagatattaacatgtcaggtttcaatgtaagtataagtgctcttttgaattctacaatcttgcaaaattattgtcaatttcttataagtacaataatttttataatcgtatgaagtagagttggcaattttaagcattattttaaaatgtattactgtacatgtaattcagaggccagaaaactagctttgatttattttgattgttagtgaattccatcgttgttgtggtattgatttatatggatggcataaaatattcaaaacaagtatggggaaataagtaactagaagctaaccttttccaagtatttggattacaaccacagtaatagatttagtgactatatgaaaaccttttccaagtatttggattataaccacagtaatagatttagtgactatatattcatattcctgtgttgagagtaatgtgattatgttttacaaactcccaatctatgaaatctaatttagggaattactctcagagaccatgttccctggttatgtcactaatttgtttagtgacattggacaagttccttctcaaaattggatttcactttgttcatccataaagtaaggagttagagtgaactatttagtcccaagtttctaggaatctgtggtttttgtacccattagatatggaatgcatgctactaattaacaaaatccacatatctagcctattatgccataggatggagtggattacattggctaaaccatttttcttctctttcttttttttttttttttttttgagacagagtctcactctgttgctgaggctggagtgcagtggcaccgtgtcggctcactgcaacctccatctcctgggttcaagcaattctcctgcctcagcctcccgagtagctgcgattacaggcgcccaccaccatgcccagctagttttatatttttagtagagatggggtttcaccatgttggccaggctggtcttgaactcctgacctcaggtgatccactcgcctcggcctcccaaagtgctgggattacaggtgtgagccaccgtgccttacgtggctaaaccatttttatgctgcccttatcagaactgaatttgtaactgacttgtgtgcttatatttctgtctgtatgttaaatgcaaaactcttcagctcaggtcactcttggtagggatgaggggccatcttgtccaagaagggagctgtctgggttggctagccatgtgatctgataccagggtaaatggcatcagtatgctaaccgattctgatacaccccttctctagtcaatcctttccaattgatcttaaaacactcttttgtctcttccctcttcagaatccgacaaggattcttctgttgactctagaattcagtctgaaatgttctgcttggcactcaccctacaaatcttgctctaaaatctagccagtgttatttccccaaaagtctgtgttccccaccccaaccttccttcccaccaccacccaggtgcctttgctcatgctgttctcatggttttcagtgtccttcatctttttcagctttacaccttctttagggtcttttttttttttttttttttttaagagacgaggtttcgccatgttggccaggctggtttcgaactcctgggctcaagcaatccttctgcctcggcctcccaaagtgctgggattacaggcgtgagccaccacgtccaaccaaggcctaattttaactctgaacagttttacctgttttttatttcaatttaacttttttctcttcgtctttgtaatggaaaaaatcccttcctttcgtcctaacttttttaatccttcaattccctgagattaatccttggtcttgccttccaccattctccctacgctcaaaagaaatcagtggaaatagattctctgcttctcttcaattcaagcaacagttcacaagcatttcccttgggatttgagcatgacatgaatgaaggtgtctgtcttctccctcagccagggaagcctacttccacagctcagcacaacttcctctctctctagctcgctctccagcagtgccctcctttctagttccttctgctgcataacacagccccagaggttccagggttccaaggagtccactctgtcatgaagctcattgacttaatgcacagtacccagaagcctcagtgaagttcagctgagagccagtagaaaaaaggagaaactccaaagcagaaagtagtaaatcagcaaaataaaataaaataagccaggttgaagagaatgaacccacaatttacagaaaatgaacaccattttctaaaggagacttaagtaggactacagttaataccctttcacatttaataattaattgagattcattgtagataaagtacatttgaaaaaaaattttaacataattctactgaaaatatctgaatatttaacttgaggtggcttaaaaggacaattgaagctgttttcctattgagaaggaaaaaaggaaaagtggaaccagagaaagtgaagatggtgaatgtatatttttctctacagattttcaaacaaaatctgggagtttcccccaaccttttacgtaacttctttcttaatgcaatttagttaaatgtactcagtagtttgctgtgtgatctggcgccatctagtgtatattacaggtactgcatctccaagagggccaacctttttttttgcattcaaaacaattttataataagtaccatatgttagctaaaagaaagtagaactgtatacccagactatgacagtggggaaattttctatatttttagtgtggcctttgacaaagtcttccgattttgtttcaacaggaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggtaactaaaaacctcaatttcgaatgtgtgggactatagagtagaaatacataggccacaatgattttacaatctagacttaataagtttttttatatctacaagaagtagatggcagatgctgagtaaaaactggcaggaaagtacgatacaagtgaacttttaaagtaaagtagtcgaggccgggcacggtggctcacagctgtaatcccagcactttgggaggccgacatgggcggatcacctgaggtcagtagtttgagaccagcctgaccaacatggtgaaaccccgtctctacgaaaaattaaaaaattagctggggcgtggtggcacatgcctgtaatcccagctactcgggaggctgaggcaggagaatcacttgaatctgggagacggaggttacagtgagccgagatcgcgctattgcactccagcctgggcaacagagtaagactccatctcaaaaaataaataaaaaaaataaaaagtagtcgagtcgcttaatgtaaagccacttagtaaatcagtatttagttttaatatttagggttagaccactttttaatcctctcatcaggaaaaagtgcacatatgcattcagtttgacctgtaaatttagcatatatttatgtttcattcatccacagtcaatgtaactggaactaaccccaactcctttcacctttacctcctcaagaaacaaatgataatatatactaatttttttttaagttttggaaaggcagagtttaccttttccagattatatatgtgtgaagcgtagtctataaaaattaagaaatgcagccaggcgcggtggctcacgactgtaatcccagcactttgggaggccaaggtggccagatcacctaaggtcaggagttcgagaccagcctggctaacatggtgaaaccccgtttccactaaaaatacaaaaaattaggcaggcattgtggtgcgcacctgtaatccagatactcgggaggctgaagcaggagaatcccttgaacctgggaggcagaggttgtagtgagctgagatcgtgccattgcactccagcttaggcaacaagagcaaacctccatctcaaaaataaataaataaataaataaataaataaataaataaataatgcaaatagtaattcattgagtgtccactgatatttctataaaaccagtaacttaactgataacatcagttactttgagggatgcagattcgaggaaatattggagaaagatttgagaaggagactataaaaagttcataaacctctaaattgcttaactggttagaataaggttgtattctttaattttaaaataaattcaaattttaaaaataagcctgtacctagagagaatgtatgtacttagaagaatgcttggaaactcgtattatcgaaaaattctagatctgaatagagagataaaataatctaatatgtgtattggcactatatgcacatacataaagtgtttaatgaatcagtaaattttgtgaatattcttaacaggagaaactcgtgaagaaagaaccttccgtaactggatgaactctcttggtgtcaatcctcacgtaaaccatctctatgcgtaagccttcctactgctattgtaaacagttacgaatgtcatgaatggatgttaaataatgacagctctaaagattttctagatattaatttgtagctattatttatattggaaaatgtcaagtggtgatttccatcatcattttccaaatacacaaaagctttaagtattcctttacatgatcgttaactgtaagtgatagaatatataaatgtctttatagtaccctagggagcaaatactttatattttgaaacagctgtttgggaggttgaggtgggggcattgcttgagcccaggagtttgaggcttcagtgagctatggttgtgccactgtactccagcctgggcaacaaagtgagatcctatctctaagagggaaaaaaaaagaaaggtaaaaaagaaagaaacagagaccagggaatcctttaagtagaccatccacaacaactcagggactttggttcattgttctctcagcctggaacgttctttgctcgcatatagtggctcgtatccttactgtattccagtcactgattcaaagatttcctgactaccacctgctactctctaacccctaaccctagttcctttttttcttaatagcacttacatacacccctaaaattgtttgtttattgtcaacaaaccaataccccccgtattgtttgtttatccatgtacttgtttattgtctatctctctgactctaatgcaaggacagggatttttgtcctgtgggcccagcctctagaacagtgccttgcttacagtaagctctcaataaatacttataaatgaatgggatggtcttagctctgttttcagcacagattgatagaaaatatgagtcttgggtattatttatggttttatatatcttgtttgacaatgtagtgttactgtttttaaggaaagtcaagtcccagcttcctgaaaacactgattacattatttttaaatcattagtgacctgcaagatgccctggtaatcttacagttatatgaacgaattaaagttcctgttgactggagtaaggttaataaacctccatacccgaaactgggagccaacatgaaaaaggtagataattaagttgctgtatatatttgttagagtatttttattctcgattaatttcttttgtttctaaaactcttgacgctgagcttcttgaggacaaaactgtgtcttatttgtttttgtgtgctgatacctagcattatacaagacacacacacacgtatgcagattaaacaaatggaagtctttaaccatttactcttgtgcctttgcagctagaaaactgcaactatgctgttgaattagggaagcatcctgctaaattctccctggttggcattggagggcaagacctgaatgatgggaaccaaaccctgactttagctttagtctggcagctgatgagaaggtatagtacacaattttagctgtttagtctttactatcatacaggtctgtgatttagtccttactgtgtttaataagtggatatgtcgataactacacttttgaaatatgttatatttacactccgaaatgagtttaattaatgaatatatgttggatgttaagtgggagatgcttccttgcaagttaggcagcagaactatggttagtcccttttttaaaaaataggaagcctgacacacagatttcggcctcgtttagtgtcagtgaattaaaaaattgtcagaacaaaattatgaacatcttcatgctcatttgaaaataaagatctctctctgtaatgctgatgaagatcactataatgctgaaaagcattcattatgactgggcaccagccaaagcacagcttattttatgccattaccgctattggaatagtacaaaatgtgcctacagtgggctgttggacctgctcattaaagcactgtcaatctgctcctctctcaccactacaaagagtagatcagtagcaagccactactgcttgaaatatttttttcacatagtgtgaatctctttccatgaaatctttagtccttgaaatttaaggaatataggggccaggagtggtggctcacgcctgtaataccagcactttgggaggccaaggagggtggatcacgaggtcaggagatcaagaccatcctggctacacggtgaaaccctgtccctactaaaaatataaaaaattagctgggcgtggtggtgggcacctgtagtcccagctactcaggaagctgaggcaggagaatggtgtgaacccgggaggcggagcttgcagtgagcaggagattgcgccactgcactccagcctgggcgacagagcgagactccgtctcaaaaaaaagaagaaaaatttaagaaatataaaaagtggaagataaagcatctttctgatgtttgcatttttcctcataaagtagatggtgacgttttcttctgctgcctctcttagatataccctcaatgtcctggaagatcttggagatggtcagaaagccaatgacgacatcattgtgaactgggtgaacagaacgttgagtgaagctggaaaatcaacttccattcagagttttaaggtcagaatccatatttgactattaaatattatgtttgctggataacatctatcatttgggaaggcaacttttggcttctttgtgagtgagaattagtgttgggctaatggcacaattctttacgaattcactgggctttgtttttggcacttgatataagtaagcacatgttaatttgtatgtatcaaaattctcagatttgttctcctttcacactaggacaagacgatcagctccagtttggcagttgtggatttaattgatgccatccagccaggctgtataaactatgaccttgtgaagagtggcaatctaacagaagatgacaagcacaataatgccaagtaagggagactgctaatagtatgaaaagaacgcagctttgtagctggacagatctgaattctaattcaggttctgccatttaagagtggtgtcaccttgggagaaacctcttggagcctcagattcctcatcaataaactgggggcaataatacttaccttagattttataaagattaaatttttaaaaattataagagcctagccttgtgcttggcctactaggtgcttagtcggttgttgcttcagtggattacagaaataatgtagcatgtattttaatgcaaatcaggtaaaactttacaaggaaaataagagcttagggtgttcatctgtctgtctcattctttttttaaaaaacgcattatccacttatgtctcttttactatacatagatcattcttactacatttattgaatttatcttcatcagttcccatattaacagaatgcttgctagccctccacagaagactatgccttgaaagtttcttgcatttcaacaatattcagaaggtcttttccaccagcctattttcttcttcaccaaaggcctagagtgtgacctggcttcatgggtgacccatgaaaaccttactagttagacattgaaaatccatccacagtcctgcattaccgaacagctaagaagcattcctgcaaaactttggagttaggcacattatttcttttttccttgaaaaatatttctagcagatatgacaaaggtctaatatccacaatatatcaagaactcttgaaatctctttttctagaaactcgatgatttaattatctttaaagattctggttccaacacacctagaaatacttcacggattagttgagatgtgttcctgaaaatttccctacctggacatctcagttcttctgtcccttcgtctaccttttctagtttttggtccagccactctgtccacgtaccacgtagactgtctcccctctcatgaatacttggaagtattcattgcatctgcctaacaacttgggttttgcatctagcatgattttccacctcatatctctaagatgacttgagtgtgtgttattatgtgtgcaatgagaatattaacatggattgtatagacagcctaggtaattatatatataaagttggtgcttcaagcttaattctcacctcacattggagaaaaagagtgaataaatattattagccccaaataatagagcttaaaaacctactgtaacttcaaagtgaaatcaaaacccaaatcaaaagaaaacaaaaagcaaaactgttctaattggaactatcaatatggaatttttgcatcccagcataataattatatatgaggaaatagatgtcttacgtggtgtccttaactgacaagaatttcatcctgattttgtttccccctaaaataggtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcag

SEQ ID NO: 4941 - DNA, 68727 bp, human
cagctgcaaagattccgaggtgcagaagttgtctgagtgcgttggtcggcggcagtcgggccagacccaggactctgcgactttacgtaagtgctttgtaggcgccggcgggcactaggggagcgggtttcctgggcgtgggcaggagtgggtcccggggagagcatctcggttaagctcagcaggaacgtgcggcgcaccgtggggcgggggttgggggagagggaggtcggagaaatttcagttggagccctcgggcgcccgggcgatcggtcgcaaccgaaatgggtgtgagtgacggggagtttccctactagcatccgccgcagacacgttttctgcacttcactgtattaagtggtgttttcttactagttgctcttaacttgttgccagtcttgggctggagtcctagacgccagcccttgccctgattcccctccgcggctgcggccccgaagtggaaagggagcgcacaacttccctctgtcgtccttctccagctactgccatcccctcttccctcccgcccggactcaggaaatcccggagccagcagcctgctactcctccagcccccacacgcccgcctcgggtgacctggctggcttaagccgaccctggggctctggagagggggggccgtggccgagggaaggcacgaggtttgggttgcctgccttctgcctgcttccctcccttgtccttagcgagggcgtcgcgaacgcacctagtctccctatgagtaagcactttttttcctttcagtaggagaacatctctgggctagtaggacagtacctttccgttctcccctggccccacaccccctgtccttttttcagctcctttgactttgcggccccgggcgcgcggtcggggcggcggcagtcccggacctctcccgactcttggagagagagaggcaaaggggcgacgggagggaggtaatagtctacccccccgccctttccccgcacagctgcacttgcctgtgtttacttttctccacccgcagtacttaagcgctgtaatgagaggcccggggacgccgaccacccccgccctggcttctcgccagtcccaaagttgctgccgccgtcgctgctccagtgtgctggcggttccgaccgccgggctccgggacgtaagatgatcccagcccgggaggtggagtgggggttaatggcatctgactctagccttatgcgatgctccttgcctctcacctgagctgcacgatatccccagtggtgcagaaggttgaacttttgcagaaggttgagcttggagctaagtgggttggagagcctcgccatttagcgtcagacagacgggatgctgggggcgcccggcctgttaagagggattgggaggagggaagggagcctggctaacagtaggtagaaaatgtagggaaaagtaaaaaccattgaggggcaagcacttactccactttgctggatgtcacaatggactggggagcctaaacttgatcctcgagatgcagttcatggtgaattccaactaagtggctggagccccacacataccagttggaatcacgtgccccaagtctctgatggtcacatgacgtctttttactttaaagctggaatgtaatggttgaggcccatattccaaaaaccacctctacgtttgaaaaaaaaaaggtggggaggagtgtgaactagcttctaatcaaggaagtctactaggattttggatgaggggaccagaaagggaatttggtgctcagcttttatccaaaacaaaaacaggagctgtttttaaaataagggattgaaatatatgtgagctgggacatgtatctcctctcttcttcaatctcatggtttttctaaatttaaaaaacatcttactaattattttctagggaagtcatcctattactcatgcctcattttgtccctgaatactagatttgaagctaaatcccacaagatagtgttaaaaagtaaggctctgttcatcttccttggtctggcctatattctaattgaactgttccctattttaggcaactacttaaaggtagtaaataacctcttgactaaaattaaccaccagttatttgtggttttcaattaactggattagaaatcatgcacaaaaacagtggatagtaaatttgatacatcgagttggttgggtttttgcctgtcagtggtttggtagaataatgagaggacactgaaacaactttcccatattgacctatacccgcccaagtggcccaagttaaggttgcttctgggaaaacgtggcaatttggctattcagattatatattacagagtatagaagagaggcagaggagcctctgaggtcaggagtttaaaagctttgcttatctgaaaaaaaaagaaaaaacggacctggttgatgcatattcagtcttgaaaacaactagggcagaagatatttaagagattctgactttgtattcttttgccaaaaaccctttgtctcctgcagcagcctctgaatgaccggagcactccagtttcttgctgttcatccgtttctgagcctgaaaactagaacaaccttaaagcacattgttctgaccccaaggctagccttgtggcacagatgagctggaaatggatttaaggtgcacctgagttactagagttaactacactggtagatagacccctctagtggaagtgaggtgataatataattttagatcgaaataataaatgtttaacctcaaaaaaaggaagttattaccactcaactaggttacagtggtagggggataagttcttttttaagtattgtgaaatcatgtctaaacagaatcatcgctaggctctagtccacagcttttcattgtcttgggatgcctactcattgaacaccacccccaatattgctgactttttttggtggtatgatctaatgagcccaaatttttattgaaattagggggctgggagtcaaattcttgatttttactgttagatctagcagatagcaacccctttacctgaggtggggagctattaataaataaataacactttgccttgacttaatacagacgatcaacattgaagtccaaagtctctagtctgatgtaaccatttagattcaattgataaaaatgactaggcttatggcattttgggtagaaggattaattataactagtgagtaataatttgggtgagattaagcctcttccacaagtggttacacgcacattagactttgactgtgactgtttatactggcagaatgtcagtatctagggcactatcagaaacccaatgagatttttctcccaggagaacagaattctgttactgaaaataaaagggcagcttggccatggtgcttgagcaccaaagtggttctttttggtgacactgagagggtacaagaagaaagtccatttgccattatcccatattctgttttaggcattatttctacttggattttcatgaaatgtactgacagtgttcttagcacatatgataaattcatgagtttgctgttgtgtttgatctagcataatctatgtggaatgtataagctgaactgtttcttttttgatgtttggtacagattatgaaagtagctggtataaaataaaatttgaaaatgaatatctctcaatacatgacaacaatggggtatctgtttttagaatcatgttgtctttggtcatatggcaatttttcttttggtgaagagtgatccagaaggcaaaatttttgatctgtgaaaataatacaactcatttagaagaagtcagctgggtcatgttttgagtctgtattattttagacagtgatataccatataatgtatattcagtgtgttggaggtttcaaagctttttggatacattacaatgttggaagatttttatataccagtggtcatgactagctgattttagttatgagagcgctttggttaaagttatggaaacagtctaatcgtgaaatgtcagtcttagaagatctgatcatacttgggccaatttattttagttacggaggtgagacaatttcagaagattcacgataaatttaataataccaaattttgccttagtcttgacacttggaagataaatattagtgagtataaactgttttagggatgaagaagtattgttagtatacaaaaatgaaaatactaattattttagcatgggtcttttagtcctttgcagtctggacagatagattatcttaagtaaatcattgaacttgccctcagaggaattagattctagatagtgctctgccattgactcataatttgaccttcggaaagtcatttaaaattattatattaataactaattgagtacatacatgtgccagacaccattcatgcttttgtttataaaaagagaggattgctcaagctttttggtttgctgggttttattttttcaaatattcataatctggcttatttcacttatcagttgacttttcaaactttgatgcaattgcattgatccaagctaaatactttgttggcaaattgatgactattcaggaaagtgatcaccagtgggttattccatgactaatgttagttctttaaaataaagaggtgccatttatttaattccttgacagggatttttggtgcattaagcctactgattttataatatgagaaaccttacattttcttaaaagtttagaaacgtatttgataataaggaggtagtgttgtttattggaaaagcattgagcatagaatttagggtcttttagtcctttgcagtctggacagatagatgatcttaagtaactcattgaaattttctgtggtcatatctgggtttcactttatttttaagccatgtgattccaatctacatatttcacaggcatggtaaaaggataagtgagaaacgtgaagccttggcttttaagcagacaggtgctatataaattcaaagtactgcagcagtgtatcatagaaacactaaagctttaacaagagtttacagaaatggcagggttctcatcacgtaagtcttgccacatttttctttgtctgtaaaagttctgcacccatccaatttttacaagcaaaggaaaaataaagccagacatattataatgaaaaataagagactaggttgataacaatagaataaaaacctacatgtgatactttcttcttcttttgttttgttctgttttgttttgttttaaagacggagtcttgctttgtcgcccaggctggagtggtgcagcggcgtgatctcggctcactgcaagctcctcctcccgggttcaggccattctcctgcctcagcctcccgagtagctgggactacaggcgcccgccactgtgcccagctagtttttttgtatttttagtagagacggggtttcaccgtggtctcgatctcctgacctcgtgatccgcccgcctcggcctcccaaagtgctgggattacaggcgtgagccaccgcgcccggcccgttttgttttgttttgttttgagatggagtctcgctctgtcgcccaggctggaatgcaatggcgtgatctcggcccactgcaacctctgcctccgggttcaagtgattctcgtgcctcagcctcctgggtagctgggattacaggcgcgtaccaccacgcctggctaatttttgtatttttagtagaaatggggtttcaccatgttggtcaggctggtctagaattcctgaccttgtgatccgcccgccttggcctcccagagtgctgggattacaggcatgagccaccgcgcccagcccatgtgatactttcttctatttcttacctcaaatattgtgcaaggtagcccgttaaagccattaattgggtggtgtttttcccctttttaactaactactgagtagaattttggtcttcagtggtaattgttacagagtccattggcttaccatacctcatttttagttttgtgattgcccataatgggaggtttcgtgtaaaaaacctcataaaaaatcaagtttttcctcctcataattgcagtctaaaggaggacaacacgcaggtctgggaaactgcatagtggaagagataatctatacatttaagtagcatgccatgaataacacaaaaaatggcctggcacggtggctcacatctgtcatcccaacactttgggaggccgaggtgggtggatcacttcaggccaggagaccagcctagccaacatggtgaaaccccgtctctactaaaatacaaaaacttagccaagcacggtggcacgggcttgtagtcccagctacccaagaggctgaggtgggaggattgcttgagcctgggaggcggaggttacagtgagccgagattgcgccattgcactccaagcctgggctaccgagtgagaccccatctcaaaagaaaaacagaaaaacaaacaaacaaacaaaaaaaaacagaaaatgtgggaagttaagttgaaaaataaacaccttcaaagctattaacttggattttcttttcttttcttcttcttttttttttttttttttttgagtcaggttctcactctgtcgcccattcatactctgtccagttcattgaaaatacaagtctgattcccttgagttgtgatattcatacacacacgagtatatatacacttatgtgtgcatatgtatattatataaagttttacgtgatatataatataagtttttactttctgtaaaataaaatttgttagggccgtataatagttttgaatattcatattattgtgttccacattataagctctaattacatcgtgttgcactcagattgacattctgctgttgacactgaaaataacgctttcattcatagatgaatgtaattttcaagctttttttctatatttcttaacttgcttgaatgttcccatttttgccatttcttgttgttcattttaacattttggggcttgtgtttcagatcaggaagaatcaccattatagggtgcaaagagtttgctcagaggtgaaaatgatacgaaattgtccctagagcacatcctattgctatactattcaacatgtatgaattaatctactgggaaagtgtcttgtgtagtgtgtactttaaagatgttttcaatcactttgctttggattagaaaaattcaaggtaactataattttaaatgctcatatttttatgtttattttatatgtaggaagagaaatttttaaaaattggaataacactatatcccattcttttcatttattacattataaacatgtttccaagtgatcaaatatttttaaaaatgtttaaaatcactgcagtatattttatataatggctgtttcataatttatttcactaattccaagttgttgaacatttgtttccatatcttatagataatgcttcagtaagcattcttgatcgaacatcattttgcactctatcattttttagaagtcaccaagaatgttttaaagatgaattcctttgatagtccctgaaatttaaacattggcttaaacaaaaagatagccttgatttcagtggcatttaaaaaaagaaggctgggcatggtggctcaggcctgtaatcccaatactttggaaggccaaggcaggcagatcacttgaggtcaggagttcaagaccagcctggccaacatggcaaaactccgtctctactaaaaatacaaaaaaactagctgagcatggtggcgcacgcctgtaatcccagctacttgggaggctaaggcaggagaatcgcttgaacccaggaggtgaaggttgcagtgagccaagattgcaccactgcactccagcccgggcaacagagcaagactccgtttcaaaaaaaaaaaaagaagaagaaaaaagaaaaggccattctttatatagtgtattgtatcatatgtgactctaaactggaacttgtttaggtaaagtatatgtcttggaagtattttggttttctctgatctagttagcaggtgcagagcaggatgaggtaggattctgtgctgtgtacaatcataggaagttctgttttttgaaacggaactgttaatgggggaagggagacacgtttgtttttaagaagcctttatgtttaatattattataaaactcagttcaagtatacaaagcttatttgtgcctatgaacattcagtatcctaaagaaacatttaatcctggtgttggctaaatgactatttgctgatatgcccttttatctcaaggctattagtttcttaaagtactttgatatcactcaataaactacagttaaactcagagttttacatttcattcaggttgcttaaataatataactaaacataggtccaataatagtaaaaattctgatgctgtcacttaatttgtgcctggtttcagtatatggcgattgcttaaattacaagcacttgaatttacaaatattttgtgtatttaaatggctcattgtacattacatatccctcctgaaacttaacccatgccatttcacagacccttccatggtgtttttctctttcctccagttcactagcctcactcaccaaagactttattggtctgggaattctattatgacccagaagtgacttggaaggttcctttcacccaacaacacattctcactacctttcttttcttttcaggggcatcatttacatgctatgttgcacagtcagaatggattttagcataaagtatgggttccaatagctctcgcattttattatttatttatttgtttagagacagagcctcactttgtcgcccaggctggagtacagtggcacaatctcggctcactgcaacctccatcccccaggttcaagcgattctcctgcctcagccttgtgagtagctgggattataggctcctgccactgtgcccggctaatttttgtatttttagtagagatggggtttcaccgtcttggccaggctggtcttgaactcttgacctcgtgatccacctgcgttggcctcccaaagtgctgggattacaggcatgagccaccgcgcctgggccagctctcccattttatatctctgtggcattgaggaggtttcttaactctctgaacttcagttaccccatgaataaaatgaagataatccactcacttttcactttgttctcataattattatatgagaacacttataaagcaactagcatatggtaggtgctcaataagtattttcatttacaggttgattaatgttgccttagatgatttttgtcaggcatctatatctacctctttttctctaatttgagtaccttcctaccttcctttttttttttttttttttggacagagtcttgctttgtcgcccaggctggagtgcaactgtgcgatctcagctcactgcaaccttgacttcccggggctcaagcgatctccgtgcctcagcctcccgagtagctgggattacaggcgtgtactaccatgcctggctaacttttttttgtagtttgttttttagtagagatgggatttccccatgttgcccaggctggcaagattttagaaattagtggggttttttgtgttttatttaatggtattggaaaaacactccttttattgtttttcattgtgaatgtgaaggattctagccatgtttcaggttgaagaagcttcttcgcttagctcagaaacctgtttatcgtttaatttattctttttttttttttttttttgaaacggagtctcactgtgtcgtccaggctggagtgcagtggcgcgatctcagctcactgcaacctccgcctccgggttcatgcgattctcctgcctcagcctcccgagtagcagggactacaggtgcccaccaccatgccctgctaattttttgtatttttagtagagacggggtttcactgtgttagccaggatggtcttgatctcctaacctcatgaccacccacctcggcctcccaaagtgttgggattacaggcgtgagccactgaaccctgccatttaatttattcttttgtgaggatatgtggagaactagccaagacccgtcacagtggtttacgcgtgtaatcccaacactttgggaggccaaggcgggcaaatcacttcagctcaggagttcgaaaccagcctggccaacatagcaaaactctgtctctactaaatatacaaaaattagccaggcgtgttggcccatgcctatgtacccagctacttggaaggctgaggcacaagaatccctcgagtctgggaggcggaggctgcagtgagccaagatcgtgccacttccctccagcctgggtgacagagcaagactctggaaaaaaaaaaaaagaaaaagaaagagagaaagagaaaaggaaagaggaaaaggaaaaggaaagaaacaagaactcaccttcaaaggaaaattggaaacatggctcagtaaattacagacaccgttataaactcaaggccgctaacaaatacagcttaaatcagaatgaaaggtaataggtagtgttgatacctgacttgtggaggaggaaaaaaaagtaggggcaaagagaaaatatattattgaaaacttaaaatgctgaggatggcagagggttataaagtaaaccaatatgttttcatgatgacatgtagcctttaaaaatggctgaatctaaaacatatttatgatgcccattattttatctagtggaaattttcaaaagcaaaaaccaggaaatgatgaaggctattgacacattcagaaaatattctgagcagtttgtgggtctccattgtaaagctacagttgaatcatttttacaagtgggtatgaataattacaattttatattttgtcctgtggtaattaaaaagcaaatagagccaaattatcattaagcgtaactaacagaaaagtaatattgatagatttacatgtttaaaaatataagccaacccatgcattcagtattttatcctcaaacaaggtgttccagctttagttgacactcagataaaaagcaaactagtggctgggcatggtggctcacatctgtaatctaagcactttgggaggctgaggcaggaggattgcttgagcccaggaattcagaaccaacctgggtaagatatcaagaccctgtctctattttttaaaaaataaaaatagaaaataaattttaaaaaagcaaactagaatatatctagtaggtgctagcagaaggggaaaaattctctaagcagagatttgtgtaaaaatgaagggaaggttaataagtatctagaaactgtaagtgttgtataaaagaaggcttatagaccattggtaaatagatgtaaaactcaaggaaacttttaaacgtgcccaaagttcttaagtatatattaagatggtacaaactacagatgaagtaatagttaaccaaatatactaacatgcacaattgcttaattagtctatttgtggaatggtttcattattcattcaactaccataagtttaatgcagactgttaggtgctagggctacaaagacggataagatactcctccagtctagtagaacagaaagacacaaaaataatcttggttctcatgaaacctaaaaatattcataaatgtagaaaatgaatttagaccgtgcccggtggttcatgccagtaatcccagcaattagggaggccgaggcaagtggatacctgtggtcaggagttcgagaccagcctggccaacatggtgaaaccccgtctctactaaaaatacaaaaattagccgggtgtggtggcaagcgcaagtaatcccagctacttgggaggctgaggtgagagaattgcttggacctgggaggcagaggttgcagtgagccgggattgcgccattgcactccagcctgggtgacaagagtgagactccgtctcaaaaaaaaaaaaaaaaagaaaaaagaaagaaaggaaaaaaaaagaaaatgaatttaaatacagccttttttctcagcataaaataatttctaaatataaaccttgtgtgaacaaagaaattcacttataacccaatataatcaaatctaaactaagaacaaatctcatttaaacattgttatttctttgcaataattattgcataccaaaaaagagcccactatgagttaatgttacttaaatagaacattgctcagcctacaaatgaaggtcagcagacaccagtgtcttggaataaaatagccctttggcaagaaaacgagccacaccccattaagtttttacaaaaataaaattctttccagctttactaaattgtagatgttgcgcccagcatgtacttctgcagtagttgattctgcagctgtggaaatattcatgtatgcagaagtccccaaaaacatctattcaccattacttgcacatgcagctcttatactttctgtagtaaagtattccgttaagttttattttgactcgtggataatagcaagcaactacaggtatagctgacaccttaatttcctgccttgaacttctggccacagactttatttttttattttttgagatggagtatcgctctgttgcccagactggagtgcagtggcataatttcggctcactgcaacctccgcgtcccaggttcaagcaattctcccgcctcagcctcttaagtgcctgggattatggtgcataccaccatgcctggctaatttttgtattttttagtagagatgggttttcactgtgttgaccaggctggtctcgaactcctggcctcaagcgatctgcccacctcgacctcgcaaagtgctgggattacaggcatgagccaccttgcctggcccattgtcacagaattcaaattgagcaggaatacgtaggatttcaaatctaacagttgtttcatttggtgggatagcatcaaagccatgtactgtgaccactgtatatggttttcttcaagagcagcaataaatttctgccatgtaccatgggaaagagctgtacttttagggagaaaggaaataagccctgagaaaaagccccattttcctagttcctttcacagttcacctggcacacaacgggtcttgatatttatatttgaaagagtgaaacatggatggccataaatgctccttgctgataacgattgaattgggaaaatctaatcaggaaatcagtgatttatgaattacattgcataaaatacataatgatgggagcctgtaagaagactaaacaaatggcttccttagtttatttttcctttaggttttagttgttttcagtgaatattatgagtgaatgttatcgatagtgttttcattgtgagaactgctaaactgtagagtcaaagaagaaattgggacatattaatattttgacttttatgccagctttattgagacataatatcatactttttttttttttgagacagagtttcgctcttgttgcccaggctggagtgcaatggcacgatctcggctcaccgtaacctccgcctcccagattcaagcgattctcctgcctcagcctccctagtagctgggattacaggcatgtgccaccacacctggctaattttgtatttttagtagagacagggtttctctatgttggtcaggctggtctcagactcccgacctcaggtaatccgcccacctcggcttcccaaagtactgggattataggcgtgagccaccgcgcccggccccataccatctatttttatagattttagtatattcacagataacatgcaaccttcaccagtcaattttcaaacattttcatcacctcagaaagaaaccccatacactttagctatcaccttccacagcactctacccctgcaaccctaagcaaccactgaactatttcctgtctccattgagttccctgttctggacattacatataaatggagtcatataataggtggtattttgtgactagtttctttcacttagcctaacattttcaaggttcacacaccttgtagcaagtatcagtactctattcctttttatggctggataatatttcattgtacaccatattttgtttatccatttgtccatcgatggatatttggggttgtttctacactatggctatcataaataatgggacatgcaaacattaagtgtctatccatgagtcccctaatgagttagaggtggtgctgacaagataacatttcacttattaccactctgctcttaatataaatccttgctttgattaagcactaccgatttttccatctaagtttttttgttattttttgttccttgagacggagtctggctctgctgcccaggctggagtgcagtggcaccatctcggctcactgcaagctccgcctcccgggttcacgccattctcctgcctcagcctcccaagtagctgggactacaggcgcccgccaccacacctggctaattttttgtatttttagtagagacggggtttcaccgtgttagccaggatggtctcaatctcctgacctcgtgatccacccgcctcggcctcccaaagtactgggattacaggcgtgagccaccgcgcctggcctctatctaagtttagctattttttttcttgtttcctgatgcttattggcttatcatcgacttgttctcaataacgttttccttagtagtatttatactggaataatagaaagcctgtaaatgctgtataatcatcttttctaaaacttattgtataataaacatttagcacagttttgtttaatcacattttttgaacactaaggagcaaaggcaagcagtattaaggagtacaaaagtacatgataaatgctttgaaatgcaatgggttcaatcaaccaaaagcattattgagcacagctaatatatttacttttaaatgtactattcaagtgtgaaatatatccatatagaacaaaattcaaaactcacaaagggccataatgataagtaaattagcctctaacacttaatatttttaagaagacattagtgttttacgtttaggtattttgacagtaagtttgagggagtctttatcttttgaccttttggggtgaatatgagaatgaaggaatataaaaagatgattaaaagaatcaccaggccggaaatgacggctcatgcctgtaatcccagcactttaggaggccgagacaggagaatcacttgagctcaggagtttgacaccagcctgggcaacatagcgagacctcatctctactaaaaataaaacaaaattagccaggcatggtggcgtgcgcctatagtcccagctactcaggaggctgaggtgggagggttgcttgatcccgtgatcacgcctctgtatttcagcttgggtgagagagatcctgtctcaaaaaaataaaataaaataatttcctgcaatttcagattattcttttaagcacccttgaccccagattcaccagatcaaaacagctaatgactcatagaactttactctgtcattattttccagattcaacccacagcgaaatttttgggatccagtctccttactcttatgggcaggcggaaccttgcagatcctttaggaaaggataggcttccctgagaaaggtgggctggagttaagtcaaaaaaaaggtgcaactttctggagtcccatttagaacttcctgcgtatttaataggcctttgctaattattaacaatgtgcctggcacactaacataaataaaacagtgtgccatcgtttgaagagctgagtctaatccacctactgatttttacaaaggaggcaactgaagtctgattttggcttgcctcagcatagagtgctccaggacaatggtggaggatcaggtcgccatcactggagacccagattgtagtaatggaactgatccatcattcttctcactatatatttaaactccatgtccagggtcaactttgtttagtagcagtgcctcttccctgaatcagtttgtatctacacttaatttctttcagagattaataaaatgacaaatgctatctcaataaagttaccatgaactctctgaaactcatatcacccatgactaaagcaacttgctttgagtctgacaagctcttccctagctaatggaaatgcattagcaatagctttacagtggtaagctatttttctaggtcatattcaacccagagtagtcacatgctgacaaaacttcaatcctaaacactgatcataaagagtttcctatattgtatgtaatatatccaaaagtttttgaaaactctaattccagtatattgaatatacattatagggtttatcactcctgatttttttttaattgagacggaatcttgctctgttgcccaggctggagagtagtcccgtgatctcggctcactgcagcctctgcctcccaggttcaagcagttctcgtgcctcagctccccaagtagctgggattacaggcgtgcaccaccacgtctggataatttttgtgttttttgtagagatggggtttcgccatgttggccaggctgatctggaactcctgacctaaactgatcctcccgcctcggcctctaaaagtgctgggattacaggagtaaaccaccatgcctggcccactcctgatttcttctaaactggattttatcattctcagagtcagtgtttcctctctgtattactccttgcctagaaaaaaaaatgtccatttcattcatctattcattgacttattcaagtacttaccgagcaccttatatatgtcagatactattctaggcactggggattacagccgtcaatgaaacagacaaaaatcaccgtctttatgaagcttacatcctactaggggagagatagaaaataaacaatgattttatatattagatgctaatgtgttatggagaaaaagtaagattaatggtataggaagtgggaagaagggtattgccatttcaaaatatgtggtcacagaaggcattactgagagggagatatttcaggcaagatatgaaggaaatcaaggagtatccatgtgaatgtttggggagaagtgtcacttgaacaagtaaaaaatatttctaataacagatacctaaatcatcatacattgatgtgtttcagccctgaaattttcctttatgacaactcctttttattttggtattgaacagaaaaaaataactttcacccagatcaaacactctagtggagtcatgaactgactatatatgctaagaatattgtgtcagaagttatgtcaaaaaagttttgaaaagataaagctaggcgtggtggctcacgcctgtaatcccagcactttgggaggctgaggcaggcggatcacgaggttaggagatcgagaccatcctggctaacacggtgaaacctcgtccctactaaaaatacaaaaaattagactggcgtggtggcgggcgcctgtagtcccagctactcgggaggctgaggcagaagaatggcgtgaacccgggagacggagcttgcagtgagccgagatcacgccactgcacaaaaaaaaaaaaaaaaaaaaaaagataaagtgggaataatgtttaaagcaggatatagaattaatacaagtaaatgttcttcattttccctattaatttaattatactatattctgtgtttaattctgaattagattttttaattaaactttttattttgagataattgtagattcacacctacttgtaagaaatggcacaaagagatcctgtgtacctttacccagtttcttccaatggtaaactcttaaaaaaccatagtacaatagcaaaaccacaatgttgacactgatacagacaagaggcaaatgagtttcattaccagtagaatcccttttattgtcctttgataacaacacacacctccttcctcccctgacctccatttttgaccccaggaaaccactaatctgttctccatgtctataattttgtcatttaaaaatattatataaatggaatgatatatagtatgtagcctttgggaattagctttttttctctgagcgtaattctcttagagattcaacctaagttgttgtgtatgtcaatacctcgttccttttcattgttgaatagtattccatggtgtgtatgtaacaaagtttatttaaccattcacccattgaaggatatctgggccatttccagttttttagttatcacaagtatttgtatacaggtgttagtgtgaacttcagttttcgtttctctgggattaatgccggaagagtgcaaatgctgagttgtatgagagttgcatgtttaattttataagaaattgccaaagtgtttgcccagagtgactgtaccattgtgtgcttccaccagcaatgtatgagtgatccagtttttccacatccttgccagcctttggtggtgtcactgtttttcattttagccattctgataggtgtgtagtgatagctcattgtagttgcattttcagtttcataataactaatgatgtttaacattttttatgcacttatttcccatctgtttgccctcttcagtgaaatgtctgttcatgtcttttacctattttctttcatttttgagacagggtcttgctctgttgcccgggctggagtgcagtggcgcaatcacggctcgctgcagcgtcaacatcctgggctcaagtgattctcctgcctaagcctcccaagtagctgggactacaggtgcacaccaccattttattttttgtagagttggggtcttgttatattgcccaggctgatgtgaaacgtctggcctcaagcagtactccgcccttggcctcctactgtgctgggattacagacatgagccaccatgcctggcccttttgtctgttttctaattggattatttgtgtttttactgttgtggaattttaagaggtctttatgtattctagagtctaattctttatcagatatgtggcatacaaatattttctcctcgcctgtagcttatcttttcatcttctgaacagaatctttcatagaacaaaaggatttatttggtgaggcccactttatcagtatttccttttatggattgatttttggtgtcatgtccgagaactcttcatcaaatcaggttcctgaagaatttctctttcccccctaaagttttatagttttatgttttacatttaggtctgtgatctgttttgagctaacttttgtgtaaggtgtgaagtttgggttgaagtttcttattttttgttttggactgtgtttgtcctcgtctactgacatggttttttgcacccttgtgaaaaatcattgaatatatttgtgtaaatctgtttctgggttctcttctgttccgttgttttgagtatctgttgctctgtcagtatcacactgtcttgattactgtagctacatagtctgacttaatgccaggtggagtctattcaccttatttttcaacagttttagatgttctaaggcttgttcctttccatgttaatttttaaaagaagcttgtctataactacaaaaactgttctaggattttgagaggaattgatttaatgaattagacttttgaaattgcatatgtaatgttaataaagttaaaaatggtaattctgttaaggaaaacaatttagttccttccaaagtctaacgctagttcttattttctgaagaaatgtgtatttttatgattttgaaattattgaatgaatattaattagcagtttcttttttattttttaaattttttgtgtggagatggggtcccactatgttgcccaggctggtctcaaactcctggtctcaagcaatcctcccgcctcagcctcccaaagtcctggtattacaggcgtgaaccaccatgcccggccagcagtttcctttcagccataacatgaatgaccttttttaatggccaaaattgaagtttgtcaggttctaaatcactaatatgtttttgaatttaaaaatttttgaaggtttacttctggaatttttaagaccaaccattagatttataaggctgttaataagattcctaaacctattgttttgccttaaggaaagtatggtttaccttttgtgttatcccaaacaaattcatctccccatatagcaaaatggaatatgctactaaatagttgaaatttagggtaatggagtttgggatatgtttattattcatgaatagtaagtcaaaagtttttaaatgaaaacatttgtgtattctcatgctttgattgttgattctgcaaaataaaatcttaaaaattacaaaaagcatctgataaacttcttaatttaaaagaacactcagaaatttactttcaggtatttaaaaaaagagggaggctatcaaactgattaggactgaagaagaactgaagagataatgtcaccttgttggttttgggtgagggaaaattgaatgagatcatgctttctttctgtcttgctttctcaagataaagcttttccactcttctgtctgcttactgattcagggtggcaggcacaaaacaaaacgttccggttatattttccatcctgtttatatttaaattggctgtttattctttaataaagtgtataactgttggtctataacattatgaatgtgggattaagtggttagacttagcaggaatttgaaaatcagggtccaaatgtactaccctaagtacagtagcagaattacttctataaagaaaacttccctaagttacagcatctggctcatagcattatcattacagtgaagtttaccatcactcatattagtgatgtgttacttcccacttactcctaaccctgcttaggtaatgcaaaactataatttagaaagtgtgatttaaagaagatgcaatataatggtactcattgtaaacatatatccagatttctttcttcacatataatttatctgtatttttaaatttattttgtctaatgaaagacttttaaaagctcattctctcgagcagtgaattctcagctagtgagccaggacagtctgcctcatcaaaagaattctgctaattgctttagccaatttctgaggtaataagctgggagagggaagaggttggttactcatgcataggtgactttttgctaacagtgtgatttttaggaagtgaagaccacaaaagctttttgacttgtggcagaattcattatgatgagactttagctgtaccaggtaacagattgccaaataaaacaccaaacaagcaagattggtcagttacaatccagtctgtagtagtctgatccagcatagtgttatgtttatggattcaattccctcctcgaagtcatacaattgaggcatctcagtagaaataaaacaaaataaacaaattttgtagggaagctcctatacatttgaatggtaagggcatataactattaatactttatgagaccatggtattttgcagccaatcttaaggataaatctacattgtgttcaggattctgtgttgggccagacttaacaatgaccattatgtgtagaaaatagcaaccattgttgctgaattaaactctctctggagatttaaacatttttttaaaaaattaagctaataggccaagcgtggtagctcacgcctgaatcccaacactttaggaggccgacgcgggcggatcacttgaggacaggagtttgagatcagcctgggcaacgtggcgaaagcccgtctctactaaaaacacaaaaagattagccaggcatggtggtatgcatctggtcccaggtactcgggaggccgaggtgataggatcacctgagcctgggggaggttcaggctgctgtaagctgtgattgcaccacggcactcagcctgagtgacagagggagactctgtctttaaaaaaaagaaaagaaaagaaaaagctaataaaaccttgatgacaacatagccaaagaaattaatcagagaagagtggtgattagaaacagaaagcatagtggaatagatgaattacacctggcaaaggaactctaaactatattatgtaaagctcaggacagtctacttgtctgaaaaagaaataccaaaagtatacacatgcaaaaatttggatttttcagctggactttttgtgaaaggttccctcccaccccaaattcaaaagaagtataaagcaggccattcatggcaaactcccaatgaaatggaattaatttgtattgtgttttgaaagtgtatatatgtgcttgcaggaattacatggaagaattatactgacatagagtggctctcaaagtgaataatggaatcttaaggatgttttattaaacagcgagtcaactatttttctccgtgaatgtgactccacaatgatagtggaagtcagaaaatatttcacatgcaaatatatctgaaattcttcatggatgtatttaacgctttgaagtgatggcaacatctggtagcaagtagaagccagcgtcttaaaagctatggcttcatgttactacttcatctgaattagtcatttaaaggggattttatatgtcttcctaaaaactgacgaggttaatcttagactagggcaggctggcaggaaatgctaaagcggctctttcttttgaaggttttgttattccttgtgaggtcaaaaagtagttgttttaaagtttggaaagctaaagcagtgatgttttgactcttgacagtgagatgtttttctttttttttgggggagggtgtgtgtggcaagtttgaggaaaaacttgatacactgagagttctttatactttccactccacttattttctctcaaatgaatttattttctaaaggtgcagaatttagaaattcgtttcaattaccaaatctgagcatggatttggtgctattagaagatgtaaccaccatgtgtttggccagattagctttcaggaatgatcgtatcttacagagttagccaatggaacaagagtagatgccttttatccttatttatttgctttgcattaaaaagacaaatgctgaaagtttattcttgactatgaaataaaccactataatatatgacactgagttaattcctttaggatgctatgtcttccacatacatccatttaataaatatttgttgagtgcctactgtatgccaggcactgttctataagctgaaaatagattgctggacaaaacagacaaaaaatcactgccctcttagagcttattaaatacgaaaacagtagagcaatttaaaattatttaatgctatcactcagcttttaaagatcttcactgaatgagttttgagaacttttgcacatattatctacagcttgaatagggaaaaaatgacattttgtttgaaatctagttcaagaagctagaagctgataagtaaagtaaatattttattctgtgatgatcattttcagttttcatttatcagtgttatacttaggcctcttgaggaatgttactagtttaacttgtggatttcctcctgaggatgggcttaatttgtattgggggaggtggtgaaaggacctagtagccctggaatttaatgtaaagtcgtggcatttgtaaaactatcttctgtcatttgaaaaattatagaatacttaaatgtatttaatgctccctgtggaaaatgaatgtattgctcagttatttttgcctatgtgagtagtacaagagctgactcaaaggagatgacatgatggttcctgtcctgaagtgaaataagatgatgggttgtggtggaaaaatgatgtggtcatgcccatatttgctcacatctcttgttcgtttccttttatagagggaaaccagggaaagtctcatttcttattttttgtttcctttttgtattttctttcatacgccatttccctttctttttttcttaaaattgcattatagtgacttccaattcaattggctcaagttgtacttggtaatgacataaagaaataccgcttagaaaggtcatagtggaagcattatacccattttagggaattgattatatatatagacacagccactctgagccccttgaggatatgaaaagcatgttgcagaaatcctcatatttcctgatgccaactagtatagtgccttttacagaatatatgcttaatcggtatttatctattgaacaaatatgagccatgaaatttaattttgctctccaaaatcccaagtcctttatataagtaggcagaaattttaaaaagtctttttttttgtttgtttgttttttgagacagagtcttgcactgtggcctgggctggagtgcagtggtgcaatctcagctcactgcaagctccgcctcctgggttcaagattttctcctgcctcaggctcctaagtagctgggattacaggcacccgccaccacgcccagctaattttttgtatttttagtagagacgggatttcaccatgttggccaggctgatctcaaactcctgacctcgtgatttgccctcctcagcctcccaaagcactgggattacaggtgtgagccactgcacccggtctaaaaacttatttttatggaattattcaaatacataatgtaaaatagcattaaaaacccccagctttaacaattaccagtatttcatgttcttatttcatctttgctctccccttttttgagatttgctttaaaataatccgcatattgttttaccgataaatactatagtatacttcttagtttttaatattttaagatagtagtgtttgcatttcatatggagttttacttttaaaccctttctgtgctactttatgcaagagaaagaaattcttaaccgcttatcagaagaaaaatctaatttttttttttttgacggagttttgctcttgttgcccaggctggggtgcaatggtgtgatctcggctcacagcaacctccgcctcccgggttcaagccattctcctgcctcagcctccgaatagctgggattacaggcctgtgccaccacacccggctaattttgtatttttaccggagacggggtttctccatgttggtcaggctagtctcgaactccagacctcaggtgatccacctgcctcggcctcccaaagtgctgagattacaggcgtgagccactgcgcccggccaagaataatctaatttgctgtgtatgagtaggatgttaactcattttgtaacatatatttcctttcttaatcttttaaaaaattttattaaaagtttctaaacaggccgggcgctgtggctcacacctataatgccagcactttgggaggctgaggcggacaggtcatgaggccaggagttcgagactagcctggccaacatagtgaaacccggtctctactaaaaatacaaaaaaaaaaaaaaaatagccatgtgtggtggcaggtgcctgtagtcccagatacttgggaggctgaggcaggagaatcgcttgaactcgggagggggaggttgcagtgagccaagattgtgccacgcactccagcctggaggatggagtgagactccgtctcaaaaaaaaaaaaaaagtttctaaacaacattgtacatgttatgtcatgactgtcatgataaagtcttgccttttagacatgaacctgattcagcaaaatgtgctttgaagtagataagctgtagatttttgtcttgcctgaattgatattaaagagatgttttttcttttcacagttcaaaagtacagaactcaggttaaaacctagatatgtaattttgttaattttattttcagtttgaaaattcttgttaaaacctgcatactttataggtttgctgtctctaaaattagatggctccttcataaatattactgaataaagcaccagttttcaaaaagtgtggcacatgggctcatgggggttaaaattactttcatgataaaactaaattgttatttgttttttcactgtgttaacatttgcactgatgatgcaaaagcagtagtgggtaaagctgctgaatcaagatagtggccccacactgtagtgatagccactgtattcctcagcaccataccatcacctttagaaaaaaatcttacaacatgcatttcatttacaaatgtacttgatgaagcaggaaaaaataattgtattaaatctcaattcttaggtatgcatctttttaaatattgtgtgtgatgagataagacatacccataaagtatttctgctgcatatggatatatgacgattgtcttgagggaaagcacttgcgcagctgtttgagttgtgagctaaactagctgcctttttaaaaatagaaaaccaggccgggcgcggtggctcacgcctgtaatcccagcactttgggaggccgaggcgggcagatcacgaggtcaggagatcgagaccatcctggctaacacggtgaaaccccgtctccactaaaaatacaaaaaattagctgggcgtggtggcgggcacctgtagtcccagctacttgggaggctgaggcaggagaatggcgtgaactagggaggcggagcttgcagtgagccgagatcgcgccactgcactccagcctgggcgacagagcgagactccgtctcaaaaaaaaaaaaaaaaagacaaccagttttactttgaaagattgaattaactgattattcagacccgagtatctaacagatactttatttttaaaaaatgaaccaagtgtgcctctcactgcaagggaaacaactaagagtatttgttgccaatgctaaaattagagctttcaagcaaaattcaaatttttgagaacttgcattggtcaccattttatccgatcaatacttaggcttttctagtgaaatcgacagtataattaatgaaaataatgtgttagattttgtataatgaaatgtatcagcatttggaagacccacataacttactgaaacaatatttttccaaataactaatgtatgatgttacaaaatcaagcatgggtaaaaggcccattctaagtgcaagacagacaaatagattttgaaaaaatcattgatattgtatcagactctacattgcaaccaacctttgaaaaactaccacttctctcgagttttggtgtagtattgaagaatatctgtaagtatctggaaagcctcttaaagtatttctttctttttacaacagtttatctgtaggaggccagatgttcttcatgcactggaaccaaaaccggtattgcaaaagattgaatgcagaagcagatatgaaaacccagctttcttgttctaggttaaacattaaagcgatttgcaacaatgtaaacaatgccacccttgtcactacactttttttgaaaatatagttatttttcattaaaaagcttatgttaacatgtaatgggcttattcttatttttaaacaaataaatatcttaaaagtttcgtagtcgcaatttttgatgtgacaaatacactgatagatctaacccatgtgtcaccaaactctttgggatcctcagatcctgaggccaaaaagtttaggaactgctgagttgggttttttgttgttgtttccctccttatccctttgccccacccctccacttttctcctattcccctctcctttcttttctttttttgagtgagagagagaccctcaggatagaaaattgtagagcatgtgagttattcctttgtatgtttttattagctacgaactgaacatgtatgtcttttaaattcattcattgccccatgtgtagttcgatgtattttgaccttttcttttatttattttaaaattttgattacttagttacacaaataaagagctaataaatactatcagggagacagcccttggaatattgaattttatattttcttctgcgacagtcttgctctgtccgtgcagtggcaagatcacagctcacctcctgggctcaagctatcctcctacctcagcctcccaagtagctgggactacaggcgacagccaccatgcccagctaatttttttgtattttttttgtaaagacagggttttgccatgttgcccacgctgctctcgaactcccgggctaaagtgatccacccacctctgcctcccaaggtgctgggattacaagcaccagccaccacgcctggccagaatattgaaattaagatatattctgacttatttttccccaaatatgaaaaaaatgattacatatatgacttgattattaaaattgacacatccatgcaacaagtttatatacctaatgctgtgcctggtatgaatttcctaaactttccaatatagtcccaaaattacagtagtagtttcttgaatgtaaacttgttgcctgttttatatgttagatccctttgcttctatgcttcactcactatgtttgtttgttcgctttgtttttataagtcatgaagatggaaaaaaaactgtttcatgaaaggaaaatagatgagtgttgttgaggtgtgtcattaagcacagtgggagaggcctccaatgtacgtgtcacacatggaaagtatacctagtactgggtgtggtggagagcatgacgtctggatgaaagttgtaagagactttaaaaatactatgcctagcttttgtgttacaactacatattccactgatacttatgtgaaactcccataacttttcgggttgtacctcttttttccaccctggggtgggagtgtgtccacaagtgcatgtgtgtgaactcttaactttgtgtttgtattttgagatggagtctctgtggcccaggctggagtgcagtggtgcaatctctgctcactgcaacctccacttctggggttcaagctgttctcctgcctcagcctcccaagtagctgggactacaagggcacaacaccaatctggcttttttgaatttttggtagagacggggtttcaccacgttggccaggcttgtctggaactcctgacctcaggtgatccgcccacctcagcctcgcaaagtgctgggattacaggcctgagccaccgcgcccagcccggcctgaactcttaactgtatggtttctgtttgtaacatctagagagagtgacagtgagaatttggtttccgtcggctttccttagcattcattttgatgaatttgggatgcaatttaaaagctgttttcattctgtggcctgctgatgaaaatgtagaatttattgcagaacccttgccaccgtcttgcattcccaaaccagtgttcattacccatagtaaaaaccgagatcctgttcacacacatgcacatacacagacacgctccccaccgcccccgtcacgcacacacccacacacacctcggatggtgagtgagatagaagtttagtttacatgctaaaactggttaaattactgatgtggtagaactgtcttttagcccgggcacagttgctcacacctgtaatcccagcactttgggaggccaaggtgggtggatcacctgaggtcaggagttctagaccagcctggccaacatggtgaaaacccgtctctactaaaaatacaaaaattagccgggcatggtggcaggtgcctgtaatcccagctactcgggaggctgaggccagagaatagctggaacccgggaggcggaggttgcagtgagctgagatcgaaccactgcactccaacctgggcgacagagcgagactccgtctcaaaaataataataataaataaaagaaacaaaaaactggccgggcgcggtggctcacgccttgtaatcccagcactttgggaggctgaggcgggcagatcccaaggtcaggagatcgagaccatcctggttaacacggtgaaatcccgtctctactaaaaatacaaaaaaattagccgggcgtggtggcgggtgcttgtagtcccagctactcaggaggctgaggcaggagaatggcatgaacccgggaggtggagcttgcagtgagccacgatcccgccactacactccagcctgggtgacagagcgagactccgtctcaaaaaaaaaacaaaccaaaactgtctttatgtcctacctagcatttactaagtagaagatgtgcccttttgaagggcatgtctattcctagaactttaactacaatgctttgcagtagaaatatatgctattgtattaaggtgaagtgactttagaattagtaactcggtgttgacagatcatgctgatcgaagattagccttggagtttggaaagctggagagcatgtatattccagatgaccaggaaaggaaaagtcagaaaaacagtttttaagtagtactgttataacgacctgtaaaacttgaaacgagagaaagctgtcttctaaaatgaagaattacatatttaaaacattaatttcctcaatgatactgctacatatctgaaaagggtggttacgtagcatttgggacagacccgtctcagtggtttgaggcaacaggtgtggctgaagaaaaggtaaggctggggaaaaaccaacatttctggtctaaactgatactgtcttcttacctgaggcagtttcctatgccctggttttctctgtctgaaaaatgcatgataacacatactcttcaaattagctcaaaatgcttggtagttacctactattccctgacaggccacaggcagatagttctatgcttgttttagaaatggagaatttggtactcagaaaagttgaagaagcttcatttcattcacatagtgagtcagcaacaaggacagacggaaaaacatgtcctatgactcctgccattgtattccttctcttctgcattgtgttgccttttgatatttcacgaaggttttgtgattggtgaaataaattaaagcacttccatgaaggagacaaaatgtaacccagtgtctgctgatggtggttagtgacgaggacaggagaacactgcctcataatggggactatccggtgagggctccttttcacaggtgcccacactgtgagtcacctccttatgctgagagttcggtatgctatcataaaatactttgttgtgtattatttatgaaggactagagtatctattgtctcactttctttcattctcatgaggtagattacagcagcagatggcattatgcatgctttatcccagacacaagaaaataatatctgccacttactgagtaccttgctggacccagacactcttacatatttatatcttcccattgggtcatcccgtggaccttgtgaaatatgtggaatagctccattgttatagatatgaacccggggctcagagaagctaagtaatttgttcagggtcacacagacttacaggtctgtcagactcctaagaccctgatgctttcattgtgctgcatttccttcaaattatgaacttgccctatgtcagcacagaaacggcctcttcagcctagcccagtgctccaactgattgttctctctcataaaaggcactcacaactaaccacttgcttgatttaggaattcactgattagattgctagaccagttaaaggcaaatttcaataatgagagcagttatcacgtatctagtacttaccatgcgccagactatgatctaaatttatgacacatattaaatcatttaagccttacaaccatgtataaaatagtgaactgcgatatgatggagttgctcttatcttcatcccgggatgagaaaatagaggcagaagagttttaagcaatttgcacagttaataaagtgtggagccagaatttgaacccaatctggctccagacctctttactacagctctcagttagaaaattatttctaactgagatatttcggttcagcaagtgttggcttagttcctgtgtgctatgccagcagaaaatatagttcctacacagaagagcttacatttttgacataaatcaaaatgtatatacttgaaataaatgctacaacaccttagcatatggggtgtaaatgttgtgtatggatcagcatgaataatagagactgttagtgagtggcttgagagttaatttgccttcgcaagtaatgttcttgactatggacgagtgacttgggcactggggagaagctgttccatgtgttctaaaataagcaggttacttggctactgttcaaactctaaataggtatatgggttgtagctatttgacctgaactaactttaaattcccctgagtccttatatgattttggggaaaaaaaaaaaaggaagaagaaaaaagaaaacttttctctgtaaatgctgcatttaaattagaatttattaaattctctgcaaaataccgccaggctgacaggaaggggattcgtaagtattgtatcattcttttgtcagggtgttctctttttctagcaggaagtgttgtgacttgctctctaaagttgcaattgtaagaagaatgttgggtttccagattgctcttctgggcgtgggagaaggttctgtctatcagtgctgcgagaaaggaaagaaacaagtttgctctcagcgggtaactattttaatattattttgacaggctctaactttgagattactaaatctaaatttaaatactaaatgattaagcaggaatttacgtcaaaaagcttgaaattcctgttatttatttgggtaaacatttggagtcactttaaaaatattatttattcaagtagaataaaatttttgttaagagaaaattttgaagtttagattctaacctgttctgtgtgtattctgtatttttctttatttagagaatgtttagggagtttatactttttaaaaatgggttttgaaatcctaattatacagccgtatttatcaagttaagtatctaaaacactaaataatagaaattattgtctatatttgtggtgggggtgggatttcaaatgcttttgatcccagttacatggtttttcaaaattctgtaaaatggaggttgaggtggctgtcatgacagaacatgtcacgattagattgatattatactcttcctacgtgagttaaatcaaacagttgtcttagtgtttataatttacaaaataataaacatcactggtgattaaattttgatggcgttattggtacttggcagcaatagtgatttctggtgctcacatacattaggattttccatcacatggttgtcatataagtttaatttccccatatttctggcaaagggaagtatagctagttatacagtcaatcctcactctgagttgagtcacctctcggactggttgtacttaatatgcgcatatgaagtaaaaagtgaagcatgaaacaaaacaaaccagttttttcaattaacaagtgctgtatttgctaacatataagcaaggtatataacactgcaagaggcattttcagtgacttgccgatagctttctgcttcgtgtatatagtgatttgagttgtaggtcacaatattttatggcatttttattttgaattgaagtgaagcatggtaactagtctgatcttgcctagcctctctctctctctctccctccctctctctctctctctctctctctcacacacacacacacacacacaccccacacacacatatccctgaaagttgcccttggcttcactcaaacatatgttaattttcataagaaaggaaactggtggaaatacttcttaggtatgaaaattaattaatttcattagcagcagatttattttcccataaattattcagattttgggggtagatgtaaaagtttacttaggcatggaagacattagaccttttaaaagcaaagtgggctatttcaatctaagaagttagttaatgtaccttagctttctgaagctaggggaaggagaggtgtctttttgttgtgtctttgggtttgaaatagtattcttcatcctaggaaaaagggcttttagactataattgagacttgcattaaatagctgcaaaattcttgcctgagaaacgtttaaatgatgtctttaatctgaccaaattgaattgaatatttctattattggaaaaagctacgtattaatttatttttaaatagccattgctttcagatcttatctttgtttattaagtataaaaagaggaaaggaaacttttacctaaaatggaggtatttgatattcctccaggaaatgacacaggattgggcaccctttggggtttaagtgactcatagatattggtactgaaaacaaaacaaaacaaaagatcagttagaatctagctaatgatcaattatagcacagaatagaagtatttccagaaaaatgaactcatttcttaatagctatgtaggggtgaaatcacaggatttctgagatttgctttaaaataattcatggaagagagacagggaaggagggagggagaagaaaggacaggaagagagaatagatgaaccaagcaaatgtggggaaatctggataaatgtagaatctgtgatgggtttatgggtgttttttgtgctattttctcttgtatatattgaaaatattgacaataaaaaatgttagtagacctttagtttggggcaatttatatttattttctttcttttttttttttttttttttgagatggagtctcactctgttgcccaggctggagtgcagtggcacgatcttggctcatgcaacctccacctcccgggttcaagcagctctcctgcctcagcctcccgagtagctgggattacaggcacccaccaccacgcccggctaatttttgtgtttttagtagagatggggtttcaccatactggccaggctggtcttgaactccttatatttacttctaaatgtcaacttttatctataaattgcaggcctgtcaaaacatgatgtatgcatgatgtgtatgactgtaaaggtgaaatgtgctgcttgaatgccaaaatggttgaaagtaaaaactgcttctgaaaaggtttatttctgtttgattttcagctaaattcaaaggacaggtcacaaacatcttgaagagttttttagtatcttgaagtattaaacaagggtagttaaagcatgataacaggccaattgtatgtgaagaatgtgaagacgttattgaacttgactattttgttcacagctttctccaatagagtatgtgtttttaaaaccacgtgagaggactatatagcctgcatgatgtataggtctgcgcactttccctactcacctccatcgaagtttatttattgaacaaacattcggtaggtgcttgtggtgagccaagatacaaagtcaaataagataccaaccgtgcttttaaggagctcacaggctcgtggaggagatagagaaagaaatagatgtcatcacgctgaaagctgaaaagggctataggaatatggggaaggggaggaacgggttagcaactatgaccctatgacgcatctcctttaaaataatacaaggctgggcacagtggctcatgcctgtaatcccaacattttgggaggcctaggtgggcagatcacttgaggtcagtagttcgagacaagtctggcccacatggtgaaaccccgtctctcctaaaagaataaaaactagccagatgtggtggcgcatgcttgtaatgctagcaactgtgaaagctgaggcgggagaatcgcttgaacccaggagtcggaggttgcagtgagctgagatagagccactgcactcaagcctgggtgacagagcaagactctgtctcaagaaaataataataatataaaataaggctgggtgcggtggctcactcctgtaatcccagcactttgggaggccgaggcgggtgggtcacctgagatcaggagttcgagaccagcctgatcaacctggtgaaaccccatctctagtaaaaatacaaaaactagccaggcatggtggtgggcgcctgtaatcccagctacccaggaggctgaggcaggagaatcacttgaacccaggaggtggaggttgcagtgagccaagatcatgccattgcactccagcctgggcgacagagtgagactctgcctcaaaactaataataataatataatgtaatataatacagacagaaaattggagatggtttaattggttgtgggtattacagtggtagaagagggctaaaatggcttagtctaaccccatgcataactttgcaaataactcttctgctctcatctctcttccccgcccttcttaataaacctttatatctttcttatgcatccacaggggttattggagcagtgtacgtgcagaacagagcaatctcttcttcacattaaagagtagactgatgtttaagtctcccttaaaggttttagatatatccaaggccgaattatagttattaggtaggcagctacttggagttggataaagggtagagttagccttcagtcacagatagagccttctaaagttcatttctcaattgatttggaatttgaaacatattttgtcatggaaatagtagtagggtttttcaggttactttacaagtattcctgaaattttatattatgttatctggcatgatatggttttgttctatgatatcttattttattttcattgtattctatgtgaattgtagaagcacagttgctaaatatatccagatttatgttccatcagccagttactttattctctagttcctgatactatacaatctaatcagtgtatataataatgcctcatgagaaaatactgtcaattttatttgaggtacctaatgatgtcctctgtttagttgtacaatttgcagctgaaatgttaagtagaatgaacagaagagctagacctgaaaaataactttccgaagtaaagtctgctatacgtggtgattatttctttcatagatgtttgctcaccacattgactataagaagaaatttttggctgggcatgatggctcatacctgtaacctcagcacttttggaggccaaagcagacaaatcacttgagcccaggagttcaagaccaacctggagaacatggcaaaaccccatctctccaaaaaatacaaaaattagctggggtgatattgcgtgcctgtaatcccagttactcagggggctaaggtgggaagatttcttgagcccaggagttggaggcttcagttaccatgacactgcactccagcctgggcgacacagcgagattctatttcaaaaaaaaaaaaaaaagaagaaggagaagaagcaatttttgataatgctgatgtgctagaattaatgcacagtaaaacacttcaccactttttcttctgcttcaacctttcctagacttttaggactaggaacctatgacacacgtgagggcatttaggttttgactcccttattttgactttcagagcaacaaatcattaaataaaaattatgcatatagcctcttaagcctttacaattactcctttaccaagattccgtgaaagttttctaaaatgagtcaagcaaaattccaagccacttgttcttgagaaaaatcttgaaagaaaaaatttttaaatgaaaagtaaatcacatagatacttgagtgtttgttttatattaagactaagttattagcactgatacaatgggagtggttgttcacaatacttagcattcatgaggctgaaattaagcagtattaacaaagagaagcagaagcctgtcatatgtaggaatgaatgtgtcataggagaaagtaagcgtttgtgtgcttttttttcagaatattgcctgttttatgatcagtgccaatttaacaccaatgttttaaataaatgacttttagaactctgtatgagtctttactgaactcattgtctatattctgtatgttttatacaattaaagttttggttattttagttcaaggcttaagtgaatcccttatccttttaaataatgaaaacaagttagtattagctggagggggttactatctccattttctggcaactgttcttatttctcgatatcatggtcatatttgttaggagctttttaagttattttccaaaggctatatatactaggcatggaccttctctctgcaaagcaatgtgtagtctctttgtttttgtttttctgggaagagtagttaattggctgggcactgcagctcaagcctgtaatcccagcactttgggaggctgaggcaggaggatcacttgagccctggagttttagaccagcttggcaacatagtgagatcctgtctctacaaaaaaaaaaaaaaaaaagaaataaaaattaaaaattagccgagtatggtggtgcatgcttgtagtcctagctactgggggtgggaggtgctgaagcaggaggatcacttgaggccaggagttggaggctgcagtgatcatgccactgcactgcagcctggacatctcagcaagactctatctcaaaaaaaaaaaaaaaaggaaagagggaaaaaacagttaattacctttcctccaacacatgcttttgctttttttttttttttccagctatgcttggagaaacacattattattattattattattattttgaggtggagtcttgctgtgtcgcccaggctggagtgcagtggtccaatctcggctcactgcagcctccgcctcctgggttcaagcaattctcctgcctcagccccttgagtagctgggactacaggcacgtgcagccaggccctgttaatttttgtatttttagtagagacggggcttcaccatgttggccaggatggtcttgatctctgaccttgtgatctgcccgcctcggcctcgcaaagtgctgagattacaggcatgagccactgcgcctggctgagaaatacatctttttaattgtgcttcacagctttgtgtcctgggcaaagtcaacgactatcccaggcacttgtttattccctaatacaatttagggaatgaagttatggaactctacagacttcttagctttcaaattctcattgctgtgatcactggatattgggaatactgggaattttcactccctctaaacattgcagttggttggagtattttattcattttttatgtttatttttttagaggcaggcaaccatagctcactgcagcctcaaactcctgggcttcagtgatccttctgccccagccttcctagtagctaggactacaggctcaggccaccatgctggctgatttaattttttttttttttttaagagaaggagtctcgctatgttgtacaggttggtcccaaactcctggcctcaagcagttctcccacttctgcctcccaaagcactgggattataggcatgagccaccaccctcagcctcagttggtatattttgtaaaccatgcctgtgtaaccaacatccagcaatgagagtaaaaggtgaagtttagactgttctccagaaacaaacaatcatgaaatgagacttgcaaagcaaagaattacacaagtttttgtgtgctgttcgtgaaagaaggattttcttttattgaagaagattgttctctttgaccaagtttaagaatctatgtaaagaaggtagataaactgaaccaagtaggacaatggaagtcccagttagactgactgtcctcatatccacttatgtaactatagggagaagtctataattaaatttcaaaattttgtggcaagattctaaattctctgggagttgaagagaaagatcagtgggaggtggagtcattgggaaacgtgctttgggagaggatgaggcttctgaaccttgcttgaagggtgagtagaatttggatagagagagaggaaaaatagaggagagtattctaagcatgagacgcagatagagagagaggaagttcttaatggaagacaggaaaagcagaagagaccagaataaaacaaaaggtactgatagaggagaatccagaaccagctgtaatagaaacacagttctgtgagagtactgggaagataaattttatcttgggtgcggacaatctgaagatacttcctgaaataggcttttgaagtgtctagatagatgggtgaagagcattccactggagagacccagtggtctctccagggagtggaagaagcgggaaaatacatggcctgtttggggaataaggtctcttgagagtgttgggttcaagggtgtagtacatataatgggaagtagcattggaaagatgggcagacataaagctagaagtcaagtcagaaaagtgtagggccttgaatgctgtcctaaaaaggtgggacctccttttgcatggaatgtttataagatccgctcttcaggagattatcaggagattagcagtgtaaagattgcactggaggaagacagaacagcaggcagatctgataaaaaaaaaaaaaaacttttgtggggttgggggagggggaagggatagcattaggagatatacctaatgtagatgacgagttaatgggtgcagcacaccaacacgacacatgtatacatatgtaacaaccctgcacgttgtgcacatgtaccctagaacttaaagtataataaaaaaaatatataaaaagataaaaaaaaaacttgtggagtaggccagacatgaggtgataaacagatatgacggaagaatctcagatattgcaaggcaagaatccagagggatgggtggttgactgatcctccctttgttttttatggtcaaactgcagtctggagacagaggaaagtgggaaagttgaaaacgagacctgatttggcagaagaaagagttagaaaaaaacagggaaaataatgtggcagtaagttagattggagacacttagactttcctaacttgaatcgtcctcactgactttccttctcccttggccacttctaaattggaccctgatctgctgctgcgagtgtgtctgtcactaacacaaggcacaatacccttaccagtgatgtctctctgagaatgcccttactggggatgtctatctgagaaaatcctacttgcactcaaagacagagttcaagcctcacctcggaaaaaacttttctgacgcctaccatttagtatatatgactgtgatggcatgattgcactaatgttgtatctttgtttttccatctgtttcccccactagacagtaagctcttccagaaagaaggggatttggatcctaattgtctcttatctggagcacccaacacagtgcctggtacatactaagccttaagttaatgcttgattaatataaataaataagtgggtgagtgtggtagacattcaagctgggaatcttctaaagtcattaggaaacatgagactggagctttagtaatcatagtatgaataggtgagttttagcccacagtgttgcacacccatctaagctagagactagtgttgagctgttcacttacctaactagggaggtggcagggtggcagtttctattggtaaaggtaggtatgcaaagtgtgggtgttcaaaagcactgcctgttttggatggaggaaggtgacaacaccccttttctgatcattcttgaactgttcacacataatggtggctaacttgtttattttcatttatagtgaaataatgtatttcttccatgttttgtcccctctttgttgctttcttgttcattttaggacctcaagtatgtgttgcccagtctctgatttaagtaatgagcttctcttttccaattctatttaccatactagtggctgggatgaagcctgtggtgaatatcctgtttttatcttttggctgcctttcaatttaaaaaaaaaaaaaatcaagtttatgatcaaagttggttacccccagatgagtttcccacgtgcattctctttctcctggacctcatggtactgaatgacacagatgaataagtagattattcagtcagctgcattcctaaagtgagtgagtgctttaggagataaaataggcacccccgtcccccttcaaatacctttcagaatttgaataatagtttcaggtagttgtaggtatacctttctcagcaaagatctgtgtttagggtttatgtatagttaaatgagccggtggagtggtttcataattgcagtattgttagtcaaactctgtaattagagatgacttcataggcataagattcttctatgggtgacgccctgaattcatacccaattgtacactatatccttttatgaaaaaacaaacaaacaaggttttgtttgcttttgttttactcccttatttgaaaatctgttttcctgtgtcttatatgtttagtgaagaagggctggcttttttctacagctttcccttttcctttacagaaatggcaggcataggagctaaggaggaaacagaatttgggacagatcaaagtgctttgcagatgagcgaattcagaaaaacgtagagactccaggaggttttatttttgataagtattaaaattgctgagtttaaatggaggaaaaatatatctctatttctttgaatgtcagttctctttctctctccctctctctcatcatgtaaataaagtccgcttttgcttggtggcacacatctgtattctcagctactcaggaggctgaggcaggaggattgtttgagcccagaagattgaggctgcactgagctgagattgcaccactgcctgggtgacagagtgtaaccctgtctcaaaaagaaataaacacataaagtccacttttgtgggaagacagactgggaaagaggacatatttgaaaatcagggtttttttccttttgcctgtcaatcacatattgtgaaatcggggttaaacttttattcagcaagtaatactttctcttcacctttttctagtactcatgaaaaaatttgcaaattaggaggaatgtgacaatattgacaagctgttagctattttgaaaagtgatcctaaaatatttaaagaaaaattgttgtttgtttgtatatctcctgtctgctctttaaattgtgtttagaaactggccttacggaggaaccaaattgagtcatggataaaaagtgactgacaggttttcctttaggcccatccttcttaaattactttgactaaagacttgtaatttttatatatgagggagacctattatactctgtagtcagtaattatagggagatgagataacttttcatttatcccatgtaaaaggctattagtagaactaatgccttatatttatttatacagctcttcacaattaacccaagcattcatttattccctattttctttcatgaaggatttgaagttgctatgtaatacttcatagttcacaatatgctgtcatacataccatctgtaatcttcattaggacctgggggaagtaggtattattatcactattttcaaatgaggaaacttaggctgagacagattaattaaacttgctcatggacacattactagggaatagcagaaccagagcaataatcgatgccttctaatttcacgtccaacatctttctgttaaaacatactacaaccttgggcgcggtacaacagcttggtgtactggtacttgagattaaatgaagtgtctacagggcagtattgatgtcaaatcttgtgttttgctttgtgaacccatccgggatgttttagtaactttaagggaaaaaagtcctatagtacaatgaatgccccatgaagaggaatagagcttctgttattttaatttgtaagatctttattttttaatatcttcactcatttccaagttacttaatgtgatgttttctctcaagatagtactttactgcttgacttccttaaagacaccatcaagtacctatgagtagtcttaaggacagaccattttttaattcatagtggcataaagaaatctacattaaacaactttattttaagcttcaaatggcaaaatgtacaattgtatcagctagagcatatattgtgagctttttaaatttggctttatattttttagtcttggcccaggtacttcagagtagcatttctttatttcctttcaaataactgtcaataaatgaatatgggtttatttaaattggaaagtcctgcattaaactattctgttatcctgaaacaaccttgtctggaaatacggttttaaggatatgtgcatgttccaattccttctttttgttctcattgaagtgtatctctttaatgtctctgatagatgggaaatctgagttacatatgcaaagtcactttaggctttttaaaaggcaattagaaataagaaacttgaaaattttaaaatatatgtttaatgcactggattaatttttggactaaactggtgccctaaaattatttctatgagatctaagcatttcttaattcatttttattttttactttttttattgagacagggtcttgctctgtcacccatcctggagtgcagtgacgttctcatggctcactgcatcctctacctctcgggctcaatcggtcctcccacctcagtttcccaagtatctgagactacaggcatgtgccaccacccacgatgcccagttaattttttgtatttttggtagagacgaggtttcaccatgttgcccaggctggtctcgaactcctgagctcaagcgatctgcccacctccacctcccaaattgctgggattacaggcatgagccagcacttgctaattttataggaagaaaaaaagaactgcgtttctggccactctgagaagaaattaataatccttaaagtctctagagacttttttcttctaaaaaaatggatatttgtaccttttattgcagtcactaattcactttatgtcatattgtaattattcatgtttgcttcgcagattgtaaattccttgagggcaagaactaggtgtatagcagatgtctaaaatattggtaaaattgtttgagaagtagcggggaggggcaggttggggagaaagagatttctacaggatttaatcagaacccaactggtcagcagggataaggggggcggggggcaggaatggtttatgtccagaaccatcttatctaatttcttttttttttctttcttttttcttttcttttctttttttttttttttttttttttttgcagtgatgcactgatggctcactgcagcctcgacctctcaggctcaagtgattctcccacttcaacctccagagtagctgggattacaggcacgcaccaccactcctggataagttttgcatttttggtagagacagggtttcaccacgttggccaggctggtctcgaactcctgggctcaagtgatctgcccgctttggcctcccaaagtgctgggattacaggcatgagccactgcacccagacctaattttcttttgcatagaagtgatatggtagtgtgagagtaagctcagttgtataggtttgttttagttgttttttacccacatactttaaattattactgactcactatctgcccaaactggaaaggacctttagagataaaggagagaggccacatgttttagatttctgagatggtcttacttttaaattttctgtgccattgttctccttggtgtgtgattcatggagatgtgtaataattctttattaaaaacatgattgcttaaaaggggtgaagaaaattggaataaatcctatgtcgtatttttgtaatggggagtgttgaacatattagtgaaacagaatatttttagaattactactattcgtttgcatttaacttacgaattttaaaaaaaaatttttttggaggcgaggtctcactatgtttcccaggcttgtcttgaactcttggcctcaagcaatcctcccgcagtgctgggattgcagttctttttattcttaatctttaaaatgcctaacttcaggcctgggcgtggtggctcatacctgtaataccagcactttgggaggctgaggtgagtggattgcttgaagccaggaattcaagatcagccagggcaaaatggtgaaaccccatctctacaaaaaatacaaaaattagccaggcatggtgtcccacggctatagtctgagctacttgggaagctgaggagggagaatcacctgggagggaggagcctgggaagtcaaggtcgcagtaagccgtgatctcaccactgcactccagtctgggctacagtgtaagaccctgtctcaataaacaaacaacaacaacaacaacaaaaaaaaaacccacaaagcctaacttcattactaactgaagaactttctttccctcatagatcctgagattactctgaaaggtattttcatccaacctgtctactgagaagttatccatctttagtggcatcttgatatcatacataagaaaagtttatgaataggccagctttgttttatatcttttttaaagagtctagtgttatttaatttttttttttttttttgagacagagtctcactctatcacccaggctggagtgcagtggtacgatctccgctcactgcaacctctacctcccaggttcaagcgattctcctgcctcactcaacctcccgagtagccgggattacaggcacccgccatcacacttggttactttttgtatttttagtagagacagggtttcaccatgttggtgagactggcctcgaactcctgacctcaagcaatccacccgcctccacctcccaaagtgctgggattacaggcgtgagccagtgcgcctggctgatggttttatttaatttttaaaacaccagtcactgtatgtgtctgttacattatggtaaaaacttagctaatagcatcatatggtcattttaaaacttctccaggatttgagaaacctgagtgtgaattccagtcctgagagcccaggtcttctaataggaaaaaaaggagattagaatatttagctcataggactattgtgagggtttaggaaattaatatgcaaatgaatttgtataatgtattaataatacttggtgcatagttgttgaagggattaattttattaaagttctgttttattgagtgccttactatgtgccaggggctgtgataaattctagaaatagcaacaattctgtgaaaaagatagatgtagcccagctctcttatgaatccctccctaccacttccagcccctacctctctatactgagtgttacacttcttggccaaaacataagttggtgagtaatttgttgccttttaataaaatgtctaaaagggataaatgtaagatctcaaaatgtattttgtatagtttgtgaaatttaacccgtagtatatttttttggaaaggcaacatctttagggcagtggaactactctatgtaatatgttaatggtggatacatgtcattatacatttgtccaaacccacagattatacaacactaagagtgaaccctaatgttcaccagagtcttagggtggtaatgatgtaagttcatcagttgtaacaaacgtaccactcaggtacaggatattttggtcaatgactgatcgaatgtatgatagtagtcgcataagattataatactatattcttactgtaccttttctatgtttagatatacggataccattgcattacaattgcctacagtgtttactacagtaacctgctgtgccatttgtagcctaagaggaataggccataccgtatagtctaggtgtgtagtaagctataccatctaggtttgtgtacgtgcactctttgatgcttgcacaatggcaaaatcacttgacaatgcatttctcagaacacatctctgtctttaagcaacacttggctgtatttgggaactctctgtaacttctgcttgattttgctgtgaacctaaaactactctaataataatgtctattggccgggtacggtggctcacacctgtaatcccagcattttgggagaccgaggcgggaggatcccttgatcccaggagttagacaccagcttgggcaaggtggcaagactctgtctttacaaaaaaagagaaagaaataaagaaaaataaagtctaccaaaaaaataaatcagaagagagaaaaaacccaaaacaaaaaaggagaaaggaacatgtaatcattttcatttttctttgtccaaaattattgttataataggtttgcatttggaaattatctactgtgatacagacctcctctctttattgccaggatcagcaaagtttttccatataggttcagatcataaatattgtgtgccaagaggtaaaatcaagaatattatgatattaatatcaaggatataatatattatttctatcagtttttattgacaaaattcaaaatataataattgagtacaattttttggtaatacaattctgataagaatagaattctttttttctgggataacatttcacttaattgggttcaaagttaatgtgcccccatcatcaaaatggactgcaaaaattttcctttaataaccatatccagcttgaggtcatacaaaaacaactggtgatccagttttggcccacaggccatatgtagtttgccaacctttgttctgttagttaaatagatcaataaggccaaattggaaagggtgtatactcagataatataataatttacatgcataagaatgtgtatattagcacacatgtgcatttttatatcaaaaccagctataatttgttttgtttcctctttattcttcctttaatgagagtgattgatagatgtcagtatgctatttgaaaatcaatgtcttcacagtgaatgattctaaagtggcttaatgggaaaatgatactttccgtgaatcattggtcacataatattgacctttagctttggctcatataaccaagaatttctattatgtagctttttcctgtcactgctgggtactttggcccttccttaaactttttgaatgtaatttaagattttgtccttagaaggaaaattcagaaatattttttctcaataaattttggtaagtgatgacttctcatttgttttctttattaaagctgtatgtagagacatggtaacctattcagattgttttgatagtttgaaattctgtttaaattatccctaagatgagaacttagcaagagtgcttatatttatcacaattttttaaagtctgaaacgtttttggtttttctttagatctttaaatggatgagatggctaccactcagatttccaaagatgagcttgatgaactcaaagaggcctttgcaaaagttggtgagtattttttgtagtaaaactatagggaagcaatatttatttggtctcaaagttatttctctataaatatcacatgaatggttaatcaaaaacattagggcaagatagttaaaatagatgggataaagttttggaagctatacttaaaattgttttatttcttttttttttttttggtcgagtggtagctgatattatttccaattttatgtagtatttaatatggtcaaattttttagaccacagttccaatccttaactggtgactgttatgtatggttcctgaaattttcatgccaaattttagttattattatattttgtatctcatatctttctgaagaggtttgaaactttcaccatattctcaaagggatatgtgaccctcgaaaacattagatgatgttttacccttccttaattagtttggcgttattgacttttttatgggttttctgtgcctttggttactgcagatcgttctacctcgccacgttaaattatagcttcagtataagatgagaaggcatagcatgctatttgatttatcctttatcatcatataacatgccttacaattgagcagctatggaaggtaaatatggagtatttacattccaaattttagtgcttgggtcaagtctatagacaataatgagaaaacagggtgagaacagcctacttatgtaaatacatgaatcaacatgtgcttagagaggtagattattattatttggtatctccttgactgaagggtacagaattagctcatatgatgatttgttatgtaaatcagaatttgccgttagacctgtgtcgaaaatcccattagtggaaaatgaggaaatatacatttctgttcccatatatttatgatcaacattttctatgaaggcattcagtagtagcagtgtaccttgggaagaataatgaccccagccagagtgaccattcataatcccatcaaaattttaactagaaaaaactgaatattcctgaatctaacatgatcgcgcgcacgcgcgtgtgtgtgtgtgtataaaaatagcagttaattaccttgccatggataccacttactgtaagaaaaatgctacatagtttaatatataacagcaagtgaattcttggctgcaagagtttttttttttcaaaatgactctcattcagtcaaaatagtcttataattgttttaggagtgcatttttgaaccttttttaaaattaatattcatctttcagcattagcagcagcttaatttgttatttatgaatagaatttcagagtaggcaccatgccttattaagtactcatctcctcaagtaaatgctgaatacaggtcttgtcctcatgtgcagcatcttggaaataattacgtgcaatattccttaaaaattaaagttaattcagatattgtttacctgatgagacttggaatacatttgacgagtaaaagaacttcattgtcccttaaaagcttaatgacataaagaggattgaccaattatcttcatagaggaaggagttaaattgtattaagtaagggatcaatgagaagtttgactgcaagaaaaggtcattgtggagctattgtttaagtagagtttaagataggcgtacagtttgccaaagcccctgccaggcatatgttcctaacatactcaggctcttattactatatatgctgtaaagaattctggaatccagaatttctgcctattgtgaatattattcttttgtagtctccactcagtatctagcatagtgttgcacacatgttaggttctcagtaaatatttcattgattgaaacccaaggaactatatacatagccttttgatgtactgggatttttgtcattatcaaccatacattcagagggcctttgttgtgaagattttcattacagtggaatttattattaaaggtttttgccattaaattgtagcatataaaatttatatatatttttcagcataataaaagcttgtgtgtacactccatcttttagaaactcatttaaggacccagccgagtctttcgattttctttaaaaaatctttgtagttttaagttgttgttacttacagaaccctcaggcaaccgtcaaaggtgttatagaattttttttctaattcagggacactttattttaaaaacaagctctataacttattatcctgtgaaggacagtttttcctttttgtgggggtgggttggcagagaataggaaagactactttgtctcagttcaattgcgacaaaatatggaaatcattagatgattttccccatctattaacaataatagccttgattatctccttagaaattcagcaaaatcatagcgtgtggagaaaatctctgtaattactgctaatcataggttttgttcaatcaattaatagtgctttgaaactctctttactagcaataaattgagtattagaatttaaagttctcttttcactcactttctgcacctgcttagttttaagctccaagctcatgtaattattttaattttctcaacaattgtttccagtgcttcccagtagcagaaacgttagttatcagtttttgtacttcatgatgtttcaaatttaatttaaatgctgtaatacataactatttctaaagaagaataaataaaacctttcaaaacacttaggtattaatattttaccatctagaaactgtcttttacattctaagcctttaatcttgctatggaaactagtggtcatttggatgattacttgtcataaagaaaaattcatgtaatgtaaacctttgcagagttgctttagtactgcaaacacttaccttgccttgccttttttccctcctgagcactcactactgaggttttttaaacatgaattcagcacttttgaaataaaagaataatgggtttcttaaatgactaggaatagtatgggtgtattcctttgaggtttcccaccaaactaagcaaaaaaaaattggttgtggtgattgtagctataccagacttctctcatcctaggaagttgagttgtttcaaattacttgatattcgctagtatataaaaaccacatcaggatgatgccacaaaaaaaaacagtgctttagtttaatttactttcagtattcaataaaagaacaccagtgcatatttgtttaattatgccttaaaacaaaaacaaaactatagcccgtctaaaaaaaatgaaactaatcagtgctctttcattgtgccatctggttaattatatatggattattagaagtggaggtctcgggatagtcggaaaaccatgtttcaaaggtgtggaagctagttaggagtacacatgtgtgggtgcatgggtaaaagcaatttttatttttatttttatttttattttgagactcctgggctcaagtgatcctcccacctcggcctcctaaaatgctgggattacaggcttgagccatggtacctggccagccaggtatattttgcttcatgcactagatgcgttcctgaaaatcagcaagccaactgtaaatggattttatgtagtgggatatattttaaatgtaaagagaaaatcttatttttttaagtgaagcctgctttgaatttttttatttttttatttttatttttaattattttttgtttatttattttttttgagacggagtctcgctctgtcacccaggctggagtgcagtggcgcgatctcggccactgcaagctccgcctcccgggttcacgccattctcctgcctcagccaggtggcagactacaggcgcctgccaccacgcccggctaatttttttttttgtatttttagtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaaggtataagctgtgagaagcaaaccccatgtttagctaagcatctggagatgtttagcagctgccttttctaaggatttaatgcctaatgaaagcttgatttcactgcttagatcttgggatggaatatagtttaaattcttctgcccaagtcttttgaccgagtcttttaagtcagtattttgtgagctttcatgggcattcaggattgtgtatgtgtgtaaacccattattgttagataaatagattccttttgtcatttctttagtgcagaaaatttgtagaatatgttggtcaaaccaaattgaacttttaaatccagcttttccaaaaggatatgcatctgcacttgctaggctttcttctttaagtcctaatgagcactgtcctgagtgggctaatagagaggtcgcatgtgtattccagatgagggcacacaatatgtgacctcttcataaagaaagacaccagatttagacagattcaaggatgtttaaagcaacacacacacacacacacgcatacacacacaacccgagcgtcaaagaaaatcctagtctttcttactgtcaaatttatgagacaaagtagcaccccaaaagacgcttttgaagtgatagattgcagcacgtaccacctggacatgggcagtgtaaaacagcagctaaaatcaaaaccacttggattctggcttagctttctccagacaagtacttaaaatagcttaaataacaggatgcaaggggagggaaaacatttccttttaaggatatgcattcttggtgtgattcaaacttctgcaggaacatggctgtgtaataagtttatttactttaaggtttacttaggggagggcggcgggggagttaaatagtatttaaaataatacttggtaaaagagaataatgagatttcctttaaaacaaaatgcagatgtgaacctacacgtgtcatcagagagagagagagagagagagagagagagagagagagagagaaaggaaacagtccttttaacagttgattcttttcttatgaattcagtcagtggccaatatgaaaaatgggcctgtctggtgcagcactgggagctgcgtagtgatttttttttaagtatcataattttcttcttttaaaaaaaaacgctttgtcaatttactcaaatttagccctttactttctgccagaattgtgttcagtgataaggtagagtttcctttatccagcttctccttaatgtccagccatactgaccatattttctaaaccaaaaggttgagaagtgctggcattgaaactgcactgcacaatataggcagtatggtaatttatgtctgctttatcagctggttggaaactatgatgctgaaacagaagagtcttcaaaacacagagcttttcccactccataccaatgtatagttaatgagaaaatggcaagtgagccaaaaaggtgttgcagagtattggcagcatgaatgagaaaataaaggactgccatcattcctggtggttgtgattttagtttccagttgttaaaacgacttccaatctaggtatgttattttgggtcagtttattattaagttctcatgtttatgtcaaaactcagaataggagaaattcaccatcaaacatactgaacagcaacattctaattccaatgctctgtttttaaagtggacactgtaaccacaaataaggacatagtcttatgatttcaaaaaattaaattgtctttttgaaaaaccttgccacattattcttattctcattttgcttttgaataacaaaaaattatccaaaattcattttgggttatttggaaatcattcaggtacctcagctattttattttacacataaggaaaacatgactcaaagactatcatttagccagtttgtaaaacgaaactacttttctccgatgtagaaaattagattgaatagtcatcagcatttatgtttattttttaaaattacaagttagtcttagaagtagactaaaagttgtgagcacctgatgagatggaagctttctaaaatcccattatgctacctttttactggccttccaaaccacgttagatctttgatattgtttaaggatgtgtttttggttttttgactgagggttcgaaataaaattagcataaaactctttaagaataattgcatgctattttgtctctcaagtactttaccagctgggaggttttgtaaaattaattgctagctgcatttttaggctccctctgccttcttgtttaaattgaaattattttcttcaaaatatatgatttaagagctctaagaaaggcttgataaaattgactctaactaacactaaaatgcctttgatcatgggaggtagtgtaatttggactaacactgggggctaaactatgggaaaatggcagaataggtaaaacttttagaagacgacgcacattcttgtcatccaggaaagcctaaggatatgtattcgaagtgactcaaaatttttacaaggattttgtagccacagtttcaagtaagacccaggggttccgtttgattcatttctgtatctttggtatgtagcccagtgggtgtcttcccacagggtaggtactcagtttgctctggagggtgactcatacctaaacaagtgcacatctcctttctcagtaaagccaaagcaggtttctacatttggaacaaaagagatcctgaccagagagctatcactggtggtccacttgggccctccttgatgggtgtgttcacttagaaaaccaaattacagatctgaaggctgctgggtagggacaggattagaacaaagggaatgagattgaatgttatttaagggatatttctgtcaagttttggtttctcgatgaattgccattcagtctttgagtgctatttctgtatttctgtcattgttgtttagttttgtttctaaaatgctcatctaggattagagcattctttctttggtcaattcctgagaatcagtgattctacaaaaataatttttttccattgcttattatacacaaaagattgtgctacatattggggtgggagatacaaagatttaaaagaatctttatcgggagatttgcagcctaataaggaagtttgtcatgtaatgacaaattcttattcctccaatttcctttaaaattttcctgtccctttctaaaagcatttcttactactgcccttacttcaaaatgaaatttccaaatgtggttattttatgttaattatgttttagggtggctacttcctggcatcttttaatcacatcagtgaactgtcttctaattaatgttcaagagaggttatttcagggaggatacaggcaaatagtaatttctccctgcgacccaaacttctggagttttttgtttttgcttttgagacagtgtctcactctggtgcccaggctagagtgccatgatgccatcatagctcactgcagcctcgaaatcctgggctcaactgatcctcctgcctcggcctcccaaagcgctgggattacaggcatgagccaccagtcccagccaccagacctgtagtctaacctaatacaaataggcagccagataaactttctgggccttagtcagtttcatatagctttgaatccactgtagttctcccacatctaatttaaaacatctctaccttccacttccattataacactgagaatacaaaaagaacaaatcctgttacatacctgttatatactccagtctaaactagagtcaaagcacagtggctcatacctgtaatcccaacactttgggaggccaaggtggaaggatcatttgaggccaggagtttgagattagcctggtcaatatagtgagaccctgtctctacaaaaaatacaagaaacaaaaagttagctgggcatagtggtgagagcctgtagtctcagctactcaggaggctaaggtgggaggattgcttaagcccaggatttcaaggctgcagtgagctatgattgtgccactgtactccagcctgggcaacagaatgagaccctgtctctaaagatacttttttaaattaaaaaattggctgagcttggtgacttatgcctataatcctaccactttgggaggccaaggtgggaggatcacttgaggccaggagttcaagaccagcctggccaacatgacgaaaccccatctctactaaaaatacagaagttggccaggcatggtggcactgtaatcccagctactcaggaggctgaggcaggagaatcgcttgaacccaggaggcggaggttgtagtgagccaagatcatgccactgcactccagcctgggtgacagagtgagacttagtctcaaaataaagaaaatagcttaaaagaaaaaaagaacccactgaagtggacaacgttttgatagttaaaagaataagctatctcttcctccaaagatatcataaaaatgaaagaatattatacttaggtaataaggtgcagtagtgatcagaatgttatcactctgtatctgtatttaatatgcgttactattctatctccaggttttaaaagtgtttgtgtgaggggagggttgtgaagtcttgtgtattctgatttagaatcagtgtgatagaaccaaaaaggaactttagagattatgtggtccaaagcactccttttacagatgagaaaactaggacctgaagaggtaacttgtgcaaattaatagccaagttgagataagacattgtttcacattattcccactgtgtgtctcttcaagcatgtatgctgtgtttctttcactatgccacacttactctctagtactgaactccactgtaattttagaaaggatgtaggaaaaacaagttggtatatgcatgggagcaggtgtatttaagcccaagacattcataaaacaagagccactaaaattttgcctcagtgccatggggattactttgttctttttagcaactgcagacattattgatggattgatttctacatagaaatactttacatgtagaaataaagagtttgatgtatgaccttttataaatccaaagcaaagaaagtgaatatacatcctagggaaattaagtgctttacctcaaaggaaatctaagtgattttcacactaagtattgaatggtttgttattgatgttttaaaagtacagatattttaattagccaggcatgatggtgcccacctttggccccagccatgccggggagctgaggcaggaggattgcttgagcccaggaggttgatgctgcagtgagccatgctcgtgccactccagcttgggcaagagagaccctgtctcaaagaaatacaaaagtaaaaataaaggtacagatgttttaattcatagatttaaaatgtagtaatcaatgtttaagaaaatttaatacttaaaatagactgcattaaaactaaacagaatttcatcagcattcaaaatatttgcaagatggttccatgcagtatacttaatattttaatttaatttaatttttaatcccccagagcattcttgcaaattgcaattttagtaattgaccaaaaattggacaatgtgaactacacgtagatcacacttagaaagaaatgtcagtgtattccatggaatacattggcctagcagagcttataagatcagctagctccccgaccttatctctcattttcccccttgttcactctacccaagtcatattggatctttacttttcccgaaacacaccagacacactgcagcatcactgactttgcatttgctattttctctacccgaaatctcttgccccagatagccacatgatttgcttcccttacctcatggaagtcttcattcaaatataacctcatcaaagtggccttccttacccattctgtctaagtagtagcaccaccaccatccctgccccccaatatctctataacccagggttactcaacttcagcacaattgacattttaagctgcataactcttgtgttgtacatacaaggaaggggtcatatccattgtaagatatttagaagcatccccagcctctacgcactgtatgccaggtgcttccagttatggcaatcaaaaatgtcccctgggggcaagatagccccagtctaaccccttatgcttttttcttttttttttcttttcttttttttttttttttttttttttgagatggagtcttgctctgtcacccaggctgcagtgcattggtgcaatcttggcccaggttcaagtgattctcctgcctcagcctcccgagtaggtgggactataggcgcccaccaccatacccagctaatttttgtatttttagtgaagacggggttttgccatatgggccaggctgatctcgaactcctgacctcaagtgatccgcctgcctcggcctcccaaagtgctgggattacaggcgtgagtcactgtgcccagcctgctttatttttttattttttattttatatatttttttgagacggagtctcactctgttgcccaggctggagtgcactggtactatcttggctcactgcaacctccgcctcccaggttcaagcgattctgctgcctcagcctcccgagtagctgagattacgggtgcccgccaccacgcccagctaattttttgtatttttagtagaaacggggtttcaccatgttggccaggctggtctcgaactcctggcctcaggtgatccacccgcctcagcctcccaaagtgctgggattacaggcgtgagccaccgtgcccggccacaatacattttcttaaatgcgctaaggtcatcttgagtcatttctctgttcaggttgtttccttctattataattaagtttacatatgaaaatcagtgagacctaaggaacagaagatatttgaaattacttgtgaacatcaaactttattcacaggaaaatatatactcaagtggttacaaccctcaggacattagcctttttctcaataaattaacttttggtcattgatcaggttttttttttctatttttaaaagcttcagaataaacatcattcatttaatcagcacttcaagacatactctgagaaacttcagtagtacaaaaattaaaaggttatttatagagtcatattaaatatctgctttcctcagtagtgcatttatttttataaactctatatttgtcttgaattaatgtttgtttacattaactcttaaaataattggcactgaacatgactgcttaatttcaggtgtactttgaaacagaatcagcattaagttcatataagttctttttggagcaatggaagaataagaaacacaaaattcctatacttacagtagaaattgttctataccatggaagtgttttgtaggtttacgatctattagttctttttttaaaatcctattagcgccaagttaataataattgtattagccaactatgcttccttgaacttagggatgctctttttaagtaaatctacttacacattgcttaaatcacaggatacatgatgtaaaaccttgctttttccatttaaatgtccatttccctttcaaacaactttatgttccccacaataagaaaatattttatgtaagtgagcttatgaactgaacctcaaatgaagggaaatactctaacttctgtctttcaattttttttccttttttgcttgctctccttttttacaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatgtaagtatgtgaaaattcacaattattagaagtagtagatgttccctcgtctagtgggatgttatagtattaagtactgttatgttaagttcttaaatatatcatattagtactgttataacatttctgtcatcctgcccactaaatgtacttcttttagctgctggaatatcttaacaaacgaattgagaaaaagagcactgcagaaacaaagatataacatgataagatgttaaggtgataagttatataaggcgaacagtctcctttcatgtcatcattaaagggcagttatcaaggtgctaagtgacatctttgaagtgttctctctcccgtggtgaacagtgtgctccaaaattttaataatacaccctgactcacagtctcggaagcttcctgagctgaactttctcattaaaaagttgttttccactcttgtggtaggggtatttaactgaaccattctctctaggatgataattttgataattaaaagtttgaagcatatcttttcagtccattggaagaggcatttaacatttttgttttcttctctagtttcatcaaatattcttcaaggttaggggctgagtttttaattctttcacccccccaccccactcccagaacttagtttggtgttctctactcagtgcctggaaaatgtatacatggcacatggttcttcaatgcctaccactattggctgctagcaagtgaggtctagattttttagacttatgccattttcagtctgtatttattgacagtgtatttgagatacgtgttaaaaatagctggctgggtgtggtggctcacacctgtaactccggcactttggtaggctgaggcaggagggtctcttgaggccaggcattcaagaccaacttgggcaagttagggagaacttgtcagcttgggcagcttagggagaccccatctgtacaaaagaaaatttttaattagcccagcctggtagctcgagcctatagtcctagctactcaggaggctgaggcaggaggattgctcaagcccagtagtttgaggctgcagtgagctgtgataacaccactgccctccagtctgggtgacagagcaagaccctgtctctaaattaataaattaattaattttaaaaataaaagaatagttgttgcttcttccctcaattaaggatacctttaagattttattggtgtatttattattaatttaaggctgagtttgactagatcttactagggattcctttcagtatatcacaaactagttatcagtgcctaatatttatcacaaatgtcccagcgctcctatcctcctttgtcatggtttatttttccccaagacaactgaaacgatagcatgtacttccatcagtaactgtggctcaccatagcaagtgaaattttgaaatgttctttccaattagaattaacacctttagaacactgtagtagtccaagaagcaaattgactaagtaatgatgcctactcagctgacagcattttgtgattgtttttaaaatgcacacttgtcggccgggcacggtggctcacgcctgtaatcccagcactttgggaggccaaggcgggtggatcacgagctcagaagatcgagggccatactggccaacatggtgaaacccggtctctactaaaaatacaaaaactatctgggcgtggtggtgcgtgcctgtaatcccagctactcgggaggctggggcaagagaatcgcctgaaccagggagtcggaggttgcagtgagccaagattgtgccactgcactccagcctggtgacagagtgagactccgtctcaaaaaaaaaaaaaaaaaaaaaaaaaagcagacttgtgtcataattataatgatatcgttcctgccgttttcttttgaaatactgatttcctcccaccatttttttgtctccagttatggccaaagccttttgttttgaattctatgttcaatagtaagttgcagtttatttgcaatttgagcacttgcatgttttctgatgtatcacttgctccccttttaactgcatggttaattgtgaatttaaagtagcgcagagcagcagttaactatgattggctgtttttgataaaatgtattgctcagaattttttaatctattagaaagaacagaccaaaatcaataggatttgcagtgtgtcattatattaaggacaaaattgtaaaagtgtctttgaaaatgatcttggggaaattgttaattttgtagattttgaaatgtagtttttacacagctatttgtggcttttaagggaggaggtgtgattaccttagtatattctttaaaagtaaagaacatgcacaataattttggcaacaccagggctttaagaaaacaacattcgtgaggacattttaggttagaatatacattttagaattggaaggaatcattatgtttacactcctacacttttcaaatgaaaagaaacaaacttggatttctgaaaaaggaagtgacttttcctttttgcctaacattacacagaggactagtggctttttccagtacctccctgctattcaagaaatttgaaatatcaaggacagtaaagtaacctacctgaagttttcagatgctactactactatgactgtattaaccaaatgtctgtccgcacccatctgccttgtcatcagtgaaacatcttacaaattgtcaaacaaaatatgggtagagcttagttatccaagaaatagaaatcatgttattcctgttagatattggcataaggaaatagatacaaacatgttcttgcttgttaggtttctgctttttctttgaattgttgcttaaggggtgttaattgcaaaccagactacaaacaaaaacagtttatgttaatttcagagaaatgtctgtgtgtgtgtgcgcgcgtgtgtgtgtgtatggcaaaaaacagtcccaaaattatatgtatgtaaactttaaaggtgaaaattaaatttaataccctgctttttaaaattctaagcacttcaaaactaaaaatactggatttttatgcttacaagataatgggactttttttctttgattgttaaactagtatggcactttcagcagagaagtaagctgcccagaacagtcttggacatatagtaaatactatataggtgttagttgctggggtagttctttctttaaaaaaaaaaaaaagaagttatgtttttcaaatattactaagtttaggcctacaagacattccaaaataatggaaaaattcaatcctgcctctttggaaacattttggaaataagccccaaacactggaagccagtcaattctttttttgcaattctttctgaaatctttctttcttaagtcatatgcctctggattgttttggtttggccactcgtcctgtgttgagctaactctggggtcaaaagaagttagccggttgctgagagtctttgagagaaagaaggcgaaacttaataaaaggaataaaaaacatatatattccataacggagactgaaaaagatgtatagatcaagagtggttatggcttcctgaaaaaagtacagcaggagttagctcacagatgataaagcaagtctttccttgtggagagaaaacagcacaaaacagtgagctcattagtatcacaacgggcagctttgaaaagattcattgagaagactccagcacagtagtcagccttgtgctatctctgatttcagagatttcttgtcaagccaaagcttgtactcaaatagttttatcatccacttaagcgatttctttactaaagtagaaagtaaaatgcaaattcttgtgtagtgaatcaatatcatagacacaaatcttcagttctttcttatcatttttactttttttttttttttgagacggagtttcactcttgttgcctaggctagagtgcagtggcgtgatctcggctcactgcaacctctgcctcctgggttcaagggattctcctgcctcagtctccagagtagctgggattacaggcatgcgccaccacgaccggctaattttgtgtttttagtagagacagagtttctccatgttggtcaggctggtctcgaactcccgacctcaaaccatccgcccaccttggcctcccaaagtgctgggattacaggtgtgagccaccatacctggcccatttttacttttttaaaaccaagggaatagaggaaaatactatgaaactaaaagtttaagcttagctggaataatttatttgaaacaatttagaaaatgaaggtcatgtaacttttgcaagacctttgaaaattaacaaacttaattacaactttgcatttcattgccaagcataagaaggagttttactaaagctatgtaaataattgcattaggatatatagcagagacattctatatatatgtatatatatgtttaatttattttcctttttttttttctgagacaggatcttgctctgttgcccaggctgaagtgcagtggcccatcttggctcactgcaacctccatctcccgggttcaagtgattctcatgcctcagcctcccaagtagctggggttacaggcatgcaccaccacgcccacctaatttttgtatttttagtagagactgggtttcatcaagttggccaggctggtcttgaactcctcctgacctcaagtgatccacccactttggcctcccaaagtgctgggattacagatgtgagccaccgtgcccagcctacttttctagttctagttattagttcgaattcccagacgttctcttttttaaatatgaattaatccttttttctgtgacataaacaaatttggatttattttttagctgaaatcatgatcattgaaacaacctaagttttagaagtaaatgattcttgaagcagaagcactcgtaataagaaaaataactttacatatctcattctgaagctgtaacacttttgtcattgcagggacttgtggtatgttaggcatgaagaaatgcacacctttcagattttaacttattagacaatgaagtagagttcagaaagaagtagactagtgactattgtcttttcacagagcagctgcgttgttatcaaaaggagagctataggatcaaaatgcatcacagttaaggcacagttggactaaaaaatcagattgtaaataaaaatattttaatcatttgaaaactgcctgaagtgtgtgcgtaagctccatactgttgatacttagtgaaagtcagtataatggccatagagcaggaagggtgatttcattggttgtgtttagtatttagagtagtgtgtatgtgtgtgtctgcatacatatacaaacatagacacacacagacatttattctaaaattccacctccaaaattactggtaaagctagcacagaatcacaggtatggaaatactgagtaagcttgattttgtaaaatttaagtgcttactaactattctctcaaacaaaattttatttgtaagtccaaagaaagttaggatttaatttaagaaaggtaacaggaaaaaatgactaagtaatagggccactgacaacacatacagcaacttttctaccagttactaaaagtcactttctctagatggattaattacaaaaaggtaccctcctggaaagacaaaatacaacaaggcactcctttcggtctgacacagtcctgtgcgagacacaaggcttggttagtatagcttgggctggatttctgcttctgctcgtgcctgctctgacacatacaacctgaactgttatgtatattgtaaccctgttctatgaaccgcagacataggctgcatcttcctgagatgtgtgtgtgaatacatatctgtcacgaatgttaaaggtctttgaattgcatttgttcagcaacttttccattaagtcttaagttttctttcaatgaatccacttaaatggaattctaaacgccatttaaagaaagttgtatacggtttctacatcttgctcctgttttactggctttgactaatttagccacgcacattggtggatcaggaacacatttggaattaggtacattccaatacctcagaaaaatatagacagatagaatgtccaatcagatagctacacagtactaggatgtgaaacttactgtgttataacttgcttttgtacaattagaatgttccttactgtgaagagaagctggacttcataaatgccccaataagacaatcactgaaaagcctctttttggtgtttattcttgatagtcatctattactaccagcttaacacattttttaactgcattattctgtaacttttgatttaatgaattcttaatgagctaccccattatactgtaaaatagttttttggttaaatcataaaattttatctttctttgcattaagaatttttattaaagtagggggattcttcaatgttttctctccaggaaaagaataaagccttccttgtttgtagaaaattaacagatttacctgtgcctttgaaccacattagtttttggcttaaagtgagttcaatgcatgtagcgcttaatgtttttgacaagtgtgtgcaattgacattctggtgcttcattttcagaaggggtattgtagtacttgtttagcatttcaaaaactcaagcccagttttttgtatcttttaacatcagctatggaaaaaatgtaagtgatcaagatataaaagaatataaatatgcttattgtgcatagtttgaaattaattgtgaatcaacaaaattactttaattaatagatttttcaagaggtaaaaagtagtgatattgccaagaccttccgcaaagcaatcaacaggaaagaaggtatttgtgctctgggtggaacttcagagttgtccagcgaaggaacacagcattcttactcaggtaatcattttatatgcaataggttaacacaatgtgctaagtgggatggttgctgtaatgtcaaggacgggctctagaaaaacattaccttctaattaagaatacagtagaagtcctttgtgacatgtatttaggcttgagactaatacttgtcataaaggcattataagtgtttattgtatggctttgttagcttgcaagagacaggatacaatccatgtaatgacaggctttattacagtgcattatacagtaatataaatataatttttaaggaattttgtaacttttctgaggactggttaacgtgttctattctttttcttaattttgtaattcctaataaccactgtgttgcatccaagtgtctgggtttccacacagaataaccacatgtttctgacacattaactttcagcactactgcacaactattttaggctttggagtcaaatatttaataagttagagtatgaactaatgtcttgttatttaacataattttagaggaagaaaaatatgcttttgttaactggataaacaaagctttggaaaatgatcctgattgtagacatgttataccaatgaa

SEQ ID NO: 4942 - DNA, 89668 bp, human
aagattccgaggtgcagaagttgtctgagtgcgttggtcggcggcagtcgggccagacccaggactctgcgactttacgtaagtgctttgtaggcgccggcgggcactaggggagcgggtttcctgggcgtgggcaggagtgggtcccggggagagcatctcggttaagctcagcaggaacgtgcggcgcaccgtggggcgggggttgggggagagggaggtcggagaaatttcagttggagccctcgggcgcccgggcgatcggtcgcaaccgaaatgggtgtgagtgacggggagtttccctactagcatccgccgcagacacgttttctgcacttcactgtattaagtggtgttttcttactagttgctcttaacttgttgccagtcttgggctggagtcctagacgccagcccttgccctgattcccctccgcggctgcggccccgaagtggaaagggagcgcacaacttccctctgtcgtccttctccagctactgccatcccctcttccctcccgcccggactcaggaaatcccggagccagcagcctgctactcctccagcccccacacgcccgcctcgggtgacctggctggcttaagccgaccctggggctctggagagggggggccgtggccgagggaaggcacgaggtttgggttgcctgccttctgcctgcttccctcccttgtccttagcgagggcgtcgcgaacgcacctagtctccctatgagtaagcactttttttcctttcagtaggagaacatctctgggctagtaggacagtacctttccgttctcccctggccccacaccccctgtccttttttcagctcctttgactttgcggccccgggcgcgcggtcggggcggcggcagtcccggacctctcccgactcttggagagagagaggcaaaggggcgacgggagggaggtaatagtctacccccccgccctttccccgcacagctgcacttgcctgtgtttacttttctccacccgcagtacttaagcgctgtaatgagaggcccggggacgccgaccacccccgccctggcttctcgccagtcccaaagttgctgccgccgtcgctgctccagtgtgctggcggttccgaccgccgggctccgggacgtaagatgatcccagcccgggaggtggagtgggggttaatggcatctgactctagccttatgcgatgctccttgcctctcacctgagctgcacgatatccccagtggtgcagaaggttgaacttttgcagaaggttgagcttggagctaagtgggttggagagcctcgccatttagcgtcagacagacgggatgctgggggcgcccggcctgttaagagggattgggaggagggaagggagcctggctaacagtaggtagaaaatgtagggaaaagtaaaaaccattgaggggcaagcacttactccactttgctggatgtcacaatggactggggagcctaaacttgatcctcgagatgcagttcatggtgaattccaactaagtggctggagccccacacataccagttggaatcacgtgccccaagtctctgatggtcacatgacgtctttttactttaaagctggaatgtaatggttgaggcccatattccaaaaaccacctctacgtttgaaaaaaaaaaggtggggaggagtgtgaactagcttctaatcaaggaagtctactaggattttggatgaggggaccagaaagggaatttggtgctcagcttttatccaaaacaaaaacaggagctgtttttaaaataagggattgaaatatatgtgagctgggacatgtatctcctctcttcttcaatctcatggtttttctaaatttaaaaaacatcttactaattattttctagggaagtcatcctattactcatgcctcattttgtccctgaatactagatttgaagctaaatcccacaagatagtgttaaaaagtaaggctctgttcatcttccttggtctggcctatattctaattgaactgttccctattttaggcaactacttaaaggtagtaaataacctcttgactaaaattaaccaccagttatttgtggttttcaattaactggattagaaatcatgcacaaaaacagtggatagtaaatttgatacatcgagttggttgggtttttgcctgtcagtggtttggtagaataatgagaggacactgaaacaactttcccatattgacctatacccgcccaagtggcccaagttaaggttgcttctgggaaaacgtggcaatttggctattcagattatatattacagagtatagaagagaggcagaggagcctctgaggtcaggagtttaaaagctttgcttatctgaaaaaaaaagaaaaaacggacctggttgatgcatattcagtcttgaaaacaactagggcagaagatatttaagagattctgactttgtattcttttgccaaaaaccctttgtctcctgcagcagcctctgaatgaccggagcactccagtttcttgctgttcatccgtttctgagcctgaaaactagaacaaccttaaagcacattgttctgaccccaaggctagccttgtggcacagatgagctggaaatggatttaaggtgcacctgagttactagagttaactacactggtagatagacccctctagtggaagtgaggtgataatataattttagatcgaaataataaatgtttaacctcaaaaaaaggaagttattaccactcaactaggttacagtggtagggggataagttcttttttaagtattgtgaaatcatgtctaaacagaatcatcgctaggctctagtccacagcttttcattgtcttgggatgcctactcattgaacaccacccccaatattgctgactttttttggtggtatgatctaatgagcccaaatttttattgaaattagggggctgggagtcaaattcttgatttttactgttagatctagcagatagcaacccctttacctgaggtggggagctattaataaataaataacactttgccttgacttaatacagacgatcaacattgaagtccaaagtctctagtctgatgtaaccatttagattcaattgataaaaatgactaggcttatggcattttgggtagaaggattaattataactagtgagtaataatttgggtgagattaagcctcttccacaagtggttacacgcacattagactttgactgtgactgtttatactggcagaatgtcagtatctagggcactatcagaaacccaatgagatttttctcccaggagaacagaattctgttactgaaaataaaagggcagcttggccatggtgcttgagcaccaaagtggttctttttggtgacactgagagggtacaagaagaaagtccatttgccattatcccatattctgttttaggcattatttctacttggattttcatgaaatgtactgacagtgttcttagcacatatgataaattcatgagtttgctgttgtgtttgatctagcataatctatgtggaatgtataagctgaactgtttcttttttgatgtttggtacagattatgaaagtagctggtataaaataaaatttgaaaatgaatatctctcaatacatgacaacaatggggtatctgtttttagaatcatgttgtctttggtcatatggcaatttttcttttggtgaagagtgatccagaaggcaaaatttttgatctgtgaaaataatacaactcatttagaagaagtcagctgggtcatgttttgagtctgtattattttagacagtgatataccatataatgtatattcagtgtgttggaggtttcaaagctttttggatacattacaatgttggaagatttttatataccagtggtcatgactagctgattttagttatgagagcgctttggttaaagttatggaaacagtctaatcgtgaaatgtcagtcttagaagatctgatcatacttgggccaatttattttagttacggaggtgagacaatttcagaagattcacgataaatttaataataccaaattttgccttagtcttgacacttggaagataaatattagtgagtataaactgttttagggatgaagaagtattgttagtatacaaaaatgaaaatactaattattttagcatgggtcttttagtcctttgcagtctggacagatagattatcttaagtaaatcattgaacttgccctcagaggaattagattctagatagtgctctgccattgactcataatttgaccttcggaaagtcatttaaaattattatattaataactaattgagtacatacatgtgccagacaccattcatgcttttgtttataaaaagagaggattgctcaagctttttggtttgctgggttttattttttcaaatattcataatctggcttatttcacttatcagttgacttttcaaactttgatgcaattgcattgatccaagctaaatactttgttggcaaattgatgactattcaggaaagtgatcaccagtgggttattccatgactaatgttagttctttaaaataaagaggtgccatttatttaattccttgacagggatttttggtgcattaagcctactgattttataatatgagaaaccttacattttcttaaaagtttagaaacgtatttgataataaggaggtagtgttgtttattggaaaagcattgagcatagaatttagggtcttttagtcctttgcagtctggacagatagatgatcttaagtaactcattgaaattttctgtggtcatatctgggtttcactttatttttaagccatgtgattccaatctacatatttcacaggcatggtaaaaggataagtgagaaacgtgaagccttggcttttaagcagacaggtgctatataaattcaaagtactgcagcagtgtatcatagaaacactaaagctttaacaagagtttacagaaatggcagggttctcatcacgtaagtcttgccacatttttctttgtctgtaaaagttctgcacccatccaatttttacaagcaaaggaaaaataaagccagacatattataatgaaaaataagagactaggttgataacaatagaataaaaacctacatgtgatactttcttcttcttttgttttgttctgttttgttttgttttaaagacggagtcttgctttgtcgcccaggctggagtggtgcagcggcgtgatctcggctcactgcaagctcctcctcccgggttcaggccattctcctgcctcagcctcccgagtagctgggactacaggcgcccgccactgtgcccagctagtttttttgtatttttagtagagacggggtttcaccgtggtctcgatctcctgacctcgtgatccgcccgcctcggcctcccaaagtgctgggattacaggcgtgagccaccgcgcccggcccgttttgttttgttttgttttgagatggagtctcgctctgtcgcccaggctggaatgcaatggcgtgatctcggcccactgcaacctctgcctccgggttcaagtgattctcgtgcctcagcctcctgggtagctgggattacaggcgcgtaccaccacgcctggctaatttttgtatttttagtagaaatggggtttcaccatgttggtcaggctggtctagaattcctgaccttgtgatccgcccgccttggcctcccagagtgctgggattacaggcatgagccaccgcgcccagcccatgtgatactttcttctatttcttacctcaaatattgtgcaaggtagcccgttaaagccattaattgggtggtgtttttcccctttttaactaactactgagtagaattttggtcttcagtggtaattgttacagagtccattggcttaccatacctcatttttagttttgtgattgcccataatgggaggtttcgtgtaaaaaacctcataaaaaatcaagtttttcctcctcataattgcagtctaaaggaggacaacacgcaggtctgggaaactgcatagtggaagagataatctatacatttaagtagcatgccatgaataacacaaaaaatggcctggcacggtggctcacatctgtcatcccaacactttgggaggccgaggtgggtggatcacttcaggccaggagaccagcctagccaacatggtgaaaccccgtctctactaaaatacaaaaacttagccaagcacggtggcacgggcttgtagtcccagctacccaagaggctgaggtgggaggattgcttgagcctgggaggcggaggttacagtgagccgagattgcgccattgcactccaagcctgggctaccgagtgagaccccatctcaaaagaaaaacagaaaaacaaacaaacaaacaaaaaaaaacagaaaatgtgggaagttaagttgaaaaataaacaccttcaaagctattaacttggattttcttttcttttcttcttcttttttttttttttttttttgagtcaggttctcactctgtcgcccattcatactctgtccagttcattgaaaatacaagtctgattcccttgagttgtgatattcatacacacacgagtatatatacacttatgtgtgcatatgtatattatataaagttttacgtgatatataatataagtttttactttctgtaaaataaaatttgttagggccgtataatagttttgaatattcatattattgtgttccacattataagctctaattacatcgtgttgcactcagattgacattctgctgttgacactgaaaataacgctttcattcatagatgaatgtaattttcaagctttttttctatatttcttaacttgcttgaatgttcccatttttgccatttcttgttgttcattttaacattttggggcttgtgtttcagatcaggaagaatcaccattatagggtgcaaagagtttgctcagaggtgaaaatgatacgaaattgtccctagagcacatcctattgctatactattcaacatgtatgaattaatctactgggaaagtgtcttgtgtagtgtgtactttaaagatgttttcaatcactttgctttggattagaaaaattcaaggtaactataattttaaatgctcatatttttatgtttattttatatgtaggaagagaaatttttaaaaattggaataacactatatcccattcttttcatttattacattataaacatgtttccaagtgatcaaatatttttaaaaatgtttaaaatcactgcagtatattttatataatggctgtttcataatttatttcactaattccaagttgttgaacatttgtttccatatcttatagataatgcttcagtaagcattcttgatcgaacatcattttgcactctatcattttttagaagtcaccaagaatgttttaaagatgaattcctttgatagtccctgaaatttaaacattggcttaaacaaaaagatagccttgatttcagtggcatttaaaaaaagaaggctgggcatggtggctcaggcctgtaatcccaatactttggaaggccaaggcaggcagatcacttgaggtcaggagttcaagaccagcctggccaacatggcaaaactccgtctctactaaaaatacaaaaaaactagctgagcatggtggcgcacgcctgtaatcccagctacttgggaggctaaggcaggagaatcgcttgaacccaggaggtgaaggttgcagtgagccaagattgcaccactgcactccagcccgggcaacagagcaagactccgtttcaaaaaaaaaaaaagaagaagaaaaaagaaaaggccattctttatatagtgtattgtatcatatgtgactctaaactggaacttgtttaggtaaagtatatgtcttggaagtattttggttttctctgatctagttagcaggtgcagagcaggatgaggtaggattctgtgctgtgtacaatcataggaagttctgttttttgaaacggaactgttaatgggggaagggagacacgtttgtttttaagaagcctttatgtttaatattattataaaactcagttcaagtatacaaagcttatttgtgcctatgaacattcagtatcctaaagaaacatttaatcctggtgttggctaaatgactatttgctgatatgcccttttatctcaaggctattagtttcttaaagtactttgatatcactcaataaactacagttaaactcagagttttacatttcattcaggttgcttaaataatataactaaacataggtccaataatagtaaaaattctgatgctgtcacttaatttgtgcctggtttcagtatatggcgattgcttaaattacaagcacttgaatttacaaatattttgtgtatttaaatggctcattgtacattacatatccctcctgaaacttaacccatgccatttcacagacccttccatggtgtttttctctttcctccagttcactagcctcactcaccaaagactttattggtctgggaattctattatgacccagaagtgacttggaaggttcctttcacccaacaacacattctcactacctttcttttcttttcaggggcatcatttacatgctatgttgcacagtcagaatggattttagcataaagtatgggttccaatagctctcgcattttattatttatttatttgtttagagacagagcctcactttgtcgcccaggctggagtacagtggcacaatctcggctcactgcaacctccatcccccaggttcaagcgattctcctgcctcagccttgtgagtagctgggattataggctcctgccactgtgcccggctaatttttgtatttttagtagagatggggtttcaccgtcttggccaggctggtcttgaactcttgacctcgtgatccacctgcgttggcctcccaaagtgctgggattacaggcatgagccaccgcgcctgggccagctctcccattttatatctctgtggcattgaggaggtttcttaactctctgaacttcagttaccccatgaataaaatgaagataatccactcacttttcactttgttctcataattattatatgagaacacttataaagcaactagcatatggtaggtgctcaataagtattttcatttacaggttgattaatgttgccttagatgatttttgtcaggcatctatatctacctctttttctctaatttgagtaccttcctaccttcctttttttttttttttttttggacagagtcttgctttgtcgcccaggctggagtgcaactgtgcgatctcagctcactgcaaccttgacttcccggggctcaagcgatctccgtgcctcagcctcccgagtagctgggattacaggcgtgtactaccatgcctggctaacttttttttgtagtttgttttttagtagagatgggatttccccatgttgcccaggctggcaagattttagaaattagtggggttttttgtgttttatttaatggtattggaaaaacactccttttattgtttttcattgtgaatgtgaaggattctagccatgtttcaggttgaagaagcttcttcgcttagctcagaaacctgtttatcgtttaatttattctttttttttttttttttttgaaacggagtctcactgtgtcgtccaggctggagtgcagtggcgcgatctcagctcactgcaacctccgcctccgggttcatgcgattctcctgcctcagcctcccgagtagcagggactacaggtgcccaccaccatgccctgctaattttttgtatttttagtagagacggggtttcactgtgttagccaggatggtcttgatctcctaacctcatgaccacccacctcggcctcccaaagtgttgggattacaggcgtgagccactgaaccctgccatttaatttattcttttgtgaggatatgtggagaactagccaagacccgtcacagtggtttacgcgtgtaatcccaacactttgggaggccaaggcgggcaaatcacttcagctcaggagttcgaaaccagcctggccaacatagcaaaactctgtctctactaaatatacaaaaattagccaggcgtgttggcccatgcctatgtacccagctacttggaaggctgaggcacaagaatccctcgagtctgggaggcggaggctgcagtgagccaagatcgtgccacttccctccagcctgggtgacagagcaagactctggaaaaaaaaaaaaagaaaaagaaagagagaaagagaaaaggaaagaggaaaaggaaaaggaaagaaacaagaactcaccttcaaaggaaaattggaaacatggctcagtaaattacagacaccgttataaactcaaggccgctaacaaatacagcttaaatcagaatgaaaggtaataggtagtgttgatacctgacttgtggaggaggaaaaaaaagtaggggcaaagagaaaatatattattgaaaacttaaaatgctgaggatggcagagggttataaagtaaaccaatatgttttcatgatgacatgtagcctttaaaaatggctgaatctaaaacatatttatgatgcccattattttatctagtggaaattttcaaaagcaaaaaccaggaaatgatgaaggctattgacacattcagaaaatattctgagcagtttgtgggtctccattgtaaagctacagttgaatcatttttacaagtgggtatgaataattacaattttatattttgtcctgtggtaattaaaaagcaaatagagccaaattatcattaagcgtaactaacagaaaagtaatattgatagatttacatgtttaaaaatataagccaacccatgcattcagtattttatcctcaaacaaggtgttccagctttagttgacactcagataaaaagcaaactagtggctgggcatggtggctcacatctgtaatctaagcactttgggaggctgaggcaggaggattgcttgagcccaggaattcagaaccaacctgggtaagatatcaagaccctgtctctattttttaaaaaataaaaatagaaaataaattttaaaaaagcaaactagaatatatctagtaggtgctagcagaaggggaaaaattctctaagcagagatttgtgtaaaaatgaagggaaggttaataagtatctagaaactgtaagtgttgtataaaagaaggcttatagaccattggtaaatagatgtaaaactcaaggaaacttttaaacgtgcccaaagttcttaagtatatattaagatggtacaaactacagatgaagtaatagttaaccaaatatactaacatgcacaattgcttaattagtctatttgtggaatggtttcattattcattcaactaccataagtttaatgcagactgttaggtgctagggctacaaagacggataagatactcctccagtctagtagaacagaaagacacaaaaataatcttggttctcatgaaacctaaaaatattcataaatgtagaaaatgaatttagaccgtgcccggtggttcatgccagtaatcccagcaattagggaggccgaggcaagtggatacctgtggtcaggagttcgagaccagcctggccaacatggtgaaaccccgtctctactaaaaatacaaaaattagccgggtgtggtggcaagcgcaagtaatcccagctacttgggaggctgaggtgagagaattgcttggacctgggaggcagaggttgcagtgagccgggattgcgccattgcactccagcctgggtgacaagagtgagactccgtctcaaaaaaaaaaaaaaaaagaaaaaagaaagaaaggaaaaaaaaagaaaatgaatttaaatacagccttttttctcagcataaaataatttctaaatataaaccttgtgtgaacaaagaaattcacttataacccaatataatcaaatctaaactaagaacaaatctcatttaaacattgttatttctttgcaataattattgcataccaaaaaagagcccactatgagttaatgttacttaaatagaacattgctcagcctacaaatgaaggtcagcagacaccagtgtcttggaataaaatagccctttggcaagaaaacgagccacaccccattaagtttttacaaaaataaaattctttccagctttactaaattgtagatgttgcgcccagcatgtacttctgcagtagttgattctgcagctgtggaaatattcatgtatgcagaagtccccaaaaacatctattcaccattacttgcacatgcagctcttatactttctgtagtaaagtattccgttaagttttattttgactcgtggataatagcaagcaactacaggtatagctgacaccttaatttcctgccttgaacttctggccacagactttatttttttattttttgagatggagtatcgctctgttgcccagactggagtgcagtggcataatttcggctcactgcaacctccgcgtcccaggttcaagcaattctcccgcctcagcctcttaagtgcctgggattatggtgcataccaccatgcctggctaatttttgtattttttagtagagatgggttttcactgtgttgaccaggctggtctcgaactcctggcctcaagcgatctgcccacctcgacctcgcaaagtgctgggattacaggcatgagccaccttgcctggcccattgtcacagaattcaaattgagcaggaatacgtaggatttcaaatctaacagttgtttcatttggtgggatagcatcaaagccatgtactgtgaccactgtatatggttttcttcaagagcagcaataaatttctgccatgtaccatgggaaagagctgtacttttagggagaaaggaaataagccctgagaaaaagccccattttcctagttcctttcacagttcacctggcacacaacgggtcttgatatttatatttgaaagagtgaaacatggatggccataaatgctccttgctgataacgattgaattgggaaaatctaatcaggaaatcagtgatttatgaattacattgcataaaatacataatgatgggagcctgtaagaagactaaacaaatggcttccttagtttatttttcctttaggttttagttgttttcagtgaatattatgagtgaatgttatcgatagtgttttcattgtgagaactgctaaactgtagagtcaaagaagaaattgggacatattaatattttgacttttatgccagctttattgagacataatatcatactttttttttttttgagacagagtttcgctcttgttgcccaggctggagtgcaatggcacgatctcggctcaccgtaacctccgcctcccagattcaagcgattctcctgcctcagcctccctagtagctgggattacaggcatgtgccaccacacctggctaattttgtatttttagtagagacagggtttctctatgttggtcaggctggtctcagactcccgacctcaggtaatccgcccacctcggcttcccaaagtactgggattataggcgtgagccaccgcgcccggccccataccatctatttttatagattttagtatattcacagataacatgcaaccttcaccagtcaattttcaaacattttcatcacctcagaaagaaaccccatacactttagctatcaccttccacagcactctacccctgcaaccctaagcaaccactgaactatttcctgtctccattgagttccctgttctggacattacatataaatggagtcatataataggtggtattttgtgactagtttctttcacttagcctaacattttcaaggttcacacaccttgtagcaagtatcagtactctattcctttttatggctggataatatttcattgtacaccatattttgtttatccatttgtccatcgatggatatttggggttgtttctacactatggctatcataaataatgggacatgcaaacattaagtgtctatccatgagtcccctaatgagttagaggtggtgctgacaagataacatttcacttattaccactctgctcttaatataaatccttgctttgattaagcactaccgatttttccatctaagtttttttgttattttttgttccttgagacggagtctggctctgctgcccaggctggagtgcagtggcaccatctcggctcactgcaagctccgcctcccgggttcacgccattctcctgcctcagcctcccaagtagctgggactacaggcgcccgccaccacacctggctaattttttgtatttttagtagagacggggtttcaccgtgttagccaggatggtctcaatctcctgacctcgtgatccacccgcctcggcctcccaaagtactgggattacaggcgtgagccaccgcgcctggcctctatctaagtttagctattttttttcttgtttcctgatgcttattggcttatcatcgacttgttctcaataacgttttccttagtagtatttatactggaataatagaaagcctgtaaatgctgtataatcatcttttctaaaacttattgtataataaacatttagcacagttttgtttaatcacattttttgaacactaaggagcaaaggcaagcagtattaaggagtacaaaagtacatgataaatgctttgaaatgcaatgggttcaatcaaccaaaagcattattgagcacagctaatatatttacttttaaatgtactattcaagtgtgaaatatatccatatagaacaaaattcaaaactcacaaagggccataatgataagtaaattagcctctaacacttaatatttttaagaagacattagtgttttacgtttaggtattttgacagtaagtttgagggagtctttatcttttgaccttttggggtgaatatgagaatgaaggaatataaaaagatgattaaaagaatcaccaggccggaaatgacggctcatgcctgtaatcccagcactttaggaggccgagacaggagaatcacttgagctcaggagtttgacaccagcctgggcaacatagcgagacctcatctctactaaaaataaaacaaaattagccaggcatggtggcgtgcgcctatagtcccagctactcaggaggctgaggtgggagggttgcttgatcccgtgatcacgcctctgtatttcagcttgggtgagagagatcctgtctcaaaaaaataaaataaaataatttcctgcaatttcagattattcttttaagcacccttgaccccagattcaccagatcaaaacagctaatgactcatagaactttactctgtcattattttccagattcaacccacagcgaaatttttgggatccagtctccttactcttatgggcaggcggaaccttgcagatcctttaggaaaggataggcttccctgagaaaggtgggctggagttaagtcaaaaaaaaggtgcaactttctggagtcccatttagaacttcctgcgtatttaataggcctttgctaattattaacaatgtgcctggcacactaacataaataaaacagtgtgccatcgtttgaagagctgagtctaatccacctactgatttttacaaaggaggcaactgaagtctgattttggcttgcctcagcatagagtgctccaggacaatggtggaggatcaggtcgccatcactggagacccagattgtagtaatggaactgatccatcattcttctcactatatatttaaactccatgtccagggtcaactttgtttagtagcagtgcctcttccctgaatcagtttgtatctacacttaatttctttcagagattaataaaatgacaaatgctatctcaataaagttaccatgaactctctgaaactcatatcacccatgactaaagcaacttgctttgagtctgacaagctcttccctagctaatggaaatgcattagcaatagctttacagtggtaagctatttttctaggtcatattcaacccagagtagtcacatgctgacaaaacttcaatcctaaacactgatcataaagagtttcctatattgtatgtaatatatccaaaagtttttgaaaactctaattccagtatattgaatatacattatagggtttatcactcctgatttttttttaattgagacggaatcttgctctgttgcccaggctggagagtagtcccgtgatctcggctcactgcagcctctgcctcccaggttcaagcagttctcgtgcctcagctccccaagtagctgggattacaggcgtgcaccaccacgtctggataatttttgtgttttttgtagagatggggtttcgccatgttggccaggctgatctggaactcctgacctaaactgatcctcccgcctcggcctctaaaagtgctgggattacaggagtaaaccaccatgcctggcccactcctgatttcttctaaactggattttatcattctcagagtcagtgtttcctctctgtattactccttgcctagaaaaaaaaatgtccatttcattcatctattcattgacttattcaagtacttaccgagcaccttatatatgtcagatactattctaggcactggggattacagccgtcaatgaaacagacaaaaatcaccgtctttatgaagcttacatcctactaggggagagatagaaaataaacaatgattttatatattagatgctaatgtgttatggagaaaaagtaagattaatggtataggaagtgggaagaagggtattgccatttcaaaatatgtggtcacagaaggcattactgagagggagatatttcaggcaagatatgaaggaaatcaaggagtatccatgtgaatgtttggggagaagtgtcacttgaacaagtaaaaaatatttctaataacagatacctaaatcatcatacattgatgtgtttcagccctgaaattttcctttatgacaactcctttttattttggtattgaacagaaaaaaataactttcacccagatcaaacactctagtggagtcatgaactgactatatatgctaagaatattgtgtcagaagttatgtcaaaaaagttttgaaaagataaagctaggcgtggtggctcacgcctgtaatcccagcactttgggaggctgaggcaggcggatcacgaggttaggagatcgagaccatcctggctaacacggtgaaacctcgtccctactaaaaatacaaaaaattagactggcgtggtggcgggcgcctgtagtcccagctactcgggaggctgaggcagaagaatggcgtgaacccgggagacggagcttgcagtgagccgagatcacgccactgcacaaaaaaaaaaaaaaaaaaaaaaagataaagtgggaataatgtttaaagcaggatatagaattaatacaagtaaatgttcttcattttccctattaatttaattatactatattctgtgtttaattctgaattagattttttaattaaactttttattttgagataattgtagattcacacctacttgtaagaaatggcacaaagagatcctgtgtacctttacccagtttcttccaatggtaaactcttaaaaaaccatagtacaatagcaaaaccacaatgttgacactgatacagacaagaggcaaatgagtttcattaccagtagaatcccttttattgtcctttgataacaacacacacctccttcctcccctgacctccatttttgaccccaggaaaccactaatctgttctccatgtctataattttgtcatttaaaaatattatataaatggaatgatatatagtatgtagcctttgggaattagctttttttctctgagcgtaattctcttagagattcaacctaagttgttgtgtatgtcaatacctcgttccttttcattgttgaatagtattccatggtgtgtatgtaacaaagtttatttaaccattcacccattgaaggatatctgggccatttccagttttttagttatcacaagtatttgtatacaggtgttagtgtgaacttcagttttcgtttctctgggattaatgccggaagagtgcaaatgctgagttgtatgagagttgcatgtttaattttataagaaattgccaaagtgtttgcccagagtgactgtaccattgtgtgcttccaccagcaatgtatgagtgatccagtttttccacatccttgccagcctttggtggtgtcactgtttttcattttagccattctgataggtgtgtagtgatagctcattgtagttgcattttcagtttcataataactaatgatgtttaacattttttatgcacttatttcccatctgtttgccctcttcagtgaaatgtctgttcatgtcttttacctattttctttcatttttgagacagggtcttgctctgttgcccgggctggagtgcagtggcgcaatcacggctcgctgcagcgtcaacatcctgggctcaagtgattctcctgcctaagcctcccaagtagctgggactacaggtgcacaccaccattttattttttgtagagttggggtcttgttatattgcccaggctgatgtgaaacgtctggcctcaagcagtactccgcccttggcctcctactgtgctgggattacagacatgagccaccatgcctggcccttttgtctgttttctaattggattatttgtgtttttactgttgtggaattttaagaggtctttatgtattctagagtctaattctttatcagatatgtggcatacaaatattttctcctcgcctgtagcttatcttttcatcttctgaacagaatctttcatagaacaaaaggatttatttggtgaggcccactttatcagtatttccttttatggattgatttttggtgtcatgtccgagaactcttcatcaaatcaggttcctgaagaatttctctttcccccctaaagttttatagttttatgttttacatttaggtctgtgatctgttttgagctaacttttgtgtaaggtgtgaagtttgggttgaagtttcttattttttgttttggactgtgtttgtcctcgtctactgacatggttttttgcacccttgtgaaaaatcattgaatatatttgtgtaaatctgtttctgggttctcttctgttccgttgttttgagtatctgttgctctgtcagtatcacactgtcttgattactgtagctacatagtctgacttaatgccaggtggagtctattcaccttatttttcaacagttttagatgttctaaggcttgttcctttccatgttaatttttaaaagaagcttgtctataactacaaaaactgttctaggattttgagaggaattgatttaatgaattagacttttgaaattgcatatgtaatgttaataaagttaaaaatggtaattctgttaaggaaaacaatttagttccttccaaagtctaacgctagttcttattttctgaagaaatgtgtatttttatgattttgaaattattgaatgaatattaattagcagtttcttttttattttttaaattttttgtgtggagatggggtcccactatgttgcccaggctggtctcaaactcctggtctcaagcaatcctcccgcctcagcctcccaaagtcctggtattacaggcgtgaaccaccatgcccggccagcagtttcctttcagccataacatgaatgaccttttttaatggccaaaattgaagtttgtcaggttctaaatcactaatatgtttttgaatttaaaaatttttgaaggtttacttctggaatttttaagaccaaccattagatttataaggctgttaataagattcctaaacctattgttttgccttaaggaaagtatggtttaccttttgtgttatcccaaacaaattcatctccccatatagcaaaatggaatatgctactaaatagttgaaatttagggtaatggagtttgggatatgtttattattcatgaatagtaagtcaaaagtttttaaatgaaaacatttgtgtattctcatgctttgattgttgattctgcaaaataaaatcttaaaaattacaaaaagcatctgataaacttcttaatttaaaagaacactcagaaatttactttcaggtatttaaaaaaagagggaggctatcaaactgattaggactgaagaagaactgaagagataatgtcaccttgttggttttgggtgagggaaaattgaatgagatcatgctttctttctgtcttgctttctcaagataaagcttttccactcttctgtctgcttactgattcagggtggcaggcacaaaacaaaacgttccggttatattttccatcctgtttatatttaaattggctgtttattctttaataaagtgtataactgttggtctataacattatgaatgtgggattaagtggttagacttagcaggaatttgaaaatcagggtccaaatgtactaccctaagtacagtagcagaattacttctataaagaaaacttccctaagttacagcatctggctcatagcattatcattacagtgaagtttaccatcactcatattagtgatgtgttacttcccacttactcctaaccctgcttaggtaatgcaaaactataatttagaaagtgtgatttaaagaagatgcaatataatggtactcattgtaaacatatatccagatttctttcttcacatataatttatctgtatttttaaatttattttgtctaatgaaagacttttaaaagctcattctctcgagcagtgaattctcagctagtgagccaggacagtctgcctcatcaaaagaattctgctaattgctttagccaatttctgaggtaataagctgggagagggaagaggttggttactcatgcataggtgactttttgctaacagtgtgatttttaggaagtgaagaccacaaaagctttttgacttgtggcagaattcattatgatgagactttagctgtaccaggtaacagattgccaaataaaacaccaaacaagcaagattggtcagttacaatccagtctgtagtagtctgatccagcatagtgttatgtttatggattcaattccctcctcgaagtcatacaattgaggcatctcagtagaaataaaacaaaataaacaaattttgtagggaagctcctatacatttgaatggtaagggcatataactattaatactttatgagaccatggtattttgcagccaatcttaaggataaatctacattgtgttcaggattctgtgttgggccagacttaacaatgaccattatgtgtagaaaatagcaaccattgttgctgaattaaactctctctggagatttaaacatttttttaaaaaattaagctaataggccaagcgtggtagctcacgcctgaatcccaacactttaggaggccgacgcgggcggatcacttgaggacaggagtttgagatcagcctgggcaacgtggcgaaagcccgtctctactaaaaacacaaaaagattagccaggcatggtggtatgcatctggtcccaggtactcgggaggccgaggtgataggatcacctgagcctgggggaggttcaggctgctgtaagctgtgattgcaccacggcactcagcctgagtgacagagggagactctgtctttaaaaaaaagaaaagaaaagaaaaagctaataaaaccttgatgacaacatagccaaagaaattaatcagagaagagtggtgattagaaacagaaagcatagtggaatagatgaattacacctggcaaaggaactctaaactatattatgtaaagctcaggacagtctacttgtctgaaaaagaaataccaaaagtatacacatgcaaaaatttggatttttcagctggactttttgtgaaaggttccctcccaccccaaattcaaaagaagtataaagcaggccattcatggcaaactcccaatgaaatggaattaatttgtattgtgttttgaaagtgtatatatgtgcttgcaggaattacatggaagaattatactgacatagagtggctctcaaagtgaataatggaatcttaaggatgttttattaaacagcgagtcaactatttttctccgtgaatgtgactccacaatgatagtggaagtcagaaaatatttcacatgcaaatatatctgaaattcttcatggatgtatttaacgctttgaagtgatggcaacatctggtagcaagtagaagccagcgtcttaaaagctatggcttcatgttactacttcatctgaattagtcatttaaaggggattttatatgtcttcctaaaaactgacgaggttaatcttagactagggcaggctggcaggaaatgctaaagcggctctttcttttgaaggttttgttattccttgtgaggtcaaaaagtagttgttttaaagtttggaaagctaaagcagtgatgttttgactcttgacagtgagatgtttttctttttttttgggggagggtgtgtgtggcaagtttgaggaaaaacttgatacactgagagttctttatactttccactccacttattttctctcaaatgaatttattttctaaaggtgcagaatttagaaattcgtttcaattaccaaatctgagcatggatttggtgctattagaagatgtaaccaccatgtgtttggccagattagctttcaggaatgatcgtatcttacagagttagccaatggaacaagagtagatgccttttatccttatttatttgctttgcattaaaaagacaaatgctgaaagtttattcttgactatgaaataaaccactataatatatgacactgagttaattcctttaggatgctatgtcttccacatacatccatttaataaatatttgttgagtgcctactgtatgccaggcactgttctataagctgaaaatagattgctggacaaaacagacaaaaaatcactgccctcttagagcttattaaatacgaaaacagtagagcaatttaaaattatttaatgctatcactcagcttttaaagatcttcactgaatgagttttgagaacttttgcacatattatctacagcttgaatagggaaaaaatgacattttgtttgaaatctagttcaagaagctagaagctgataagtaaagtaaatattttattctgtgatgatcattttcagttttcatttatcagtgttatacttaggcctcttgaggaatgttactagtttaacttgtggatttcctcctgaggatgggcttaatttgtattgggggaggtggtgaaaggacctagtagccctggaatttaatgtaaagtcgtggcatttgtaaaactatcttctgtcatttgaaaaattatagaatacttaaatgtatttaatgctccctgtggaaaatgaatgtattgctcagttatttttgcctatgtgagtagtacaagagctgactcaaaggagatgacatgatggttcctgtcctgaagtgaaataagatgatgggttgtggtggaaaaatgatgtggtcatgcccatatttgctcacatctcttgttcgtttccttttatagagggaaaccagggaaagtctcatttcttattttttgtttcctttttgtattttctttcatacgccatttccctttctttttttcttaaaattgcattatagtgacttccaattcaattggctcaagttgtacttggtaatgacataaagaaataccgcttagaaaggtcatagtggaagcattatacccattttagggaattgattatatatatagacacagccactctgagccccttgaggatatgaaaagcatgttgcagaaatcctcatatttcctgatgccaactagtatagtgccttttacagaatatatgcttaatcggtatttatctattgaacaaatatgagccatgaaatttaattttgctctccaaaatcccaagtcctttatataagtaggcagaaattttaaaaagtctttttttttgtttgtttgttttttgagacagagtcttgcactgtggcctgggctggagtgcagtggtgcaatctcagctcactgcaagctccgcctcctgggttcaagattttctcctgcctcaggctcctaagtagctgggattacaggcacccgccaccacgcccagctaattttttgtatttttagtagagacgggatttcaccatgttggccaggctgatctcaaactcctgacctcgtgatttgccctcctcagcctcccaaagcactgggattacaggtgtgagccactgcacccggtctaaaaacttatttttatggaattattcaaatacataatgtaaaatagcattaaaaacccccagctttaacaattaccagtatttcatgttcttatttcatctttgctctccccttttttgagatttgctttaaaataatccgcatattgttttaccgataaatactatagtatacttcttagtttttaatattttaagatagtagtgtttgcatttcatatggagttttacttttaaaccctttctgtgctactttatgcaagagaaagaaattcttaaccgcttatcagaagaaaaatctaatttttttttttttgacggagttttgctcttgttgcccaggctggggtgcaatggtgtgatctcggctcacagcaacctccgcctcccgggttcaagccattctcctgcctcagcctccgaatagctgggattacaggcctgtgccaccacacccggctaattttgtatttttaccggagacggggtttctccatgttggtcaggctagtctcgaactccagacctcaggtgatccacctgcctcggcctcccaaagtgctgagattacaggcgtgagccactgcgcccggccaagaataatctaatttgctgtgtatgagtaggatgttaactcattttgtaacatatatttcctttcttaatcttttaaaaaattttattaaaagtttctaaacaggccgggcgctgtggctcacacctataatgccagcactttgggaggctgaggcggacaggtcatgaggccaggagttcgagactagcctggccaacatagtgaaacccggtctctactaaaaatacaaaaaaaaaaaaaaaatagccatgtgtggtggcaggtgcctgtagtcccagatacttgggaggctgaggcaggagaatcgcttgaactcgggagggggaggttgcagtgagccaagattgtgccacgcactccagcctggaggatggagtgagactccgtctcaaaaaaaaaaaaaaagtttctaaacaacattgtacatgttatgtcatgactgtcatgataaagtcttgccttttagacatgaacctgattcagcaaaatgtgctttgaagtagataagctgtagatttttgtcttgcctgaattgatattaaagagatgttttttcttttcacagttcaaaagtacagaactcaggttaaaacctagatatgtaattttgttaattttattttcagtttgaaaattcttgttaaaacctgcatactttataggtttgctgtctctaaaattagatggctccttcataaatattactgaataaagcaccagttttcaaaaagtgtggcacatgggctcatgggggttaaaattactttcatgataaaactaaattgttatttgttttttcactgtgttaacatttgcactgatgatgcaaaagcagtagtgggtaaagctgctgaatcaagatagtggccccacactgtagtgatagccactgtattcctcagcaccataccatcacctttagaaaaaaatcttacaacatgcatttcatttacaaatgtacttgatgaagcaggaaaaaataattgtattaaatctcaattcttaggtatgcatctttttaaatattgtgtgtgatgagataagacatacccataaagtatttctgctgcatatggatatatgacgattgtcttgagggaaagcacttgcgcagctgtttgagttgtgagctaaactagctgcctttttaaaaatagaaaaccaggccgggcgcggtggctcacgcctgtaatcccagcactttgggaggccgaggcgggcagatcacgaggtcaggagatcgagaccatcctggctaacacggtgaaaccccgtctccactaaaaatacaaaaaattagctgggcgtggtggcgggcacctgtagtcccagctacttgggaggctgaggcaggagaatggcgtgaactagggaggcggagcttgcagtgagccgagatcgcgccactgcactccagcctgggcgacagagcgagactccgtctcaaaaaaaaaaaaaaaaagacaaccagttttactttgaaagattgaattaactgattattcagacccgagtatctaacagatactttatttttaaaaaatgaaccaagtgtgcctctcactgcaagggaaacaactaagagtatttgttgccaatgctaaaattagagctttcaagcaaaattcaaatttttgagaacttgcattggtcaccattttatccgatcaatacttaggcttttctagtgaaatcgacagtataattaatgaaaataatgtgttagattttgtataatgaaatgtatcagcatttggaagacccacataacttactgaaacaatatttttccaaataactaatgtatgatgttacaaaatcaagcatgggtaaaaggcccattctaagtgcaagacagacaaatagattttgaaaaaatcattgatattgtatcagactctacattgcaaccaacctttgaaaaactaccacttctctcgagttttggtgtagtattgaagaatatctgtaagtatctggaaagcctcttaaagtatttctttctttttacaacagtttatctgtaggaggccagatgttcttcatgcactggaaccaaaaccggtattgcaaaagattgaatgcagaagcagatatgaaaacccagctttcttgttctaggttaaacattaaagcgatttgcaacaatgtaaacaatgccacccttgtcactacactttttttgaaaatatagttatttttcattaaaaagcttatgttaacatgtaatgggcttattcttatttttaaacaaataaatatcttaaaagtttcgtagtcgcaatttttgatgtgacaaatacactgatagatctaacccatgtgtcaccaaactctttgggatcctcagatcctgaggccaaaaagtttaggaactgctgagttgggttttttgttgttgtttccctccttatccctttgccccacccctccacttttctcctattcccctctcctttcttttctttttttgagtgagagagagaccctcaggatagaaaattgtagagcatgtgagttattcctttgtatgtttttattagctacgaactgaacatgtatgtcttttaaattcattcattgccccatgtgtagttcgatgtattttgaccttttcttttatttattttaaaattttgattacttagttacacaaataaagagctaataaatactatcagggagacagcccttggaatattgaattttatattttcttctgcgacagtcttgctctgtccgtgcagtggcaagatcacagctcacctcctgggctcaagctatcctcctacctcagcctcccaagtagctgggactacaggcgacagccaccatgcccagctaatttttttgtattttttttgtaaagacagggttttgccatgttgcccacgctgctctcgaactcccgggctaaagtgatccacccacctctgcctcccaaggtgctgggattacaagcaccagccaccacgcctggccagaatattgaaattaagatatattctgacttatttttccccaaatatgaaaaaaatgattacatatatgacttgattattaaaattgacacatccatgcaacaagtttatatacctaatgctgtgcctggtatgaatttcctaaactttccaatatagtcccaaaattacagtagtagtttcttgaatgtaaacttgttgcctgttttatatgttagatccctttgcttctatgcttcactcactatgtttgtttgttcgctttgtttttataagtcatgaagatggaaaaaaaactgtttcatgaaaggaaaatagatgagtgttgttgaggtgtgtcattaagcacagtgggagaggcctccaatgtacgtgtcacacatggaaagtatacctagtactgggtgtggtggagagcatgacgtctggatgaaagttgtaagagactttaaaaatactatgcctagcttttgtgttacaactacatattccactgatacttatgtgaaactcccataacttttcgggttgtacctcttttttccaccctggggtgggagtgtgtccacaagtgcatgtgtgtgaactcttaactttgtgtttgtattttgagatggagtctctgtggcccaggctggagtgcagtggtgcaatctctgctcactgcaacctccacttctggggttcaagctgttctcctgcctcagcctcccaagtagctgggactacaagggcacaacaccaatctggcttttttgaatttttggtagagacggggtttcaccacgttggccaggcttgtctggaactcctgacctcaggtgatccgcccacctcagcctcgcaaagtgctgggattacaggcctgagccaccgcgcccagcccggcctgaactcttaactgtatggtttctgtttgtaacatctagagagagtgacagtgagaatttggtttccgtcggctttccttagcattcattttgatgaatttgggatgcaatttaaaagctgttttcattctgtggcctgctgatgaaaatgtagaatttattgcagaacccttgccaccgtcttgcattcccaaaccagtgttcattacccatagtaaaaaccgagatcctgttcacacacatgcacatacacagacacgctccccaccgcccccgtcacgcacacacccacacacacctcggatggtgagtgagatagaagtttagtttacatgctaaaactggttaaattactgatgtggtagaactgtcttttagcccgggcacagttgctcacacctgtaatcccagcactttgggaggccaaggtgggtggatcacctgaggtcaggagttctagaccagcctggccaacatggtgaaaacccgtctctactaaaaatacaaaaattagccgggcatggtggcaggtgcctgtaatcccagctactcgggaggctgaggccagagaatagctggaacccgggaggcggaggttgcagtgagctgagatcgaaccactgcactccaacctgggcgacagagcgagactccgtctcaaaaataataataataaataaaagaaacaaaaaactggccgggcgcggtggctcacgccttgtaatcccagcactttgggaggctgaggcgggcagatcccaaggtcaggagatcgagaccatcctggttaacacggtgaaatcccgtctctactaaaaatacaaaaaaattagccgggcgtggtggcgggtgcttgtagtcccagctactcaggaggctgaggcaggagaatggcatgaacccgggaggtggagcttgcagtgagccacgatcccgccactacactccagcctgggtgacagagcgagactccgtctcaaaaaaaaaacaaaccaaaactgtctttatgtcctacctagcatttactaagtagaagatgtgcccttttgaagggcatgtctattcctagaactttaactacaatgctttgcagtagaaatatatgctattgtattaaggtgaagtgactttagaattagtaactcggtgttgacagatcatgctgatcgaagattagccttggagtttggaaagctggagagcatgtatattccagatgaccaggaaaggaaaagtcagaaaaacagtttttaagtagtactgttataacgacctgtaaaacttgaaacgagagaaagctgtcttctaaaatgaagaattacatatttaaaacattaatttcctcaatgatactgctacatatctgaaaagggtggttacgtagcatttgggacagacccgtctcagtggtttgaggcaacaggtgtggctgaagaaaaggtaaggctggggaaaaaccaacatttctggtctaaactgatactgtcttcttacctgaggcagtttcctatgccctggttttctctgtctgaaaaatgcatgataacacatactcttcaaattagctcaaaatgcttggtagttacctactattccctgacaggccacaggcagatagttctatgcttgttttagaaatggagaatttggtactcagaaaagttgaagaagcttcatttcattcacatagtgagtcagcaacaaggacagacggaaaaacatgtcctatgactcctgccattgtattccttctcttctgcattgtgttgccttttgatatttcacgaaggttttgtgattggtgaaataaattaaagcacttccatgaaggagacaaaatgtaacccagtgtctgctgatggtggttagtgacgaggacaggagaacactgcctcataatggggactatccggtgagggctccttttcacaggtgcccacactgtgagtcacctccttatgctgagagttcggtatgctatcataaaatactttgttgtgtattatttatgaaggactagagtatctattgtctcactttctttcattctcatgaggtagattacagcagcagatggcattatgcatgctttatcccagacacaagaaaataatatctgccacttactgagtaccttgctggacccagacactcttacatatttatatcttcccattgggtcatcccgtggaccttgtgaaatatgtggaatagctccattgttatagatatgaacccggggctcagagaagctaagtaatttgttcagggtcacacagacttacaggtctgtcagactcctaagaccctgatgctttcattgtgctgcatttccttcaaattatgaacttgccctatgtcagcacagaaacggcctcttcagcctagcccagtgctccaactgattgttctctctcataaaaggcactcacaactaaccacttgcttgatttaggaattcactgattagattgctagaccagttaaaggcaaatttcaataatgagagcagttatcacgtatctagtacttaccatgcgccagactatgatctaaatttatgacacatattaaatcatttaagccttacaaccatgtataaaatagtgaactgcgatatgatggagttgctcttatcttcatcccgggatgagaaaatagaggcagaagagttttaagcaatttgcacagttaataaagtgtggagccagaatttgaacccaatctggctccagacctctttactacagctctcagttagaaaattatttctaactgagatatttcggttcagcaagtgttggcttagttcctgtgtgctatgccagcagaaaatatagttcctacacagaagagcttacatttttgacataaatcaaaatgtatatacttgaaataaatgctacaacaccttagcatatggggtgtaaatgttgtgtatggatcagcatgaataatagagactgttagtgagtggcttgagagttaatttgccttcgcaagtaatgttcttgactatggacgagtgacttgggcactggggagaagctgttccatgtgttctaaaataagcaggttacttggctactgttcaaactctaaataggtatatgggttgtagctatttgacctgaactaactttaaattcccctgagtccttatatgattttggggaaaaaaaaaaaaggaagaagaaaaaagaaaacttttctctgtaaatgctgcatttaaattagaatttattaaattctctgcaaaataccgccaggctgacaggaaggggattcgtaagtattgtatcattcttttgtcagggtgttctctttttctagcaggaagtgttgtgacttgctctctaaagttgcaattgtaagaagaatgttgggtttccagattgctcttctgggcgtgggagaaggttctgtctatcagtgctgcgagaaaggaaagaaacaagtttgctctcagcgggtaactattttaatattattttgacaggctctaactttgagattactaaatctaaatttaaatactaaatgattaagcaggaatttacgtcaaaaagcttgaaattcctgttatttatttgggtaaacatttggagtcactttaaaaatattatttattcaagtagaataaaatttttgttaagagaaaattttgaagtttagattctaacctgttctgtgtgtattctgtatttttctttatttagagaatgtttagggagtttatactttttaaaaatgggttttgaaatcctaattatacagccgtatttatcaagttaagtatctaaaacactaaataatagaaattattgtctatatttgtggtgggggtgggatttcaaatgcttttgatcccagttacatggtttttcaaaattctgtaaaatggaggttgaggtggctgtcatgacagaacatgtcacgattagattgatattatactcttcctacgtgagttaaatcaaacagttgtcttagtgtttataatttacaaaataataaacatcactggtgattaaattttgatggcgttattggtacttggcagcaatagtgatttctggtgctcacatacattaggattttccatcacatggttgtcatataagtttaatttccccatatttctggcaaagggaagtatagctagttatacagtcaatcctcactctgagttgagtcacctctcggactggttgtacttaatatgcgcatatgaagtaaaaagtgaagcatgaaacaaaacaaaccagttttttcaattaacaagtgctgtatttgctaacatataagcaaggtatataacactgcaagaggcattttcagtgacttgccgatagctttctgcttcgtgtatatagtgatttgagttgtaggtcacaatattttatggcatttttattttgaattgaagtgaagcatggtaactagtctgatcttgcctagcctctctctctctctctccctccctctctctctctctctctctctctcacacacacacacacacacacaccccacacacacatatccctgaaagttgcccttggcttcactcaaacatatgttaattttcataagaaaggaaactggtggaaatacttcttaggtatgaaaattaattaatttcattagcagcagatttattttcccataaattattcagattttgggggtagatgtaaaagtttacttaggcatggaagacattagaccttttaaaagcaaagtgggctatttcaatctaagaagttagttaatgtaccttagctttctgaagctaggggaaggagaggtgtctttttgttgtgtctttgggtttgaaatagtattcttcatcctaggaaaaagggcttttagactataattgagacttgcattaaatagctgcaaaattcttgcctgagaaacgtttaaatgatgtctttaatctgaccaaattgaattgaatatttctattattggaaaaagctacgtattaatttatttttaaatagccattgctttcagatcttatctttgtttattaagtataaaaagaggaaaggaaacttttacctaaaatggaggtatttgatattcctccaggaaatgacacaggattgggcaccctttggggtttaagtgactcatagatattggtactgaaaacaaaacaaaacaaaagatcagttagaatctagctaatgatcaattatagcacagaatagaagtatttccagaaaaatgaactcatttcttaatagctatgtaggggtgaaatcacaggatttctgagatttgctttaaaataattcatggaagagagacagggaaggagggagggagaagaaaggacaggaagagagaatagatgaaccaagcaaatgtggggaaatctggataaatgtagaatctgtgatgggtttatgggtgttttttgtgctattttctcttgtatatattgaaaatattgacaataaaaaatgttagtagacctttagtttggggcaatttatatttattttctttcttttttttttttttttttttgagatggagtctcactctgttgcccaggctggagtgcagtggcacgatcttggctcatgcaacctccacctcccgggttcaagcagctctcctgcctcagcctcccgagtagctgggattacaggcacccaccaccacgcccggctaatttttgtgtttttagtagagatggggtttcaccatactggccaggctggtcttgaactccttatatttacttctaaatgtcaacttttatctataaattgcaggcctgtcaaaacatgatgtatgcatgatgtgtatgactgtaaaggtgaaatgtgctgcttgaatgccaaaatggttgaaagtaaaaactgcttctgaaaaggtttatttctgtttgattttcagctaaattcaaaggacaggtcacaaacatcttgaagagttttttagtatcttgaagtattaaacaagggtagttaaagcatgataacaggccaattgtatgtgaagaatgtgaagacgttattgaacttgactattttgttcacagctttctccaatagagtatgtgtttttaaaaccacgtgagaggactatatagcctgcatgatgtataggtctgcgcactttccctactcacctccatcgaagtttatttattgaacaaacattcggtaggtgcttgtggtgagccaagatacaaagtcaaataagataccaaccgtgcttttaaggagctcacaggctcgtggaggagatagagaaagaaatagatgtcatcacgctgaaagctgaaaagggctataggaatatggggaaggggaggaacgggttagcaactatgaccctatgacgcatctcctttaaaataatacaaggctgggcacagtggctcatgcctgtaatcccaacattttgggaggcctaggtgggcagatcacttgaggtcagtagttcgagacaagtctggcccacatggtgaaaccccgtctctcctaaaagaataaaaactagccagatgtggtggcgcatgcttgtaatgctagcaactgtgaaagctgaggcgggagaatcgcttgaacccaggagtcggaggttgcagtgagctgagatagagccactgcactcaagcctgggtgacagagcaagactctgtctcaagaaaataataataatataaaataaggctgggtgcggtggctcactcctgtaatcccagcactttgggaggccgaggcgggtgggtcacctgagatcaggagttcgagaccagcctgatcaacctggtgaaaccccatctctagtaaaaatacaaaaactagccaggcatggtggtgggcgcctgtaatcccagctacccaggaggctgaggcaggagaatcacttgaacccaggaggtggaggttgcagtgagccaagatcatgccattgcactccagcctgggcgacagagtgagactctgcctcaaaactaataataataatataatgtaatataatacagacagaaaattggagatggtttaattggttgtgggtattacagtggtagaagagggctaaaatggcttagtctaaccccatgcataactttgcaaataactcttctgctctcatctctcttccccgcccttcttaataaacctttatatctttcttatgcatccacaggggttattggagcagtgtacgtgcagaacagagcaatctcttcttcacattaaagagtagactgatgtttaagtctcccttaaaggttttagatatatccaaggccgaattatagttattaggtaggcagctacttggagttggataaagggtagagttagccttcagtcacagatagagccttctaaagttcatttctcaattgatttggaatttgaaacatattttgtcatggaaatagtagtagggtttttcaggttactttacaagtattcctgaaattttatattatgttatctggcatgatatggttttgttctatgatatcttattttattttcattgtattctatgtgaattgtagaagcacagttgctaaatatatccagatttatgttccatcagccagttactttattctctagttcctgatactatacaatctaatcagtgtatataataatgcctcatgagaaaatactgtcaattttatttgaggtacctaatgatgtcctctgtttagttgtacaatttgcagctgaaatgttaagtagaatgaacagaagagctagacctgaaaaataactttccgaagtaaagtctgctatacgtggtgattatttctttcatagatgtttgctcaccacattgactataagaagaaatttttggctgggcatgatggctcatacctgtaacctcagcacttttggaggccaaagcagacaaatcacttgagcccaggagttcaagaccaacctggagaacatggcaaaaccccatctctccaaaaaatacaaaaattagctggggtgatattgcgtgcctgtaatcccagttactcagggggctaaggtgggaagatttcttgagcccaggagttggaggcttcagttaccatgacactgcactccagcctgggcgacacagcgagattctatttcaaaaaaaaaaaaaaaagaagaaggagaagaagcaatttttgataatgctgatgtgctagaattaatgcacagtaaaacacttcaccactttttcttctgcttcaacctttcctagacttttaggactaggaacctatgacacacgtgagggcatttaggttttgactcccttattttgactttcagagcaacaaatcattaaataaaaattatgcatatagcctcttaagcctttacaattactcctttaccaagattccgtgaaagttttctaaaatgagtcaagcaaaattccaagccacttgttcttgagaaaaatcttgaaagaaaaaatttttaaatgaaaagtaaatcacatagatacttgagtgtttgttttatattaagactaagttattagcactgatacaatgggagtggttgttcacaatacttagcattcatgaggctgaaattaagcagtattaacaaagagaagcagaagcctgtcatatgtaggaatgaatgtgtcataggagaaagtaagcgtttgtgtgcttttttttcagaatattgcctgttttatgatcagtgccaatttaacaccaatgttttaaataaatgacttttagaactctgtatgagtctttactgaactcattgtctatattctgtatgttttatacaattaaagttttggttattttagttcaaggcttaagtgaatcccttatccttttaaataatgaaaacaagttagtattagctggagggggttactatctccattttctggcaactgttcttatttctcgatatcatggtcatatttgttaggagctttttaagttattttccaaaggctatatatactaggcatggaccttctctctgcaaagcaatgtgtagtctctttgtttttgtttttctgggaagagtagttaattggctgggcactgcagctcaagcctgtaatcccagcactttgggaggctgaggcaggaggatcacttgagccctggagttttagaccagcttggcaacatagtgagatcctgtctctacaaaaaaaaaaaaaaaaaagaaataaaaattaaaaattagccgagtatggtggtgcatgcttgtagtcctagctactgggggtgggaggtgctgaagcaggaggatcacttgaggccaggagttggaggctgcagtgatcatgccactgcactgcagcctggacatctcagcaagactctatctcaaaaaaaaaaaaaaaaggaaagagggaaaaaacagttaattacctttcctccaacacatgcttttgctttttttttttttttccagctatgcttggagaaacacattattattattattattattattttgaggtggagtcttgctgtgtcgcccaggctggagtgcagtggtccaatctcggctcactgcagcctccgcctcctgggttcaagcaattctcctgcctcagccccttgagtagctgggactacaggcacgtgcagccaggccctgttaatttttgtatttttagtagagacggggcttcaccatgttggccaggatggtcttgatctctgaccttgtgatctgcccgcctcggcctcgcaaagtgctgagattacaggcatgagccactgcgcctggctgagaaatacatctttttaattgtgcttcacagctttgtgtcctgggcaaagtcaacgactatcccaggcacttgtttattccctaatacaatttagggaatgaagttatggaactctacagacttcttagctttcaaattctcattgctgtgatcactggatattgggaatactgggaattttcactccctctaaacattgcagttggttggagtattttattcattttttatgtttatttttttagaggcaggcaaccatagctcactgcagcctcaaactcctgggcttcagtgatccttctgccccagccttcctagtagctaggactacaggctcaggccaccatgctggctgatttaattttttttttttttttaagagaaggagtctcgctatgttgtacaggttggtcccaaactcctggcctcaagcagttctcccacttctgcctcccaaagcactgggattataggcatgagccaccaccctcagcctcagttggtatattttgtaaaccatgcctgtgtaaccaacatccagcaatgagagtaaaaggtgaagtttagactgttctccagaaacaaacaatcatgaaatgagacttgcaaagcaaagaattacacaagtttttgtgtgctgttcgtgaaagaaggattttcttttattgaagaagattgttctctttgaccaagtttaagaatctatgtaaagaaggtagataaactgaaccaagtaggacaatggaagtcccagttagactgactgtcctcatatccacttatgtaactatagggagaagtctataattaaatttcaaaattttgtggcaagattctaaattctctgggagttgaagagaaagatcagtgggaggtggagtcattgggaaacgtgctttgggagaggatgaggcttctgaaccttgcttgaagggtgagtagaatttggatagagagagaggaaaaatagaggagagtattctaagcatgagacgcagatagagagagaggaagttcttaatggaagacaggaaaagcagaagagaccagaataaaacaaaaggtactgatagaggagaatccagaaccagctgtaatagaaacacagttctgtgagagtactgggaagataaattttatcttgggtgcggacaatctgaagatacttcctgaaataggcttttgaagtgtctagatagatgggtgaagagcattccactggagagacccagtggtctctccagggagtggaagaagcgggaaaatacatggcctgtttggggaataaggtctcttgagagtgttgggttcaagggtgtagtacatataatgggaagtagcattggaaagatgggcagacataaagctagaagtcaagtcagaaaagtgtagggccttgaatgctgtcctaaaaaggtgggacctccttttgcatggaatgtttataagatccgctcttcaggagattatcaggagattagcagtgtaaagattgcactggaggaagacagaacagcaggcagatctgataaaaaaaaaaaaaaacttttgtggggttgggggagggggaagggatagcattaggagatatacctaatgtagatgacgagttaatgggtgcagcacaccaacacgacacatgtatacatatgtaacaaccctgcacgttgtgcacatgtaccctagaacttaaagtataataaaaaaaatatataaaaagataaaaaaaaaacttgtggagtaggccagacatgaggtgataaacagatatgacggaagaatctcagatattgcaaggcaagaatccagagggatgggtggttgactgatcctccctttgttttttatggtcaaactgcagtctggagacagaggaaagtgggaaagttgaaaacgagacctgatttggcagaagaaagagttagaaaaaaacagggaaaataatgtggcagtaagttagattggagacacttagactttcctaacttgaatcgtcctcactgactttccttctcccttggccacttctaaattggaccctgatctgctgctgcgagtgtgtctgtcactaacacaaggcacaatacccttaccagtgatgtctctctgagaatgcccttactggggatgtctatctgagaaaatcctacttgcactcaaagacagagttcaagcctcacctcggaaaaaacttttctgacgcctaccatttagtatatatgactgtgatggcatgattgcactaatgttgtatctttgtttttccatctgtttcccccactagacagtaagctcttccagaaagaaggggatttggatcctaattgtctcttatctggagcacccaacacagtgcctggtacatactaagccttaagttaatgcttgattaatataaataaataagtgggtgagtgtggtagacattcaagctgggaatcttctaaagtcattaggaaacatgagactggagctttagtaatcatagtatgaataggtgagttttagcccacagtgttgcacacccatctaagctagagactagtgttgagctgttcacttacctaactagggaggtggcagggtggcagtttctattggtaaaggtaggtatgcaaagtgtgggtgttcaaaagcactgcctgttttggatggaggaaggtgacaacaccccttttctgatcattcttgaactgttcacacataatggtggctaacttgtttattttcatttatagtgaaataatgtatttcttccatgttttgtcccctctttgttgctttcttgttcattttaggacctcaagtatgtgttgcccagtctctgatttaagtaatgagcttctcttttccaattctatttaccatactagtggctgggatgaagcctgtggtgaatatcctgtttttatcttttggctgcctttcaatttaaaaaaaaaaaaaatcaagtttatgatcaaagttggttacccccagatgagtttcccacgtgcattctctttctcctggacctcatggtactgaatgacacagatgaataagtagattattcagtcagctgcattcctaaagtgagtgagtgctttaggagataaaataggcacccccgtcccccttcaaatacctttcagaatttgaataatagtttcaggtagttgtaggtatacctttctcagcaaagatctgtgtttagggtttatgtatagttaaatgagccggtggagtggtttcataattgcagtattgttagtcaaactctgtaattagagatgacttcataggcataagattcttctatgggtgacgccctgaattcatacccaattgtacactatatccttttatgaaaaaacaaacaaacaaggttttgtttgcttttgttttactcccttatttgaaaatctgttttcctgtgtcttatatgtttagtgaagaagggctggcttttttctacagctttcccttttcctttacagaaatggcaggcataggagctaaggaggaaacagaatttgggacagatcaaagtgctttgcagatgagcgaattcagaaaaacgtagagactccaggaggttttatttttgataagtattaaaattgctgagtttaaatggaggaaaaatatatctctatttctttgaatgtcagttctctttctctctccctctctctcatcatgtaaataaagtccgcttttgcttggtggcacacatctgtattctcagctactcaggaggctgaggcaggaggattgtttgagcccagaagattgaggctgcactgagctgagattgcaccactgcctgggtgacagagtgtaaccctgtctcaaaaagaaataaacacataaagtccacttttgtgggaagacagactgggaaagaggacatatttgaaaatcagggtttttttccttttgcctgtcaatcacatattgtgaaatcggggttaaacttttattcagcaagtaatactttctcttcacctttttctagtactcatgaaaaaatttgcaaattaggaggaatgtgacaatattgacaagctgttagctattttgaaaagtgatcctaaaatatttaaagaaaaattgttgtttgtttgtatatctcctgtctgctctttaaattgtgtttagaaactggccttacggaggaaccaaattgagtcatggataaaaagtgactgacaggttttcctttaggcccatccttcttaaattactttgactaaagacttgtaatttttatatatgagggagacctattatactctgtagtcagtaattatagggagatgagataacttttcatttatcccatgtaaaaggctattagtagaactaatgccttatatttatttatacagctcttcacaattaacccaagcattcatttattccctattttctttcatgaaggatttgaagttgctatgtaatacttcatagttcacaatatgctgtcatacataccatctgtaatcttcattaggacctgggggaagtaggtattattatcactattttcaaatgaggaaacttaggctgagacagattaattaaacttgctcatggacacattactagggaatagcagaaccagagcaataatcgatgccttctaatttcacgtccaacatctttctgttaaaacatactacaaccttgggcgcggtacaacagcttggtgtactggtacttgagattaaatgaagtgtctacagggcagtattgatgtcaaatcttgtgttttgctttgtgaacccatccgggatgttttagtaactttaagggaaaaaagtcctatagtacaatgaatgccccatgaagaggaatagagcttctgttattttaatttgtaagatctttattttttaatatcttcactcatttccaagttacttaatgtgatgttttctctcaagatagtactttactgcttgacttccttaaagacaccatcaagtacctatgagtagtcttaaggacagaccattttttaattcatagtggcataaagaaatctacattaaacaactttattttaagcttcaaatggcaaaatgtacaattgtatcagctagagcatatattgtgagctttttaaatttggctttatattttttagtcttggcccaggtacttcagagtagcatttctttatttcctttcaaataactgtcaataaatgaatatgggtttatttaaattggaaagtcctgcattaaactattctgttatcctgaaacaaccttgtctggaaatacggttttaaggatatgtgcatgttccaattccttctttttgttctcattgaagtgtatctctttaatgtctctgatagatgggaaatctgagttacatatgcaaagtcactttaggctttttaaaaggcaattagaaataagaaacttgaaaattttaaaatatatgtttaatgcactggattaatttttggactaaactggtgccctaaaattatttctatgagatctaagcatttcttaattcatttttattttttactttttttattgagacagggtcttgctctgtcacccatcctggagtgcagtgacgttctcatggctcactgcatcctctacctctcgggctcaatcggtcctcccacctcagtttcccaagtatctgagactacaggcatgtgccaccacccacgatgcccagttaattttttgtatttttggtagagacgaggtttcaccatgttgcccaggctggtctcgaactcctgagctcaagcgatctgcccacctccacctcccaaattgctgggattacaggcatgagccagcacttgctaattttataggaagaaaaaaagaactgcgtttctggccactctgagaagaaattaataatccttaaagtctctagagacttttttcttctaaaaaaatggatatttgtaccttttattgcagtcactaattcactttatgtcatattgtaattattcatgtttgcttcgcagattgtaaattccttgagggcaagaactaggtgtatagcagatgtctaaaatattggtaaaattgtttgagaagtagcggggaggggcaggttggggagaaagagatttctacaggatttaatcagaacccaactggtcagcagggataaggggggcggggggcaggaatggtttatgtccagaaccatcttatctaatttcttttttttttctttcttttttcttttcttttctttttttttttttttttttttttttgcagtgatgcactgatggctcactgcagcctcgacctctcaggctcaagtgattctcccacttcaacctccagagtagctgggattacaggcacgcaccaccactcctggataagttttgcatttttggtagagacagggtttcaccacgttggccaggctggtctcgaactcctgggctcaagtgatctgcccgctttggcctcccaaagtgctgggattacaggcatgagccactgcacccagacctaattttcttttgcatagaagtgatatggtagtgtgagagtaagctcagttgtataggtttgttttagttgttttttacccacatactttaaattattactgactcactatctgcccaaactggaaaggacctttagagataaaggagagaggccacatgttttagatttctgagatggtcttacttttaaattttctgtgccattgttctccttggtgtgtgattcatggagatgtgtaataattctttattaaaaacatgattgcttaaaaggggtgaagaaaattggaataaatcctatgtcgtatttttgtaatggggagtgttgaacatattagtgaaacagaatatttttagaattactactattcgtttgcatttaacttacgaattttaaaaaaaaatttttttggaggcgaggtctcactatgtttcccaggcttgtcttgaactcttggcctcaagcaatcctcccgcagtgctgggattgcagttctttttattcttaatctttaaaatgcctaacttcaggcctgggcgtggtggctcatacctgtaataccagcactttgggaggctgaggtgagtggattgcttgaagccaggaattcaagatcagccagggcaaaatggtgaaaccccatctctacaaaaaatacaaaaattagccaggcatggtgtcccacggctatagtctgagctacttgggaagctgaggagggagaatcacctgggagggaggagcctgggaagtcaaggtcgcagtaagccgtgatctcaccactgcactccagtctgggctacagtgtaagaccctgtctcaataaacaaacaacaacaacaacaacaaaaaaaaaacccacaaagcctaacttcattactaactgaagaactttctttccctcatagatcctgagattactctgaaaggtattttcatccaacctgtctactgagaagttatccatctttagtggcatcttgatatcatacataagaaaagtttatgaataggccagctttgttttatatcttttttaaagagtctagtgttatttaatttttttttttttttttgagacagagtctcactctatcacccaggctggagtgcagtggtacgatctccgctcactgcaacctctacctcccaggttcaagcgattctcctgcctcactcaacctcccgagtagccgggattacaggcacccgccatcacacttggttactttttgtatttttagtagagacagggtttcaccatgttggtgagactggcctcgaactcctgacctcaagcaatccacccgcctccacctcccaaagtgctgggattacaggcgtgagccagtgcgcctggctgatggttttatttaatttttaaaacaccagtcactgtatgtgtctgttacattatggtaaaaacttagctaatagcatcatatggtcattttaaaacttctccaggatttgagaaacctgagtgtgaattccagtcctgagagcccaggtcttctaataggaaaaaaaggagattagaatatttagctcataggactattgtgagggtttaggaaattaatatgcaaatgaatttgtataatgtattaataatacttggtgcatagttgttgaagggattaattttattaaagttctgttttattgagtgccttactatgtgccaggggctgtgataaattctagaaatagcaacaattctgtgaaaaagatagatgtagcccagctctcttatgaatccctccctaccacttccagcccctacctctctatactgagtgttacacttcttggccaaaacataagttggtgagtaatttgttgccttttaataaaatgtctaaaagggataaatgtaagatctcaaaatgtattttgtatagtttgtgaaatttaacccgtagtatatttttttggaaaggcaacatctttagggcagtggaactactctatgtaatatgttaatggtggatacatgtcattatacatttgtccaaacccacagattatacaacactaagagtgaaccctaatgttcaccagagtcttagggtggtaatgatgtaagttcatcagttgtaacaaacgtaccactcaggtacaggatattttggtcaatgactgatcgaatgtatgatagtagtcgcataagattataatactatattcttactgtaccttttctatgtttagatatacggataccattgcattacaattgcctacagtgtttactacagtaacctgctgtgccatttgtagcctaagaggaataggccataccgtatagtctaggtgtgtagtaagctataccatctaggtttgtgtacgtgcactctttgatgcttgcacaatggcaaaatcacttgacaatgcatttctcagaacacatctctgtctttaagcaacacttggctgtatttgggaactctctgtaacttctgcttgattttgctgtgaacctaaaactactctaataataatgtctattggccgggtacggtggctcacacctgtaatcccagcattttgggagaccgaggcgggaggatcccttgatcccaggagttagacaccagcttgggcaaggtggcaagactctgtctttacaaaaaaagagaaagaaataaagaaaaataaagtctaccaaaaaaataaatcagaagagagaaaaaacccaaaacaaaaaaggagaaaggaacatgtaatcattttcatttttctttgtccaaaattattgttataataggtttgcatttggaaattatctactgtgatacagacctcctctctttattgccaggatcagcaaagtttttccatataggttcagatcataaatattgtgtgccaagaggtaaaatcaagaatattatgatattaatatcaaggatataatatattatttctatcagtttttattgacaaaattcaaaatataataattgagtacaattttttggtaatacaattctgataagaatagaattctttttttctgggataacatttcacttaattgggttcaaagttaatgtgcccccatcatcaaaatggactgcaaaaattttcctttaataaccatatccagcttgaggtcatacaaaaacaactggtgatccagttttggcccacaggccatatgtagtttgccaacctttgttctgttagttaaatagatcaataaggccaaattggaaagggtgtatactcagataatataataatttacatgcataagaatgtgtatattagcacacatgtgcatttttatatcaaaaccagctataatttgttttgtttcctctttattcttcctttaatgagagtgattgatagatgtcagtatgctatttgaaaatcaatgtcttcacagtgaatgattctaaagtggcttaatgggaaaatgatactttccgtgaatcattggtcacataatattgacctttagctttggctcatataaccaagaatttctattatgtagctttttcctgtcactgctgggtactttggcccttccttaaactttttgaatgtaatttaagattttgtccttagaaggaaaattcagaaatattttttctcaataaattttggtaagtgatgacttctcatttgttttctttattaaagctgtatgtagagacatggtaacctattcagattgttttgatagtttgaaattctgtttaaattatccctaagatgagaacttagcaagagtgcttatatttatcacaattttttaaagtctgaaacgtttttggtttttctttagatctttaaatggatgagatggctaccactcagatttccaaagatgagcttgatgaactcaaagaggcctttgcaaaagttggtgagtattttttgtagtaaaactatagggaagcaatatttatttggtctcaaagttatttctctataaatatcacatgaatggttaatcaaaaacattagggcaagatagttaaaatagatgggataaagttttggaagctatacttaaaattgttttatttcttttttttttttttggtcgagtggtagctgatattatttccaattttatgtagtatttaatatggtcaaattttttagaccacagttccaatccttaactggtgactgttatgtatggttcctgaaattttcatgccaaattttagttattattatattttgtatctcatatctttctgaagaggtttgaaactttcaccatattctcaaagggatatgtgaccctcgaaaacattagatgatgttttacccttccttaattagtttggcgttattgacttttttatgggttttctgtgcctttggttactgcagatcgttctacctcgccacgttaaattatagcttcagtataagatgagaaggcatagcatgctatttgatttatcctttatcatcatataacatgccttacaattgagcagctatggaaggtaaatatggagtatttacattccaaattttagtgcttgggtcaagtctatagacaataatgagaaaacagggtgagaacagcctacttatgtaaatacatgaatcaacatgtgcttagagaggtagattattattatttggtatctccttgactgaagggtacagaattagctcatatgatgatttgttatgtaaatcagaatttgccgttagacctgtgtcgaaaatcccattagtggaaaatgaggaaatatacatttctgttcccatatatttatgatcaacattttctatgaaggcattcagtagtagcagtgtaccttgggaagaataatgaccccagccagagtgaccattcataatcccatcaaaattttaactagaaaaaactgaatattcctgaatctaacatgatcgcgcgcacgcgcgtgtgtgtgtgtgtataaaaatagcagttaattaccttgccatggataccacttactgtaagaaaaatgctacatagtttaatatataacagcaagtgaattcttggctgcaagagtttttttttttcaaaatgactctcattcagtcaaaatagtcttataattgttttaggagtgcatttttgaaccttttttaaaattaatattcatctttcagcattagcagcagcttaatttgttatttatgaatagaatttcagagtaggcaccatgccttattaagtactcatctcctcaagtaaatgctgaatacaggtcttgtcctcatgtgcagcatcttggaaataattacgtgcaatattccttaaaaattaaagttaattcagatattgtttacctgatgagacttggaatacatttgacgagtaaaagaacttcattgtcccttaaaagcttaatgacataaagaggattgaccaattatcttcatagaggaaggagttaaattgtattaagtaagggatcaatgagaagtttgactgcaagaaaaggtcattgtggagctattgtttaagtagagtttaagataggcgtacagtttgccaaagcccctgccaggcatatgttcctaacatactcaggctcttattactatatatgctgtaaagaattctggaatccagaatttctgcctattgtgaatattattcttttgtagtctccactcagtatctagcatagtgttgcacacatgttaggttctcagtaaatatttcattgattgaaacccaaggaactatatacatagccttttgatgtactgggatttttgtcattatcaaccatacattcagagggcctttgttgtgaagattttcattacagtggaatttattattaaaggtttttgccattaaattgtagcatataaaatttatatatatttttcagcataataaaagcttgtgtgtacactccatcttttagaaactcatttaaggacccagccgagtctttcgattttctttaaaaaatctttgtagttttaagttgttgttacttacagaaccctcaggcaaccgtcaaaggtgttatagaattttttttctaattcagggacactttattttaaaaacaagctctataacttattatcctgtgaaggacagtttttcctttttgtgggggtgggttggcagagaataggaaagactactttgtctcagttcaattgcgacaaaatatggaaatcattagatgattttccccatctattaacaataatagccttgattatctccttagaaattcagcaaaatcatagcgtgtggagaaaatctctgtaattactgctaatcataggttttgttcaatcaattaatagtgctttgaaactctctttactagcaataaattgagtattagaatttaaagttctcttttcactcactttctgcacctgcttagttttaagctccaagctcatgtaattattttaattttctcaacaattgtttccagtgcttcccagtagcagaaacgttagttatcagtttttgtacttcatgatgtttcaaatttaatttaaatgctgtaatacataactatttctaaagaagaataaataaaacctttcaaaacacttaggtattaatattttaccatctagaaactgtcttttacattctaagcctttaatcttgctatggaaactagtggtcatttggatgattacttgtcataaagaaaaattcatgtaatgtaaacctttgcagagttgctttagtactgcaaacacttaccttgccttgccttttttccctcctgagcactcactactgaggttttttaaacatgaattcagcacttttgaaataaaagaataatgggtttcttaaatgactaggaatagtatgggtgtattcctttgaggtttcccaccaaactaagcaaaaaaaaattggttgtggtgattgtagctataccagacttctctcatcctaggaagttgagttgtttcaaattacttgatattcgctagtatataaaaaccacatcaggatgatgccacaaaaaaaaacagtgctttagtttaatttactttcagtattcaataaaagaacaccagtgcatatttgtttaattatgccttaaaacaaaaacaaaactatagcccgtctaaaaaaaatgaaactaatcagtgctctttcattgtgccatctggttaattatatatggattattagaagtggaggtctcgggatagtcggaaaaccatgtttcaaaggtgtggaagctagttaggagtacacatgtgtgggtgcatgggtaaaagcaatttttatttttatttttatttttattttgagactcctgggctcaagtgatcctcccacctcggcctcctaaaatgctgggattacaggcttgagccatggtacctggccagccaggtatattttgcttcatgcactagatgcgttcctgaaaatcagcaagccaactgtaaatggattttatgtagtgggatatattttaaatgtaaagagaaaatcttatttttttaagtgaagcctgctttgaatttttttatttttttatttttatttttaattattttttgtttatttattttttttgagacggagtctcgctctgtcacccaggctggagtgcagtggcgcgatctcggccactgcaagctccgcctcccgggttcacgccattctcctgcctcagccaggtggcagactacaggcgcctgccaccacgcccggctaatttttttttttgtatttttagtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaaggtataagctgtgagaagcaaaccccatgtttagctaagcatctggagatgtttagcagctgccttttctaaggatttaatgcctaatgaaagcttgatttcactgcttagatcttgggatggaatatagtttaaattcttctgcccaagtcttttgaccgagtcttttaagtcagtattttgtgagctttcatgggcattcaggattgtgtatgtgtgtaaacccattattgttagataaatagattccttttgtcatttctttagtgcagaaaatttgtagaatatgttggtcaaaccaaattgaacttttaaatccagcttttccaaaaggatatgcatctgcacttgctaggctttcttctttaagtcctaatgagcactgtcctgagtgggctaatagagaggtcgcatgtgtattccagatgagggcacacaatatgtgacctcttcataaagaaagacaccagatttagacagattcaaggatgtttaaagcaacacacacacacacacacgcatacacacacaacccgagcgtcaaagaaaatcctagtctttcttactgtcaaatttatgagacaaagtagcaccccaaaagacgcttttgaagtgatagattgcagcacgtaccacctggacatgggcagtgtaaaacagcagctaaaatcaaaaccacttggattctggcttagctttctccagacaagtacttaaaatagcttaaataacaggatgcaaggggagggaaaacatttccttttaaggatatgcattcttggtgtgattcaaacttctgcaggaacatggctgtgtaataagtttatttactttaaggtttacttaggggagggcggcgggggagttaaatagtatttaaaataatacttggtaaaagagaataatgagatttcctttaaaacaaaatgcagatgtgaacctacacgtgtcatcagagagagagagagagagagagagagagagagagagagagagaaaggaaacagtccttttaacagttgattcttttcttatgaattcagtcagtggccaatatgaaaaatgggcctgtctggtgcagcactgggagctgcgtagtgatttttttttaagtatcataattttcttcttttaaaaaaaaacgctttgtcaatttactcaaatttagccctttactttctgccagaattgtgttcagtgataaggtagagtttcctttatccagcttctccttaatgtccagccatactgaccatattttctaaaccaaaaggttgagaagtgctggcattgaaactgcactgcacaatataggcagtatggtaatttatgtctgctttatcagctggttggaaactatgatgctgaaacagaagagtcttcaaaacacagagcttttcccactccataccaatgtatagttaatgagaaaatggcaagtgagccaaaaaggtgttgcagagtattggcagcatgaatgagaaaataaaggactgccatcattcctggtggttgtgattttagtttccagttgttaaaacgacttccaatctaggtatgttattttgggtcagtttattattaagttctcatgtttatgtcaaaactcagaataggagaaattcaccatcaaacatactgaacagcaacattctaattccaatgctctgtttttaaagtggacactgtaaccacaaataaggacatagtcttatgatttcaaaaaattaaattgtctttttgaaaaaccttgccacattattcttattctcattttgcttttgaataacaaaaaattatccaaaattcattttgggttatttggaaatcattcaggtacctcagctattttattttacacataaggaaaacatgactcaaagactatcatttagccagtttgtaaaacgaaactacttttctccgatgtagaaaattagattgaatagtcatcagcatttatgtttattttttaaaattacaagttagtcttagaagtagactaaaagttgtgagcacctgatgagatggaagctttctaaaatcccattatgctacctttttactggccttccaaaccacgttagatctttgatattgtttaaggatgtgtttttggttttttgactgagggttcgaaataaaattagcataaaactctttaagaataattgcatgctattttgtctctcaagtactttaccagctgggaggttttgtaaaattaattgctagctgcatttttaggctccctctgccttcttgtttaaattgaaattattttcttcaaaatatatgatttaagagctctaagaaaggcttgataaaattgactctaactaacactaaaatgcctttgatcatgggaggtagtgtaatttggactaacactgggggctaaactatgggaaaatggcagaataggtaaaacttttagaagacgacgcacattcttgtcatccaggaaagcctaaggatatgtattcgaagtgactcaaaatttttacaaggattttgtagccacagtttcaagtaagacccaggggttccgtttgattcatttctgtatctttggtatgtagcccagtgggtgtcttcccacagggtaggtactcagtttgctctggagggtgactcatacctaaacaagtgcacatctcctttctcagtaaagccaaagcaggtttctacatttggaacaaaagagatcctgaccagagagctatcactggtggtccacttgggccctccttgatgggtgtgttcacttagaaaaccaaattacagatctgaaggctgctgggtagggacaggattagaacaaagggaatgagattgaatgttatttaagggatatttctgtcaagttttggtttctcgatgaattgccattcagtctttgagtgctatttctgtatttctgtcattgttgtttagttttgtttctaaaatgctcatctaggattagagcattctttctttggtcaattcctgagaatcagtgattctacaaaaataatttttttccattgcttattatacacaaaagattgtgctacatattggggtgggagatacaaagatttaaaagaatctttatcgggagatttgcagcctaataaggaagtttgtcatgtaatgacaaattcttattcctccaatttcctttaaaattttcctgtccctttctaaaagcatttcttactactgcccttacttcaaaatgaaatttccaaatgtggttattttatgttaattatgttttagggtggctacttcctggcatcttttaatcacatcagtgaactgtcttctaattaatgttcaagagaggttatttcagggaggatacaggcaaatagtaatttctccctgcgacccaaacttctggagttttttgtttttgcttttgagacagtgtctcactctggtgcccaggctagagtgccatgatgccatcatagctcactgcagcctcgaaatcctgggctcaactgatcctcctgcctcggcctcccaaagcgctgggattacaggcatgagccaccagtcccagccaccagacctgtagtctaacctaatacaaataggcagccagataaactttctgggccttagtcagtttcatatagctttgaatccactgtagttctcccacatctaatttaaaacatctctaccttccacttccattataacactgagaatacaaaaagaacaaatcctgttacatacctgttatatactccagtctaaactagagtcaaagcacagtggctcatacctgtaatcccaacactttgggaggccaaggtggaaggatcatttgaggccaggagtttgagattagcctggtcaatatagtgagaccctgtctctacaaaaaatacaagaaacaaaaagttagctgggcatagtggtgagagcctgtagtctcagctactcaggaggctaaggtgggaggattgcttaagcccaggatttcaaggctgcagtgagctatgattgtgccactgtactccagcctgggcaacagaatgagaccctgtctctaaagatacttttttaaattaaaaaattggctgagcttggtgacttatgcctataatcctaccactttgggaggccaaggtgggaggatcacttgaggccaggagttcaagaccagcctggccaacatgacgaaaccccatctctactaaaaatacagaagttggccaggcatggtggcactgtaatcccagctactcaggaggctgaggcaggagaatcgcttgaacccaggaggcggaggttgtagtgagccaagatcatgccactgcactccagcctgggtgacagagtgagacttagtctcaaaataaagaaaatagcttaaaagaaaaaaagaacccactgaagtggacaacgttttgatagttaaaagaataagctatctcttcctccaaagatatcataaaaatgaaagaatattatacttaggtaataaggtgcagtagtgatcagaatgttatcactctgtatctgtatttaatatgcgttactattctatctccaggttttaaaagtgtttgtgtgaggggagggttgtgaagtcttgtgtattctgatttagaatcagtgtgatagaaccaaaaaggaactttagagattatgtggtccaaagcactccttttacagatgagaaaactaggacctgaagaggtaacttgtgcaaattaatagccaagttgagataagacattgtttcacattattcccactgtgtgtctcttcaagcatgtatgctgtgtttctttcactatgccacacttactctctagtactgaactccactgtaattttagaaaggatgtaggaaaaacaagttggtatatgcatgggagcaggtgtatttaagcccaagacattcataaaacaagagccactaaaattttgcctcagtgccatggggattactttgttctttttagcaactgcagacattattgatggattgatttctacatagaaatactttacatgtagaaataaagagtttgatgtatgaccttttataaatccaaagcaaagaaagtgaatatacatcctagggaaattaagtgctttacctcaaaggaaatctaagtgattttcacactaagtattgaatggtttgttattgatgttttaaaagtacagatattttaattagccaggcatgatggtgcccacctttggccccagccatgccggggagctgaggcaggaggattgcttgagcccaggaggttgatgctgcagtgagccatgctcgtgccactccagcttgggcaagagagaccctgtctcaaagaaatacaaaagtaaaaataaaggtacagatgttttaattcatagatttaaaatgtagtaatcaatgtttaagaaaatttaatacttaaaatagactgcattaaaactaaacagaatttcatcagcattcaaaatatttgcaagatggttccatgcagtatacttaatattttaatttaatttaatttttaatcccccagagcattcttgcaaattgcaattttagtaattgaccaaaaattggacaatgtgaactacacgtagatcacacttagaaagaaatgtcagtgtattccatggaatacattggcctagcagagcttataagatcagctagctccccgaccttatctctcattttcccccttgttcactctacccaagtcatattggatctttacttttcccgaaacacaccagacacactgcagcatcactgactttgcatttgctattttctctacccgaaatctcttgccccagatagccacatgatttgcttcccttacctcatggaagtcttcattcaaatataacctcatcaaagtggccttccttacccattctgtctaagtagtagcaccaccaccatccctgccccccaatatctctataacccagggttactcaacttcagcacaattgacattttaagctgcataactcttgtgttgtacatacaaggaaggggtcatatccattgtaagatatttagaagcatccccagcctctacgcactgtatgccaggtgcttccagttatggcaatcaaaaatgtcccctgggggcaagatagccccagtctaaccccttatgcttttttcttttttttttcttttcttttttttttttttttttttttttgagatggagtcttgctctgtcacccaggctgcagtgcattggtgcaatcttggcccaggttcaagtgattctcctgcctcagcctcccgagtaggtgggactataggcgcccaccaccatacccagctaatttttgtatttttagtgaagacggggttttgccatatgggccaggctgatctcgaactcctgacctcaagtgatccgcctgcctcggcctcccaaagtgctgggattacaggcgtgagtcactgtgcccagcctgctttatttttttattttttattttatatatttttttgagacggagtctcactctgttgcccaggctggagtgcactggtactatcttggctcactgcaacctccgcctcccaggttcaagcgattctgctgcctcagcctcccgagtagctgagattacgggtgcccgccaccacgcccagctaattttttgtatttttagtagaaacggggtttcaccatgttggccaggctggtctcgaactcctggcctcaggtgatccacccgcctcagcctcccaaagtgctgggattacaggcgtgagccaccgtgcccggccacaatacattttcttaaatgcgctaaggtcatcttgagtcatttctctgttcaggttgtttccttctattataattaagtttacatatgaaaatcagtgagacctaaggaacagaagatatttgaaattacttgtgaacatcaaactttattcacaggaaaatatatactcaagtggttacaaccctcaggacattagcctttttctcaataaattaacttttggtcattgatcaggttttttttttctatttttaaaagcttcagaataaacatcattcatttaatcagcacttcaagacatactctgagaaacttcagtagtacaaaaattaaaaggttatttatagagtcatattaaatatctgctttcctcagtagtgcatttatttttataaactctatatttgtcttgaattaatgtttgtttacattaactcttaaaataattggcactgaacatgactgcttaatttcaggtgtactttgaaacagaatcagcattaagttcatataagttctttttggagcaatggaagaataagaaacacaaaattcctatacttacagtagaaattgttctataccatggaagtgttttgtaggtttacgatctattagttctttttttaaaatcctattagcgccaagttaataataattgtattagccaactatgcttccttgaacttagggatgctctttttaagtaaatctacttacacattgcttaaatcacaggatacatgatgtaaaaccttgctttttccatttaaatgtccatttccctttcaaacaactttatgttccccacaataagaaaatattttatgtaagtgagcttatgaactgaacctcaaatgaagggaaatactctaacttctgtctttcaattttttttccttttttgcttgctctccttttttacaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatgtaagtatgtgaaaattcacaattattagaagtagtagatgttccctcgtctagtgggatgttatagtattaagtactgttatgttaagttcttaaatatatcatattagtactgttataacatttctgtcatcctgcccactaaatgtacttcttttagctgctggaatatcttaacaaacgaattgagaaaaagagcactgcagaaacaaagatataacatgataagatgttaaggtgataagttatataaggcgaacagtctcctttcatgtcatcattaaagggcagttatcaaggtgctaagtgacatctttgaagtgttctctctcccgtggtgaacagtgtgctccaaaattttaataatacaccctgactcacagtctcggaagcttcctgagctgaactttctcattaaaaagttgttttccactcttgtggtaggggtatttaactgaaccattctctctaggatgataattttgataattaaaagtttgaagcatatcttttcagtccattggaagaggcatttaacatttttgttttcttctctagtttcatcaaatattcttcaaggttaggggctgagtttttaattctttcacccccccaccccactcccagaacttagtttggtgttctctactcagtgcctggaaaatgtatacatggcacatggttcttcaatgcctaccactattggctgctagcaagtgaggtctagattttttagacttatgccattttcagtctgtatttattgacagtgtatttgagatacgtgttaaaaatagctggctgggtgtggtggctcacacctgtaactccggcactttggtaggctgaggcaggagggtctcttgaggccaggcattcaagaccaacttgggcaagttagggagaacttgtcagcttgggcagcttagggagaccccatctgtacaaaagaaaatttttaattagcccagcctggtagctcgagcctatagtcctagctactcaggaggctgaggcaggaggattgctcaagcccagtagtttgaggctgcagtgagctgtgataacaccactgccctccagtctgggtgacagagcaagaccctgtctctaaattaataaattaattaattttaaaaataaaagaatagttgttgcttcttccctcaattaaggatacctttaagattttattggtgtatttattattaatttaaggctgagtttgactagatcttactagggattcctttcagtatatcacaaactagttatcagtgcctaatatttatcacaaatgtcccagcgctcctatcctcctttgtcatggtttatttttccccaagacaactgaaacgatagcatgtacttccatcagtaactgtggctcaccatagcaagtgaaattttgaaatgttctttccaattagaattaacacctttagaacactgtagtagtccaagaagcaaattgactaagtaatgatgcctactcagctgacagcattttgtgattgtttttaaaatgcacacttgtcggccgggcacggtggctcacgcctgtaatcccagcactttgggaggccaaggcgggtggatcacgagctcagaagatcgagggccatactggccaacatggtgaaacccggtctctactaaaaatacaaaaactatctgggcgtggtggtgcgtgcctgtaatcccagctactcgggaggctggggcaagagaatcgcctgaaccagggagtcggaggttgcagtgagccaagattgtgccactgcactccagcctggtgacagagtgagactccgtctcaaaaaaaaaaaaaaaaaaaaaaaaaagcagacttgtgtcataattataatgatatcgttcctgccgttttcttttgaaatactgatttcctcccaccatttttttgtctccagttatggccaaagccttttgttttgaattctatgttcaatagtaagttgcagtttatttgcaatttgagcacttgcatgttttctgatgtatcacttgctccccttttaactgcatggttaattgtgaatttaaagtagcgcagagcagcagttaactatgattggctgtttttgataaaatgtattgctcagaattttttaatctattagaaagaacagaccaaaatcaataggatttgcagtgtgtcattatattaaggacaaaattgtaaaagtgtctttgaaaatgatcttggggaaattgttaattttgtagattttgaaatgtagtttttacacagctatttgtggcttttaagggaggaggtgtgattaccttagtatattctttaaaagtaaagaacatgcacaataattttggcaacaccagggctttaagaaaacaacattcgtgaggacattttaggttagaatatacattttagaattggaaggaatcattatgtttacactcctacacttttcaaatgaaaagaaacaaacttggatttctgaaaaaggaagtgacttttcctttttgcctaacattacacagaggactagtggctttttccagtacctccctgctattcaagaaatttgaaatatcaaggacagtaaagtaacctacctgaagttttcagatgctactactactatgactgtattaaccaaatgtctgtccgcacccatctgccttgtcatcagtgaaacatcttacaaattgtcaaacaaaatatgggtagagcttagttatccaagaaatagaaatcatgttattcctgttagatattggcataaggaaatagatacaaacatgttcttgcttgttaggtttctgctttttctttgaattgttgcttaaggggtgttaattgcaaaccagactacaaacaaaaacagtttatgttaatttcagagaaatgtctgtgtgtgtgtgcgcgcgtgtgtgtgtgtatggcaaaaaacagtcccaaaattatatgtatgtaaactttaaaggtgaaaattaaatttaataccctgctttttaaaattctaagcacttcaaaactaaaaatactggatttttatgcttacaagataatgggactttttttctttgattgttaaactagtatggcactttcagcagagaagtaagctgcccagaacagtcttggacatatagtaaatactatataggtgttagttgctggggtagttctttctttaaaaaaaaaaaaaagaagttatgtttttcaaatattactaagtttaggcctacaagacattccaaaataatggaaaaattcaatcctgcctctttggaaacattttggaaataagccccaaacactggaagccagtcaattctttttttgcaattctttctgaaatctttctttcttaagtcatatgcctctggattgttttggtttggccactcgtcctgtgttgagctaactctggggtcaaaagaagttagccggttgctgagagtctttgagagaaagaaggcgaaacttaataaaaggaataaaaaacatatatattccataacggagactgaaaaagatgtatagatcaagagtggttatggcttcctgaaaaaagtacagcaggagttagctcacagatgataaagcaagtctttccttgtggagagaaaacagcacaaaacagtgagctcattagtatcacaacgggcagctttgaaaagattcattgagaagactccagcacagtagtcagccttgtgctatctctgatttcagagatttcttgtcaagccaaagcttgtactcaaatagttttatcatccacttaagcgatttctttactaaagtagaaagtaaaatgcaaattcttgtgtagtgaatcaatatcatagacacaaatcttcagttctttcttatcatttttactttttttttttttttgagacggagtttcactcttgttgcctaggctagagtgcagtggcgtgatctcggctcactgcaacctctgcctcctgggttcaagggattctcctgcctcagtctccagagtagctgggattacaggcatgcgccaccacgaccggctaattttgtgtttttagtagagacagagtttctccatgttggtcaggctggtctcgaactcccgacctcaaaccatccgcccaccttggcctcccaaagtgctgggattacaggtgtgagccaccatacctggcccatttttacttttttaaaaccaagggaatagaggaaaatactatgaaactaaaagtttaagcttagctggaataatttatttgaaacaatttagaaaatgaaggtcatgtaacttttgcaagacctttgaaaattaacaaacttaattacaactttgcatttcattgccaagcataagaaggagttttactaaagctatgtaaataattgcattaggatatatagcagagacattctatatatatgtatatatatgtttaatttattttcctttttttttttctgagacaggatcttgctctgttgcccaggctgaagtgcagtggcccatcttggctcactgcaacctccatctcccgggttcaagtgattctcatgcctcagcctcccaagtagctggggttacaggcatgcaccaccacgcccacctaatttttgtatttttagtagagactgggtttcatcaagttggccaggctggtcttgaactcctcctgacctcaagtgatccacccactttggcctcccaaagtgctgggattacagatgtgagccaccgtgcccagcctacttttctagttctagttattagttcgaattcccagacgttctcttttttaaatatgaattaatccttttttctgtgacataaacaaatttggatttattttttagctgaaatcatgatcattgaaacaacctaagttttagaagtaaatgattcttgaagcagaagcactcgtaataagaaaaataactttacatatctcattctgaagctgtaacacttttgtcattgcagggacttgtggtatgttaggcatgaagaaatgcacacctttcagattttaacttattagacaatgaagtagagttcagaaagaagtagactagtgactattgtcttttcacagagcagctgcgttgttatcaaaaggagagctataggatcaaaatgcatcacagttaaggcacagttggactaaaaaatcagattgtaaataaaaatattttaatcatttgaaaactgcctgaagtgtgtgcgtaagctccatactgttgatacttagtgaaagtcagtataatggccatagagcaggaagggtgatttcattggttgtgtttagtatttagagtagtgtgtatgtgtgtgtctgcatacatatacaaacatagacacacacagacatttattctaaaattccacctccaaaattactggtaaagctagcacagaatcacaggtatggaaatactgagtaagcttgattttgtaaaatttaagtgcttactaactattctctcaaacaaaattttatttgtaagtccaaagaaagttaggatttaatttaagaaaggtaacaggaaaaaatgactaagtaatagggccactgacaacacatacagcaacttttctaccagttactaaaagtcactttctctagatggattaattacaaaaaggtaccctcctggaaagacaaaatacaacaaggcactcctttcggtctgacacagtcctgtgcgagacacaaggcttggttagtatagcttgggctggatttctgcttctgctcgtgcctgctctgacacatacaacctgaactgttatgtatattgtaaccctgttctatgaaccgcagacataggctgcatcttcctgagatgtgtgtgtgaatacatatctgtcacgaatgttaaaggtctttgaattgcatttgttcagcaacttttccattaagtcttaagttttctttcaatgaatccacttaaatggaattctaaacgccatttaaagaaagttgtatacggtttctacatcttgctcctgttttactggctttgactaatttagccacgcacattggtggatcaggaacacatttggaattaggtacattccaatacctcagaaaaatatagacagatagaatgtccaatcagatagctacacagtactaggatgtgaaacttactgtgttataacttgcttttgtacaattagaatgttccttactgtgaagagaagctggacttcataaatgccccaataagacaatcactgaaaagcctctttttggtgtttattcttgatagtcatctattactaccagcttaacacattttttaactgcattattctgtaacttttgatttaatgaattcttaatgagctaccccattatactgtaaaatagttttttggttaaatcataaaattttatctttctttgcattaagaatttttattaaagtagggggattcttcaatgttttctctccaggaaaagaataaagccttccttgtttgtagaaaattaacagatttacctgtgcctttgaaccacattagtttttggcttaaagtgagttcaatgcatgtagcgcttaatgtttttgacaagtgtgtgcaattgacattctggtgcttcattttcagaaggggtattgtagtacttgtttagcatttcaaaaactcaagcccagttttttgtatcttttaacatcagctatggaaaaaatgtaagtgatcaagatataaaagaatataaatatgcttattgtgcatagtttgaaattaattgtgaatcaacaaaattactttaattaatagatttttcaagaggtaaaaagtagtgatattgccaagaccttccgcaaagcaatcaacaggaaagaaggtatttgtgctctgggtggaacttcagagttgtccagcgaaggaacacagcattcttactcaggtaatcattttatatgcaataggttaacacaatgtgctaagtgggatggttgctgtaatgtcaaggacgggctctagaaaaacattaccttctaattaagaatacagtagaagtcctttgtgacatgtatttaggcttgagactaatacttgtcataaaggcattataagtgtttattgtatggctttgttagcttgcaagagacaggatacaatccatgtaatgacaggctttattacagtgcattatacagtaatataaatataatttttaaggaattttgtaacttttctgaggactggttaacgtgttctattctttttcttaattttgtaattcctaataaccactgtgttgcatccaagtgtctgggtttccacacagaataaccacatgtttctgacacattaactttcagcactactgcacaactattttaggctttggagtcaaatatttaataagttagagtatgaactaatgtcttgttatttaacataattttagaggaagaaaaatatgcttttgttaactggataaacaaagctttggaaaatgatcctgattgtagacatgttataccaatgaaccctaacaccgatgacctgttcaaagctgttggtgatggaattgtgctttggtaagatgttagcttgttttatatccagatatccaaaaatagccttccatataattgatatatttgtttctgcatgcttgacaggttcacctcaagaaataactagaatggaaaattatccaggttctgcctttttcatttaatctctaggtctgtccatgaatctaaaattcagccataaatcgacaacctctttatagggaagctctcagcctccattttcttctcaacaccaggccagcagaacattacaactttgttgaacttaagtatgtcagtgtctctttattctaaagtaccacagcttccaaaagaaaaaaagaggctactcttcagttctcactctccaatgacctatttctaaaaaatgcttttgtcactgctgctgccccacagccaacagcatcttggcagacataacacaacattatcaacactgccagtcgatgttccaatttatagaggcagtgtcacacagtggttaatagcatgctccataatcagtctgcctgacttctttctattcagtcctgccactctgaagcggtacaactgtgatcataatactcaacccctttgcatttcagtttccatctgttatgatctccacattattatacttatctcacagggcttttgtgagcattaagtaaattactacatacaaagtgcttagggtagtgcaactgacatatttcagataactatatatatataaaatatatacatatatatgtatatatatacatatataaaatatatgtgtgtatatatatttacacatatatattttatacacatatatacaaaatatatatgtatatatacaaaatatatatgtataatatatataatacatgtatatatgtatatatatgtataatatatgtatattatacatgtatatatgtatatatatgtataatatatgtatattatacatgtatatatgtatatatacaaaatatatatgtataatatatataaaatatatattatacatatatgttatataatatatgtatatatacgtatataaagtatatattatacatatatgttatatataatataacattatatatatatatatatgttgtgtgtgtgagatggagtttcgctcttgttgcccaggctggagtgcaatggcgcaattttggctcaccgcaacctccgcctctgggttcaagccattctcctgcctcagcctcctgagtagctgggactacaggcatgcaccaccacacccggctaaatttttttattattatttctttacttttagtagagatggggtttctccatgttggtcaggctggtctcgaactccagacctcaggtgatctgcccgcctcggcctcccaaagtgctggggttacagatgtgagccaccgcgcccggctgacagtatatattatagtatacacaattcttctttttgcagtagggtcattttggttgtttgaaaagctgatattaaaaatgtaagataggctggtcatggtggctcacgcccagccctttgggaggcagaggcagcaagatcgctgaagaccaggagttaggtccagtctgggcaacaaaacgagaccctgtctctacaaaaaaattaaaaattaacccaacatggggttgcacccctttagtcccagctacttgagaggctgaggcaggaggatcacttgagcccaggagtacaaggcggcagtgagccaggatttgcaccactgaactccagcctgggtgaccctgtctgtctaagaaataagaatatatatatatacatttcctttgtgttctgtttacaagcagtgaagaaataatttcccatgtgtgtgttttgtttttgtttttgagatggagccttgctctgtcgcccaggctggagtgtagtggcgtgacctctgctcactgcatcctccacctcccagtttcaagcaattcttatgcctcagcctcccgagtagctgggactacaggtgctcaccaccgcacccagctaatttttgtatttttagtagagacagggtttcaccatgttggctaggctggtctcgaactcctgacctcaagtgatcctcctgcctcagcctaccaaagcgctgggattacaggcatgagccaccgtgcccggcctcccttgcattttaatatagagagaagactgcaagtttccctctctggggactcaccctgcagaactcaaaaaatctataaattgtaaaaataataagagataatcatattgaactaactaagatttgaattttgcatggaaagaagcatggctttctttctgtagaaaaaaatttattagggcagtattatgaacatctaatatgttagagccaggcatagtggctcgcacctgtaatcccaggtacttggaggctgaggttggaggatcccttgagcccaggagttcgaggctgcagtgattcgagctacgatttgggcctctgtactgcagcccaggcgagagttagaccctgtctctaaaaaataacaaaataaaaaataaaatgttaaagtctaaatctagattttaccaaatgagatttttcctaatgagtcacagactatagcctacctaatctttctctcgccactatactgccagcaccaaatatagtgtctggctcattgttgaggcactcggtaaacatttggtgaatgaaagaatctcatgctcaactaattttactgttttgtggaaaagactcatttccaatgcaggattttatctgtctttaaaatatattcaataaagttccaccccccacttttttttttttctttgagacagggtcttgctgtgcagtgattcaatcatggctcactaccgccatgacctcttgggctcaatcagtcctcccacttcagtctccaaagtagctaggactacaagcatgcgccactatgcctagctaattttttttttaactttttgcagagatggggtttcaccatcttgcttaggctagacttgaactcttgagctcaagcaatctgcctgccttggcctcccaaattgctagggttacaggcgtgagccacactgtacctggcccaagttttgttttcaatatccaagttattttctttcataaaagaatgagaaaaaattaaaaaaaattgaaagagaaagcatgctacaatcctctgctcagagatacccaactactatgcacatattttggtctttttgggtttttttttttttaacggcatcttgctgtgttgtccaggatgaagtgcagtggcatgatctccgctcacttcaacctccgcctcccaggttcaggcaattctcctgccgcagtctcccgactagctgggactacaggtgtgtgccaccacgctgtgctaatttttgtatttttagtagagacggggttttcccatgttggccaggctgttttccaactcctgacctcagatgatccacctgccttggcctcccaaagtgtgggattacaggcgtgagccaccatgcctggccagggttttatttatttatttatttatttatttttcttttgagacggggtcttgctctgttgcccaggctggagtggaatggtgtgatcgtagctcactctaactttgaactcctgggctcaagctgtcctctttcctcagcctcctgggtaacctgtactacaggcacatgccaccatgcccggctaatttttttatcgtttttgtagagacagggtctcactatattgcccaggctggtctggaactcctggcctcaagcagtcctcctgcctcagcctcccaaagtgctgggattatagacatcagccaccacatcaggccttggccttttttatttttagtttttattttccatatgtgtagtttattatgatcaacatgataaaagtcatctagctgcattttttagagtacatgaaagagatgttatagtaagctttaaaatatttgtaaatatttacagccactttataaaaggaaatcagctctttttttttacatcagcctttttttaaatttttgtttcagtaaaatgattaacctttcagttcctgataccattgatgaaagagcaatcaacaagaagaaacttacacccttcatcattcaggtatgcattgttctcccctccctttaacatgaaattactgtttgaggacctgttctgcagacttcagcctctgcactctgtaggctcccaatcaatccttgtaaaaactgttgagtgtgggattgttatccagattatacagacagaactgggactcagaaaggtttctgagcttgcctgagattaatgttggaactgaggttcaaatcccattctaatttcaaagccccatgttcttttcatttcataatgtgttcaagcactacagagataagcagaagtatataagctcttaattaactggcgtgcttaagaaatggagcatttttttttctatcaagtgaatattagattattagcaaaattccctcagagaagagcacctcttgggatgtggacattgataacttctaaaactcttttgggcatatgcagtactgttggtctctcacccatttaggcatttttggaattataacactttactcacatggatatatttactgtggtactcagccttttcatttagtgccagcatacttcaaaaggtaccaaataaaaatacaaagttaacttctcatgagattctgcaaaaggcaatagcaataaggctgaaatttgtcttagctaggctttctaacacaaaactctggaatttgttttttgtgacacatatatggatgaaattaatacagggtattaatttcctcattgaatgttattttcagtgaagggagaaagtagactgctaaaaaatggaaaggtcaagaagcaagtgtgtaatttggctgtcttgcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaaggtaatggaacacagtcattctggcagttgtttattggttatttttttctagtcatgcagactttcgtgctctcacttaatggaggtgattaaatggtggtaactagaatgaacataaggtaatgctatagagttattcaggaaaatagcctaattacatgactctcttctttactagtaattcacatttgtctggcactttacaattcattttgcaataatgacacaaaagcacagagagattaaggagctttcctgaagtcctcaaacttgattatctatttttttctgttctgcctacacaacttctaccccgttgccaccctcagctccaccattttgcaccatcttcttttttggagacagggtctcactctgtcacccaggctggagcgcagtggcacaatcagcctggctaacatggtgaaaccccgtttctactaaaaatacaaaaaattagccaggcgaggtggcacgtgcctgtagtcccagcttctccggaggctgaggcaggagaattgcttgaacccggaaggcggaggttgcagtgagctgagattgtgccattgcactccagcctgggcgaaagagtgagactctgtctcaaaaaaaaaaaaaaaaaaagaaagaaagaaaaaaaaagagagaaaatgtaagattgcaaccgggtgtgttggaccatgcctgtaatcccagcactttgggaggccgagacaggtggatcacttgaggccaggagttggagaccaccctggctaacatggcggaaccccgtctctacaaacaatagaaaagttacctgggcgtggtggcatgtgcctgtagtcccagctagtcaggaggctgaggcaggagaatcgcttgaacctgggaggcagaggttgcagcgagccgagatcatggaggcagaggttgcagtgagccgagatcacgccactgcactccagcctggtcaatagtgcgagactctctcaaaagaaagaaaagaaaaagaaaatataaggatgaattatatttctgttaaaataggattgagccttcaagagttaattgattaattttacttaaatacaaataccaccgtgtttctagactactttaatcaaaaggttaagtaaaagattcccaaattgtaaacatctttcccccaaatccctgactttttttttttttttttttgagacggagtctcgctctgttgcccaggctggagtgcagtggtgcgatcttagctcactgcaagctccacctcccgggttcacgccattctcctgcctcagcctcccaagtagctgggactacaggcgcccgccaccacgcccggctaattttttgaatttttagtagagatggggtttcagcgtgttagccaggatggtcttgatctcctgacctcgtgatccgcccgcctcggcctcccaaagtgctgggattacaggcgtgagccactgcacccagacccaaatccttgactttagaagtgttaaataagaacaacttatacaaacatatgacataatgtgaagcttgcattaagcttaaaggccataacctcatttggtatttgaaatgtgaagaataacagagaaaagaataaattgtagtattatgttattatatctgttatatatttatcttttttagtagattatgagtatcttgaaactaggaactatgtcatagtagtttttgcacctctattacttaacagtgtcaaaagactgaatgaacttggcatgaccattattgtgtcatataataactgtgggatttttttttttttcttctagccttggctgctttactccgagatggtgagactttggaggaacttatgaaattgtctccagaagagcttctgcttagatgggcaaactttcatttggaaaactcgggctggcaaaaaattaacaactttagtgctgacatcaaggtaactgttgaaagaatcacaacattttggggggatataatagctggaagatttcatcccagcttaacagagagaaaatcctaacactgtatcaccaagccttgttgtctcttggccctgaaggtagattttagaagagtaatagagccagataaggtacattagcacctatgttttattttgtgggaaaaggtaaaaatattatgctaatttatcatattataatgctaatttgttatatcctgcctattggtaaacatggagtattaaagaataggacatgactattctattcttaactgcctttcccaagcctcagtgtacctgttagtaaacacacctagaagagataggaagggcctcatgatttcctcttcaccttttttatttggcttctctcctgtcattttatcctacctttagttgtgagttcctcgaggatagcaatgagctcttatttatgtctgtgtatcctacctcagcccctgctccagggccctcctactaaagccaacttaaaacatagtatgtggcatatacaagaccctcatatttcttgcattgaattgaatttttttttcactcactgtttatcatgagcagtgggggaaaactaacaatggaggaagacatttattacatgttgcctttggcttctcatgcagagggccaacattaccatagcaaacattgtgtggagttctccttaactgcctcaattctgtgtgacatccagatgttggtacacagggaataaacttaaggatcttcatcagatgtcactgaccagcaaggctgtgaaaacaatactatgtgatgatatgattttgttcagtgatgagaggaagcagtgagttgcctgtactactgatttcatccatgaaaattaagagtagccccaaaattataagaccaactgaccctgccctctcttttaattacacaatatgtttggccaggtttgttgttgttgctgttgttgttgtgacagggtctcacttcgtcacccaggctggagtgcagtgctgctaacatggctcactgcagcctttacctcccaagctcaagcaatcttcccacttcagcctcccaagtagctgggactacaggtgcacaccaccaagcccgattgatttttttttctttttctgagatggagtctccctctgtcactcaggctggagtgcagtggcactatctcggctcactgcaacctccgcctcccaggttcaagagattcttctgcctcagcctcctgagtagctggaattacaggcatccaccaccacgcctggttaatttttgtatttttaggagagacagggtttcaccatcttggtcagactggtctcaaactcctgacctcatgatctgcccacctcggcttcccaaagtgctgggattacaggcatgagccactgtgcccggcctgatttttttattatttgtagagatggggtctcactgtgttgcccaggctggactcaagctcctgggctcaagtgatcctcccacctcggcctcctaaaatgctgggattacaggcatgagccatggtacctggccagccaggtatattttgcttcatgcactagatgcgttcctgaaaatcagcaagccaaccataaatggattttatgtagtgggatatattttaaatgtaaagagaaaatcttatttttgtaaatgaagcctgctttgaatttttttattttttattttttaaattattttttgtttatttttttttttgagatggagtcttgctctgtcgcccaggctggagtgcagtggcgccatctcggctcactgcaagctccacctcccaggttcacgccattctcctgcctcagcctcctgagtagctaggactacaggcacccgccaccatgcctggctaattttttttgtatttttagtagacatggggtttcaccgtgttagccaggatggtctcgatctcctgacctcgtgatctgcctacctcggcctcccaaagtgctgggattacaggcatgagtcaccgcccccggccatcaatatttttaaaaaggaaataattgtttggtaatgtgaaaactaacttccagtttatctgtattcaagttcaaattttcacctgtaaagcccttttcagggtagtaaatacagattttgctgggtctgctctttacttgttcttctcaagagcataggtttattataaattgtttgtgtagctttagcaagtaattggaagtgaaagcactttcgcaattgtagtacactattccttaagaggtaaatgctatgcccccaaatgatagaatcggagttggcattttatgaattgctctgaaatagctttcaattacctgattttccccattcttagaatcatttatggcaccaagtttcaaactcacctgggtaactggtttaaaaggcacctttctgggcagctcccagacatttatatttggtagctcaggaattggattcagtaattcacatattgagtaacttcctcaggggttagtatgcacatagactatgagaaacactccttcatagcctgtctggaccttcaaagcccagtaacaggaaactattaatatcgtagctggaaggtggtcttcacatatggcaggattaaggaatcttgactcaaattccggtcctctagcattccaaagatgcaggaatttacttgacacgtgtgtaaaggttcttaataagcgtttgtgcaagtacaatagttttcaagctgtgttttgtggagttgtccacacaacctgaattcatgttgactgtgagccaaccccattgttttatgtattgggattctaagaaaacaacattcaagtgatttagtccaggggtttaaaacgaaaagagacctttgttttgttaagtacattcagatcatagagggttcagtgttattttagcaactaaaatgtttaccatttaatgcttttgtcatttaaatttacaattaaatacatctttaacatagctaatctcttcttcgtaggttgtggtatatgcattgtgctttgtaatgatataacctgtttattttctctttcttctatgcttcctggatttctgctctcctacttttttaaatgcttgttttgtctgtcaagcttattgacttcagtaattcagtgaaggtacagaactggttatatgtttattagcattattgtattgatgactttaataattgcgaagtcatgtcaaaatccagttcatccatatgcaagacagatataaggcagatagatggacttttctggggaaaacacctgttaaattaaaaggcagagatttgtgccatttattctcaaaaaatccaatgcaaatagccttccaaacatgggacaataggatacattcattccttgtaactgtgatctcactgacattttcaattctttgtaggattccaaagcctatttccatcttctcaatcaaatcgcaccaaaaggacaaaaggaaggtgaaccacggatagatattaacatgtcaggtttcaatgtaagtataagtgctcttttgaattctacaatcttgcaaaattattgtcaatttcttataagtacaataatttttataatcgtatgaagtagagttggcaattttaagcattattttaaaatgtattactgtacatgtaattcagaggccagaaaactagctttgatttattttgattgttagtgaattccatcgttgttgtggtattgatttatatggatggcataaaatattcaaaacaagtatggggaaataagtaactagaagctaaccttttccaagtatttggattacaaccacagtaatagatttagtgactatatgaaaaccttttccaagtatttggattataaccacagtaatagatttagtgactatatattcatattcctgtgttgagagtaatgtgattatgttttacaaactcccaatctatgaaatctaatttagggaattactctcagagaccatgttccctggttatgtcactaatttgtttagtgacattggacaagttccttctcaaaattggatttcactttgttcatccataaagtaaggagttagagtgaactatttagtcccaagtttctaggaatctgtggtttttgtacccattagatatggaatgcatgctactaattaacaaaatccacatatctagcctattatgccataggatggagtggattacattggctaaaccatttttcttctctttcttttttttttttttttttttgagacagagtctcactctgttgctgaggctggagtgcagtggcaccgtgtcggctcactgcaacctccatctcctgggttcaagcaattctcctgcctcagcctcccgagtagctgcgattacaggcgcccaccaccatgcccagctagttttatatttttagtagagatggggtttcaccatgttggccaggctggtcttgaactcctgacctcaggtgatccactcgcctcggcctcccaaagtgctgggattacaggtgtgagccaccgtgccttacgtggctaaaccatttttatgctgcccttatcagaactgaatttgtaactgacttgtgtgcttatatttctgtctgtatgttaaatgcaaaactcttcagctcaggtcactcttggtagggatgaggggccatcttgtccaagaagggagctgtctgggttggctagccatgtgatctgataccagggtaaatggcatcagtatgctaaccgattctgatacaccccttctctagtcaatcctttccaattgatcttaaaacactcttttgtctcttccctcttcagaatccgacaaggattcttctgttgactctagaattcagtctgaaatgttctgcttggcactcaccctacaaatcttgctctaaaatctagccagtgttatttccccaaaagtctgtgttccccaccccaaccttccttcccaccaccacccaggtgcctttgctcatgctgttctcatggttttcagtgtccttcatctttttcagctttacaccttctttagggtcttttttttttttttttttttttaagagacgaggtttcgccatgttggccaggctggtttcgaactcctgggctcaagcaatccttctgcctcggcctcccaaagtgctgggattacaggcgtgagccaccacgtccaaccaaggcctaattttaactctgaacagttttacctgttttttatttcaatttaacttttttctcttcgtctttgtaatggaaaaaatcccttcctttcgtcctaacttttttaatccttcaattccctgagattaatccttggtcttgccttccaccattctccctacgctcaaaagaaatcagtggaaatagattctctgcttctcttcaattcaagcaacagttcacaagcatttcccttgggatttgagcatgacatgaatgaaggtgtctgtcttctccctcagccagggaagcctacttccacagctcagcacaacttcctctctctctagctcgctctccagcagtgccctcctttctagttccttctgctgcataacacagccccagaggttccagggttccaaggagtccactctgtcatgaagctcattgacttaatgcacagtacccagaagcctcagtgaagttcagctgagagccagtagaaaaaaggagaaactccaaagcagaaagtagtaaatcagcaaaataaaataaaataagccaggttgaagagaatgaacccacaatttacagaaaatgaacaccattttctaaaggagacttaagtaggactacagttaataccctttcacatttaataattaattgagattcattgtagataaagtacatttgaaaaaaaattttaacataattctactgaaaatatctgaatatttaacttgaggtggcttaaaaggacaattgaagctgttttcctattgagaaggaaaaaaggaaaagtggaaccagagaaagtgaagatggtgaatgtatatttttctctacagattttcaaacaaaatctgggagtttcccccaaccttttacgtaacttctttcttaatgcaatttagttaaatgtactcagtagtttgctgtgtgatctggcgccatctagtgtatattacaggtactgcatctccaagagggccaacctttttttttgcattcaaaacaattttataataagtaccatatgttagctaaaagaaagtagaactgtatacccagactatgacagtggggaaattttctatatttttagtgtggcctttgacaaagtcttccgattttgtttcaacaggaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggtaactaaaaacctcaatttcgaatgtgtgggactatagagtagaaatacataggccacaatgattttacaatctagacttaataagtttttttatatctacaagaagtagatggcagatgctgagtaaaaactggcaggaaagtacgatacaagtgaacttttaaagtaaagtagtcgaggccgggcacggtggctcacagctgtaatcccagcactttgggaggccgacatgggcggatcacctgaggtcagtagtttgagaccagcctgaccaacatggtgaaaccccgtctctacgaaaaattaaaaaattagctggggcgtggtggcacatgcctgtaatcccagctactcgggaggctgaggcaggagaatcacttgaatctgggagacggaggttacagtgagccgagatcgcgctattgcactccagcctgggcaacagagtaagactccatctcaaaaaataaataaaaaaaataaaaagtagtcgagtcgcttaatgtaaagccacttagtaaatcagtatttagttttaatatttagggttagaccactttttaatcctctcatcaggaaaaagtgcacatatgcattcagtttgacctgtaaatttagcatatatttatgtttcattcatccacagtcaatgtaactggaactaaccccaactcctttcacctttacctcctcaagaaacaaatgataatatatactaatttttttttaagttttggaaaggcagagtttaccttttccagattatatatgtgtgaagcgtagtctataaaaattaagaaatgcagccaggcgcggtggctcacgactgtaatcccagcactttgggaggccaaggtggccagatcacctaaggtcaggagttcgagaccagcctggctaacatggtgaaaccccgtttccactaaaaatacaaaaaattaggcaggcattgtggtgcgcacctgtaatccagatactcgggaggctgaagcaggagaatcccttgaacctgggaggcagaggttgtagtgagctgagatcgtgccattgcactccagcttaggcaacaagagcaaacctccatctcaaaaataaataaataaataaataaataaataaataaataaataatgcaaatagtaattcattgagtgtccactgatatttctataaaaccagtaacttaactgataacatcagttactttgagggatgcagattcgaggaaatattggagaaagatttgagaaggagactataaaaagttcataaacctctaaattgcttaactggttagaataaggttgtattctttaattttaaaataaattcaaattttaaaaataagcctgtacctagagagaatgtatgtacttagaagaatgcttggaaactcgtattatcgaaaaattctagatctgaatagagagataaaataatctaatatgtgtattggcactatatgcacatacataaagtgtttaatgaatcagtaaattttgtgaatattcttaacaggagaaactcgtgaagaaagaaccttccgtaactggatgaactctcttggtgtcaatcctcacgtaaaccatctctatgcgtaagccttcctactgctattgtaaacagttacgaatgtcatgaatggatgttaaataatgacagctctaaagattttctagatattaatttgtagctattatttatattggaaaatgtcaagtggtgatttccatcatcattttccaaatacacaaaagctttaagtattcctttacatgatcgttaactgtaagtgatagaatatataaatgtctttatagtaccctagggagcaaatactttatattttgaaacagctgtttgggaggttgaggtgggggcattgcttgagcccaggagtttgaggcttcagtgagctatggttgtgccactgtactccagcctgggcaacaaagtgagatcctatctctaagagggaaaaaaaaagaaaggtaaaaaagaaagaaacagagaccagggaatcctttaagtagaccatccacaacaactcagggactttggttcattgttctctcagcctggaacgttctttgctcgcatatagtggctcgtatccttactgtattccagtcactgattcaaagatttcctgactaccacctgctactctctaacccctaaccctagttcctttttttcttaatagcacttacatacacccctaaaattgtttgtttattgtcaacaaaccaataccccccgtattgtttgtttatccatgtacttgtttattgtctatctctctgactctaatgcaaggacagggatttttgtcctgtgggcccagcctctagaacagtgccttgcttacagtaagctctcaataaatacttataaatgaatgggatggtcttagctctgttttcagcacagattgatagaaaatatgagtcttgggtattatttatggttttatatatcttgtttgacaatgtagtgttactgtttttaaggaaagtcaagtcccagcttcctgaaaacactgattacattatttttaaatcattagtgacctgcaagatgccctggtaatcttacagttatatgaacgaattaaagttcctgttgactggagtaaggttaataaacctccatacccgaaactgggagccaacatgaaaaaggtagataattaagttgctgtatatatttgttagagtatttttattctcgattaatttcttttgtttctaaaactcttgacgctgagcttcttgaggacaaaactgtgtcttatttgtttttgtgtgctgatacctagcattatacaagacacacacacacgtatgcagattaaacaaatggaagtctttaaccatttactcttgtgcctttgcagctagaaaactgcaactatgctgttgaattagggaagcatcctgctaaattctccctggttggcattggagggcaagacctgaatgatgggaaccaaaccctgactttagctttagtctggcagctgatgagaaggtatagtacacaattttagctgtttagtctttactatcatacaggtctgtgatttagtccttactgtgtttaataagtggatatgtcgataactacacttttgaaatatgttatatttacactccgaaatgagtttaattaatgaatatatgttggatgttaagtgggagatgcttccttgcaagttaggcagcagaactatggttagtcccttttttaaaaaataggaagcctgacacacagatttcggcctcgtttagtgtcagtgaattaaaaaattgtcagaacaaaattatgaacatcttcatgctcatttgaaaataaagatctctctctgtaatgctgatgaagatcactataatgctgaaaagcattcattatgactgggcaccagccaaagcacagcttattttatgccattaccgctattggaatagtacaaaatgtgcctacagtgggctgttggacctgctcattaaagcactgtcaatctgctcctctctcaccactacaaagagtagatcagtagcaagccactactgcttgaaatatttttttcacatagtgtgaatctctttccatgaaatctttagtccttgaaatttaaggaatataggggccaggagtggtggctcacgcctgtaataccagcactttgggaggccaaggagggtggatcacgaggtcaggagatcaagaccatcctggctacacggtgaaaccctgtccctactaaaaatataaaaaattagctgggcgtggtggtgggcacctgtagtcccagctactcaggaagctgaggcaggagaatggtgtgaacccgggaggcggagcttgcagtgagcaggagattgcgccactgcactccagcctgggcgacagagcgagactccgtctcaaaaaaaagaagaaaaatttaagaaatataaaaagtggaagataaagcatctttctgatgtttgcatttttcctcataaagtagatggtgacgttttcttctgctgcctctcttagatataccctcaatgtcctggaagatcttggagatggtcagaaagccaatgacgacatcattgtgaactgggtgaacagaacgttgagtgaagctggaaaatcaacttccattcagagttttaaggtcagaatccatatttgactattaaatattatgtttgctggataacatctatcatttgggaaggcaacttttggcttctttgtgagtgagaattagtgttgggctaatggcacaattctttacgaattcactgggctttgtttttggcacttgatataagtaagcacatgttaatttgtatgtatcaaaattctcagatttgttctcctttcacactaggacaagacgatcagctccagtttggcagttgtggatttaattgatgccatccagccaggctgtataaactatgaccttgtgaagagtggcaatctaacagaagatgacaagcacaataatgccaagtaagggagactgctaatagtatgaaaagaacgcagctttgtagctggacagatctgaattctaattcaggttctgccatttaagagtggtgtcaccttgggagaaacctcttggagcctcagattcctcatcaataaactgggggcaataatacttaccttagattttataaagattaaatttttaaaaattataagagcctagccttgtgcttggcctactaggtgcttagtcggttgttgcttcagtggattacagaaataatgtagcatgtattttaatgcaaatcaggtaaaactttacaaggaaaataagagcttagggtgttcatctgtctgtctcattctttttttaaaaaacgcattatccacttatgtctcttttactatacatagatcattcttactacatttattgaatttatcttcatcagttcccatattaacagaatgcttgctagccctccacagaagactatgccttgaaagtttcttgcatttcaacaatattcagaaggtcttttccaccagcctattttcttcttcaccaaaggcctagagtgtgacctggcttcatgggtgacccatgaaaaccttactagttagacattgaaaatccatccacagtcctgcattaccgaacagctaagaagcattcctgcaaaactttggagttaggcacattatttcttttttccttgaaaaatatttctagcagatatgacaaaggtctaatatccacaatatatcaagaactcttgaaatctctttttctagaaactcgatgatttaattatctttaaagattctggttccaacacacctagaaatacttcacggattagttgagatgtgttcctgaaaatttccctacctggacatctcagttcttctgtcccttcgtctaccttttctagtttttggtccagccactctgtccacgtaccacgtagactgtctcccctctcatgaatacttggaagtattcattgcatctgcctaacaacttgggttttgcatctagcatgattttccacctcatatctctaagatgacttgagtgtgtgttattatgtgtgcaatgagaatattaacatggattgtatagacagcctaggtaattatatatataaagttggtgcttcaagcttaattctcacctcacattggagaaaaagagtgaataaatattattagccccaaataatagagcttaaaaacctactgtaacttcaaagtgaaatcaaaacccaaatcaaaagaaaacaaaaagcaaaactgttctaattggaactatcaatatggaatttttgcatcccagcataataattatatatgaggaaatagatgtcttacgtggtgtccttaactgacaagaatttcatcctgattttgtttccccctaaaataggtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataattagtctgttcttcatgcttttgtctcttaggaagtatgccaatgtttgtcaggatttttttctttttgtttttctgatgtattctgtaaaatggtgtttgttaaatttgagttttgggagctgaattagaggtactgaattaaggacagtacaaatgaagtaaaaaggttttctccaatttacc

SEQ ID NO: 4943 - DNA, 2084 bp, human; identical to SEQ ID NO: 3642

SEQ ID NO: 4944 - DNA, 2040 bp, human; identical to SEQ ID NO: 3643

SEQ ID NO: 4945 - DNA, 538 bp, human; identical to SEQ ID NO: 3644

SEQ ID NO: 4946 - DNA, 218985 bp, human; identical to SEQ ID NO: 3645

SEQ ID NO: 4947 - DNA, 219051 bp, human; identical to SEQ ID NO: 3646

SEQ ID NO: 4948 - DNA, 219526 bp, human; identical to SEQ ID NO: 3647

SEQ ID NO: 4949 - DNA, 219051 bp, human; identical to SEQ ID NO: 3646

SEQ ID NO: 4950 - DNA, 3178 bp, human; identical to SEQ ID NO: 3651

SEQ ID NO: 4951 - DNA, 43365 bp, human; identical to SEQ ID NO: 3652

SEQ ID NO: 4952 - DNA, 43737 bp, human; identical to SEQ ID NO: 3653

SEQ ID NO: 4953 - DNA, 42625 bp, human; identical to SEQ ID NO: 3654

SEQ ID NO: 4954 - DNA, 43179 bp, human; identical to SEQ ID NO: 3655

SEQ ID NO: 4955 - DNA, 41652 bp, human; identical to SEQ ID NO: 3656

SEQ ID NO: 4956 - DNA, 41651 bp, human; identical to SEQ ID NO: 3657

SEQ ID NO: 4957 - DNA, 48307 bp, human; identical to SEQ ID NO: 3658

SEQ ID NO: 4958 - DNA, 10813 bp, human; identical to SEQ ID NO: 3659

SEQ ID NO: 4959 - DNA, 71944 bp, human; identical to SEQ ID NO: 3660

SEQ ID NO: 4960 - DNA, 22940 bp, human
tgcaaatttaaagcccttaagagcttttttgttaagaagaaggaaaaagaagccgaagatacccaggaagaagaaatgctagaactgagcttgtccagcagcaacattaacatctcttctctgcagcccgttcgggaaaatcaaccaactaaggccaggtgagctcagatgcggtggagagtgatggggacaggggaagaggcaggcagttggatctaggtcacctttcggcagccaaatcaccagggacaccaagagtccccacctgtgggggccaggcttgcagccattgccaatgcagtcatgtccgggggaggggggtggtgcttttctctgtgtgcatatgcatgtttgttgtctgagctgcacatctcagtgggttggagcatggcaaatgcataccccacttcccgagagcactgaataagagggtgcagatattcagggaagccctgcctgtcgcaactaaaataacttgagatgtggggcctgcagccaatgaggagctgaaggcctgtttgatctggtaagaagggcctacgtcattcaggaggcttggtctggtttgcttgcctggctctcagactaccgatctagccaagatctcataacaagtgatgaaagcctcctatagtaaagctatctagctgggagtggggtgggtcatgagcatgagatcactgtgttgctgtaaaaacacacatgcaagcaaacagcccagatccctttctccctccatttcaggagactaggggaaatgctatagtcacagggggcatggggaagactgtttccagctaccactgccaccgctgttcagatattcatctgcagtgcccaaatttccacatcctattgtgctatctggacacctaggattcccagctgtctctggatcaatcagatccccctctatgaagttctgcttaggcctgttcttctggccttaaatgccagacttatctggactccccacagagctcaccagtcctgctgcccgctccaaccaggcaaagccttgagggaatgaggcagttagctgacatgttatactgtccccaatatctcccccaatacattctataacataatggcctgatagttatcatatatggctccttaagaacaaccttcatgagtgcatccagtgtaaggaatttcaagtagtcttgctgggagtagggcagacggttttgaaagaggggcttatgtagtacctcacaagtaatactattatagcccattgccttgcagtgttcagtaagactaagactagccctgctaaaacccagggggaggtcagggaggggcattcaggtttactatctctgctaaagttctacatttctcccttttacttgttccttcctttccagaagtgtgtgcacatgtgaacctgagagagagagagagagagaagggggggatttttttgtgtgcaaggaaattcaaataatataacttagggggcctgaagatcacccctggtctcagtcttctgcttaatgtgctaggggaagaaaccctggaaaatgtcactccggagaagggagatcagcttttttcattcactgaagcaattagtcataacgaaacttatgaccagccttcccctggcctgtaccataggaccagcatctatttccaagactgtattaagccgtatctgatggaatggacaaatcccgttccttcatttgatttcttaatgagtgctgttgtaataatatacttcactgcccttaattaaggctgagattttgtttgggagtttttatttttatttttattttcgcctccagggaacagatcaatgagcacaagatatgttaagtggacaagagttttcatttctgacagacttggccacaactggtgctaatttaatcttttgatcagggagggcttggcactatagagccaattcaaccatttcactttggttaatgcacagcatggaaatgagagacatttctaagcccactcatagcccaagatttcctctcactttttctgcaaaaagcagaggaggcaaggtagtcacagatgctacactggttctgaacctgatttgagccagtagatcatagagcagcagtgaatgaaagcgtgttatatgtgcatactgagcgtatgcgtgtatatagagatgtctggaaacattacattctcaatgctggatcaatcatatatatatccattaagtgtttatctagagagtcacagtaattttctgctggactgctgttttataaagcagactacgttgcttccaacaccagggccacctggatagcagagttttatagggaaaaggtaagtaggagtttagtaaaaagcagcagacatctctctcctctcctctcctgttggcccacaagccatcttagagcgggttctgttttaatccccataacatgagattgtccttatagtgtgtcattatcaaatatatccatatgaagtccccacaggctcataatgacagggcaggtgctagccccacaatgcccaagctgctactctagttaccatttgaagattttttttaagtgctaacataaatgtattgttttgtaataaagataataagtacaaaaagggcatttaaacattttaaagtttattttatctgtttttaaacattgctacccctccctaaaagaaaccctgtaccaattaacaggttcccccctaaataaccactaatctactttctgcctctataaattttcttattctggatatttcatgtaagtggaatcatacaaaggttgtttcacttagtatgttttcacttagcatgttttcaagagtcattcatgttgtagcatgtatcagcttacttgcttttttcttcttttcttcctttattttttcgtgtctaatctcatcttttatataaacatacacattttctcctacctaacaggaataacttttatcatttaaaatttttatgtttctatataacagctttcttgaaatataattcacatactacaaagttctaccttttagcatgtgcagctatcactattacccaattttaggacattttgtcaccctaaaaagaaaccctgcgcccagtagcagtcattctccattcccctatcctctttcaaaccactgatctgctttctgcctctatggatttgcctattgggaacatttcccatgaatgaattatacaatatgtggctatttttgactggcttcctttcacttactatgttttcaagggtcatttatttaaaatcatgcatcaagaacttgatttcttttttggtagcagttttattgagatataattcatatattatacaattaaaccacttaaacggtaaaattcaacgttttttgtaaatccacagagttgtacaatcatcatcataataaattttggaactttttcatcacctcaaaaataaactcctgtacccattgaccagtcctccctattcaaccttcccccaacgcccgccaggccctagaaatcattaatctgctttctgtctctgtggatttacctattctggacatttcacatgagtggaagctggtcttttcttattgacttcttgtactcattataatgttttcaaggttcattcatgttgtagcatgtatcagaatttcatcctttttgctactgactgtccattgcatgactataccacattttatccattcatcagttaatggatatttgggttgtttccaccttttggctattgtgaataatactgctgtgaacatttgtgtataagttttggggcagatatatgtttttatttctctgggatatatacctaggagtggaattgttgggtcaaatggccgttatatatttaaccttttgaggcactgctagactgttttccaaagtggctggaccactttaacaccagcaatgtatgggggcaccaccagcagtgtatgggtgttccaatttctccacaaccttgccaatgcgtgttattatctgaattgaatttttcattctagccattctagtgggtgtgaaatggcatctcattatggttttgagttgtatttccctgccaactggtgatgttgagcatcttttcatgtacttgttggccatttatatatctttggaaaatatatttgtatatctttcttgtttggagaaatgtctattcacatctttttttattttctaattgggttatttaaatttttattattgaattccttaagaattcaataaaaagaattcctattagtaagaaagagttctttatatgtttcagatccaagacttatcagatatataatttgcaaatatattcttccattacgtaggtcatcttttcattttcttcctagtaacctttgatgcacgaacatttttaatttttatgaaatccatttgtattagtccattctcactgctataaagaactacctgagactgggtaatttataaagaaaagaggtttaattgactcacagttcaatcatggcagaggataaaggggaagcaaggcacgtcttacatggtggcagtagagagagagtgcaagcggggatgccacacacttttaagccatcggctctcatgagaacacactcactatcacgagaacagcatgggggaaactgcccccatgacccaatcaccttccaccaagttcctccctcgacatgtggggattacaatttgacatgaaatttgggtggggacacagagccaaaccatatcactatttatctatttattttttcttttgttacttgagcttctggtgtcatatctaaaaatccattgccaaatccaagatcacaaagatttactcctatgttttttctaagaattttatagttttagctctcatatttaggcctttaatccattttgagttaatttttaaaattacactttaagttctgggatacatgtgcagaaagtgcaggtttgttacataggtatacatgtgccatggtggtttgctgtacacatcaacccatcatctacattaggtatttctcctaatgctatccctcccctagccccccaccccacaacaggccccagtgtgtgatgtaccaccccccatgtcgatgtgttctcattgttcagctcccacttatgagtgacaacatgcggtgtttggttttctattcctgtgttagtttgctgagaatgatggtttccagcttcatccatgtccctgcaaagggcatgagctcatcattttttatggctgcatagtattccatggtgtatatgtgccacattttctttatccagtctatcactgataggcacttgggttggttccaagtctttgctattgtgaatagtgctgcaataaacatacatgtgcatgtgtctttatagtatttttatatatgttgtgagataaaggtccaacttaattcttttgcatgtggatacccagttgctccagcaccatatgttgaagagactattcttttttcattgaatagtcttggcacccttgctgaaaatcaaccatagatgtataggttcatttctgaactctcaactctatttcattgatctatatgtctatctttatgctagtgctacactgtcttgattactgtagttttatagtaagctttgaaattgaagtataagttatccaactttgttcttcttgttcaagattattttggctatttgtggtcccttgcatttcactatgaattttaagatcaattttctggaaaaaaaaaaaaagccagcatgaaattcaatagctattgcattgaatctgtagatcattttgtgaagtactgccatcttaacaagtttaagtcttccaatgaatgaacatgggatttcctttcatttattcaggactttggcattttttctcatcagtgtcttatagttttcagattatgagttttgcgcatcttttgttaaattgacttttaagtttttattcttttgttgctattgtaaagggaagtgttttcttaatttcattttcagattgttcattgcaagtgtatagaaatacacttgcatccttcaactttgatgaattcatatattctagtcatttttagcgtattcattaagagttttatacacaaaattatgtcatctgtgaatagagataatttcacttcttcctttccattctggatggcattaatttcattttcttacctaatttcccggtctataatctcccatacagtgtcgaatagaaatgataaaagcagtcatccttgtcttgttcctgatcttagggggaatatatccagccttcaccatgatgttagccgtggtttgtcacagatatcttctatcaagattgagtgcatttatcatggaagggtgttgaattttacaaatgttttttctgcatctattgaaatggtcatatagtttttgtttttattctattgatacagtgtttggcattcactgattttcatacattaagccaatcattccttgtaaatcctactttgtcatggtatacaattctttttatatgctgttggattcagttcgtgagtgtgttattgaggatttttgtgtctatattcataagagatattggtctgtagtttgctcttcctgtgatgtctttggttgaaattttttaaaggtaaaatacattaccacactccaaaaaggagtctttcatgtctttagcctttcatttgtttttatctttcttctgatttttcttaacatgtaattatcatcaacctggcaccattcccaatcagaaggtattttcatctggatttagcaagcttggggaagggaggtgcaggtggtacataggatgactttgaaaataggatagatatattgtagagctcttgtgtgaaagaggaaaggatctgatgaattaaagccttgtgtatctgtgaagatctttgattttttttaaatcaaaacaaaaacacgagagaaatttggatgtgaaagatcttttataattctcactgtaataataacaaaactcatggcctttcctcccattccccggaattgccactattgaattatatactttaaatgggcaaaatgtatggcatgtaaactatatctcagtaagactgttatgtaaaaaggatatatgctcataatgtaaaaattaaaattatacagaaggacatgaagtagaaaatgaaaatttcattcctgtccctagtgcgccattcctcagagggaaccacctctaacaatttgtggatatccttctagacttttttctttgaatatgaactatatatgtgtgtatatattaaatgggaccatactattatctttttcacttactatctcatgaaccactttctatgtcagcacatatgcatccctgctctccttctgaggtatctatggtaggccatattatgaatatacatttgtcttcagttcccatggcccttgggttgcttttacaagacctttcctttctgtccagggccaagagcagcatggggagcaaagccctatcccatgatagcatcttcatgttgggtcctgagcctgaaagatcagcaagtaaaatgtttccttctatggatccccagagaggcagacctcagcaggtaatagtggactcgagcatcagtgtctaattggactacttctcttctgttccctactctaaccctgccaaaattaaaaggagtgggaacttggttctgcttctcagctgatcctacccccacagggctgttgtaagccttgagtgacagaatgtataaatatataatgtgcctattacctggcacacagtgttgattagtattgccatattcacttctttttttttttttttgagacaggtctcactctgtcacctaggctggagtgcagtggcatgatcatggctcactgcagactcaacttcccaggctcagcttcccgagtagctggcactacaggcctgtaacgcctggatgattttttggtactttttgtggagacagggtttcaccatgttgcccaggctggtctcaaactcctgggcccaagcaaccctcccgccttggcctctcaaagtgctgggattacatgcgcgagccaccgtgcctggcctatattcacttctcttaacacaccataagaataattattttggcagcaacattccactgtttatgtgctggcataccaatcctcaagtttttttctctctctcttacacagagatcccatatttccagaactctgcctaaacctaggagtaaggttcctggagttgtgtctggagccatgtcaggagctgtgcttcaaaatgtgcctacaagtgcagtctgggttgctggccccaagatcactgaggtaacaaagtggaattgttcagcgcatgggcagctgagtcagaaagacagatctatgcttgaattcctactctgctacttactggctgtgtgacccctgggctagttgattaacttctctgggccttcttttcctcatctacagtgggtataatattaacatctacctcaaagggttgcttgtgaggattgaatgaagactcagagaagttaaagatattgctcaagcccaccctggtagtaaattgtagacttggaaatctgacccaggtgtattaaactcaaaccccatgatctttccattaccccaagatgctcaacttctttatacctgcctggacagaaagaagggtacaccttagcacctacataatgtagcatgtatgtagcatcttgcctccagctaatcctaaacttatggtagggatccattgctcagtcagagtatagctctgatccagaaatgcttcagggggagctgaagatattgtcaaggagacaacccttaacagctgccttccccgtctcagcctgtgggtggaattatgcccaaaggtccctgtgtaagtgggaagagaacaaggaggagacccttctccattggagagatgattattttccatttggcaaaaggtaagtggggcttatttctgacatgtctgttaagaccccacatctctcactctggtttcctttcttctggatcctttagctatagaggagaaaacactgagatagacactaatggtgttgaccctaaagttgttaagcagcccctagggtcagaagactatttccctcttgtactacagcaggaaaagtcacttccatgaagtattcaatcttcagttttaaacatcaacactagctttcactcacctccatagttacactccctgcagcctcatgaccatgaccaagtggcaacagggttctcacattcagaaagaggaaactggtttcttggactcctccttctttcccctcctctctaagtcccagcaacagagagactcatatagcagagatattccatttttttaaaaaaattattttttgtgaaaattaaaggaaaatattctaggggcattacttctcacaaggaagtggttggggaaggccacaatagcctaaaggcaagctttcttaaatgtttggcttgggcctatacctcacacttttggcctgatcccttagttgataccctggaaaacaaggctgaagacaacatagggtattaataggacctaagttatcaacaaccaacctgacctttgcatgggaaatttcccttaagtaccaaaatgacaaccccaatggaaggatggttgatagcattaagtcaagggtcctgacacccagtgctacataaaagctggggcaagcatgaaattggccagtggggtcaattcccttgaaggggcaggattctaatggattaagtgacattcagaacaacgaggagattgttaaagaagaaatccaggtatacagttatgtcagaaatactgacactgagccaattttatttcctgccagattttcacctaatgtcctatctgaagtgttaggaatgtggatgcctacattactctccaagacattttctgttccctttatttgagcacaaatagttaaaaagatacaatggcagattattagcatcttgctgttgttgaatcaaattgaatttagtcatttaagaaactgagacttcaaaacagtttttcttactgctcacgggcttgactgtccctcagcccttcttaaggaagcaggcacaccatatgttctggttgttgcctttaaacgtcttgaacttgggcttcagtatgggctctcccttttctggctcttataattaggagacacgagttcacagtgatcaagaacaagggctatcaagctggacagacctttcaaatgcttgctctgccactgaaagaattagggcaggttacatcatctctcaaattttgttttccccgtccgtaaaatggagcccacaatagcaaatgcttcaaagaattgttgtgaggcttcagtgagatgtatctatggagagcactctctgcttagcacattgtaagctcttagtaaaagttagttgtcattattgtaattattattattaaagctgggcttggaattggttgatatggcctctccccaagagctcccaatggggcctggtagtaataaggaagcactggagacactggccaggagcaccccaggagcacaacctttgtaagcttcactgtggttccttctttggctacagtgtctgaaggctatctgccctgagctgagcagagtctacaacagaagcaagtatgtcagcttcatgaccacaagaatttgttttgtttattgttgtaggcccatttcctggaatggggtgtaatgcattgcagattcttggccagtatttgttaaagataaaaagcagggattctgacccacatcaagaggaccatggcagggaccagtgtctcaaagtcaagtgtaccattttcttcaaaatggaatcaactaaattgtctgctgaatcccaaggaaagcccaaatgataaatttttgtccctttaggaaaccattccatagattttctttaaaatctatagatttttaaattctgtagattttctttaaaatcccagaaaatcattattgacatgattaagataagcaactaacacagtcaagattcaatccaaataattccttgaataataggagcaaagagtgcagtttggatgccaattccaggtcataactcaaaagactcgcctctatgagaactggacttccaaagtcaaattcagacattaaaacaaagatcagaactaaatgagatttgtatttaacatcagtaaggagataacatcaggattctgatcttgcacgaacaagcaatttgaagtttctgtctttgtttggggattggcaaaagtgtgcagcaccccagaggggaaatcaaggctagtagtctttggtttgagtaggtactaggaatgaagacggggaggtaggaaattcttccctgggcttatttttttcactttggattcttagtccttcaaccaactttggattccttactcttattaaagaataagagaaaaccactaatttgaggaagagagcacaggttttaaattgttccttctattctccctcttgacagaacccaccatcgcgccgacgccgactcagcatcatcccacctgttatccaacctgaaataatttctaagaacttggtagaaatctctctcgatgatgagtcacctaagaatccacaaaagaaggctttaccacataagagtttgacagcgactcaggtgagtatatattaagggacaggttgaggggcctcacagatcagaggcataacttcttcttgtatcatctattctcccgctggagctcaacactagggggatgattggggaaggacctgacattcttggcttttgatttgcatggtggttttccatccaattctacaaaccaaataatcaccattttaatgtataagcaagggaagatagtattttcgaaaaaataatagtttgcagatgttttgagttatttcatgaagataaaaatacagacttttactgaagcatagactctacacttagaaatccaaaaaaatcagaggttaggacatatagtattatttgatagacacatatccatgtgaaaaatcagttgacacgtgagagggcgatgtgtctatttcatatgtctaggtttgtcaaccagataatatcaatcagcgtataatagtgtgtgctcatatcaacacttccattctcaaactaatgtgtgtttaattgaattggttgttggtgaacttgaaaaggctctgagagtgaggtagagtttagaatgattaacctttggaaataaaaagtaaacagaaacctaatttatagggaagagaattggccagtcagaacaaaactctattttgatgttaaaagatcctatgaagtgaagcagccctcagttagatatgtcaacaaagaaattaggttaaaaccaaagttaaagcacagactggtagtaggtggatggatgcttattgttttatggatctgggctatgactacaagtattttctgcagaatgccactaaatcagatgaattgggatgtataatctgaactagtggaaggattgaattagataacattttttattgtagtaaaatacagatcacataaaatttaccattttaaccattttaaagtatacaattcagtgacagtacatacattcacaatgttgtacaatcatcaccactatcaaggtccagaacctgtttggttctccaaaatggaaaccccgttcctattaagcagtcattcaccattcgtatctcccatcagcccctgacaacaactattctgctttctatctctgtacttgcctactctggatatttcacgtaaatggaatcatacaatatgtggcttttgtgctggcttctttcacttagcataatgtgtttgaggttcatccatgtcgtgacatttatcagtacttcatttctatttatgactaaataatacttcattatatggatgtaccacattttgtttagccattcatccattgatagacacttgtgtcctatctaccttttggttattgtgtatagtgctattatgaacattcttgtacaaatttttgtttgaacacctgttttcaattcttttgggtatatacctaggagtggaattgctgggtcatatggtaactctatgtttaagtttttgaggaactaccaaactgttttccccaacagcaataccactttacattacatccccactagcaatgtatgagggttccaatctctccacatcctggctaacacttgttaggttcctgttttaaaaaaattatagtcatgctagtgggtgtgaaatagtatctcattgtggttttgatttgcatttctctagtaaataatgatgttaagtatcttttcatgtgcttgttagccatttgtgtatcttctttggagaaatatctatttctcctttgcccatttgttaattgggttatttatctttttgttgttgagtttgtaaaccagaaaagtacctaagacaggtcagaaacaatttcgaaattttattttgccatggttaaggatgtgcacctgggaggcaggtctgtgcctttctccaaagataattttgagggcttcaatgtctaaagggggaaaaggcggatattggggaaagatgaccacatttttaaaaggtgtgggaagataagagacaaatggttgcatttttttgagtctttgatcagcctttcactgaatacacaatttacatgtgagagggggtagaggaatagtcacttatgccttcatcttcctcagtgaatctgcatttttacatcagaagaagcaatcaaatatgcatttgtctcaggtgagcagacggatgagtttgagttttgtcctttgtcccacacctgtgaagataagctatcaatatacattgtcagggtaaaattcttaaagcttaaagtttgggctgattaaattccctggcctcagtcacattgcaggataaatgctggcatttaacatttgggggttaagttattccactgaattggctaataaagagttaattttgagtgctacaagtatgcctctttttataatatctcatgctttacctggatggcttacaccataattccccagcattgtatacaaataagtctccgaagcccagagccatcttttttttttttaaagcaatcttctgctgcatatgcctgtagtcccagatactcgggaggctgaggcaggaggatcacttgaggttaggaactccaggctgtagtgcactatgatcatgcctgtgtgtagccactgtacttccacctgggcaatgtagtgagactctgtctctaaaatgaaataaaattttagttttaaaatccgctaatacatcaaaggagaacataatgctccctcccatgattgtatacaaatttacaactttcaaagtgattttccttatatagttacatttgattctctcaataactctgtaaagcagataggaaagattctcattaaagatcaaaaaaaattgaggttcagagaggtgaagtgacttggccaaggccacagagccaatcaaagatagagctggggcttgatcccaggactcctgaccaaatccatagcacttttcactgaactatgtggcttctagcagtcctctttttataaccaatgcccagcaatagcaacgacagctaacatttatcaagactttcttatgtaacgggcactgtgttaaacactttccttgtataattttatttaatctttacaacaacaaaccaaagtatgtattatgattattcccattttacagacatgaaaactgaggctcaaaagggctagggaacttgctcaaggtcagacagccaataagtggtatagctaggatgtcatattcaggcctatttggtttcaaagtccatgttcttattctctatactagttaagaaattgaagagattgtgatagaagggggctgcagggaataccagaaattccatctctaagaactttcaagttggcaaaaatattgaccacaacagcttttaagtaacatagattttgaatgaagcagcagctgtgcaggaactctcaggaatgggcacagaagccactttgccacacccagagaattaaaatccctacagccattattgggtctcacactctgtgccagtacctcttggtgcagaagtctcccaccaagaaccacatttcccaccaagagtcgcttcttcttgtggagatagacacatgcttttagcttttgactcacatagaacccaactctccaacatcccagtgtcagtttcagaatgtattttttctcaagagtgacagctttatgggccaaatgcttgatgaaatctgggcctagacagccacctggtaatccccttatttaagacattacaatcagagctttcctttgttccaggaagacagtcaaccttctctctatccctgctcaaaaggggaaaaccctagcatcatacaacagaaaaagaaatcattaaaaaggactaccaaaatgtgcattattgactaaactcctttgcactgggtctagaaacttgacagaagggaaaaaagaagtgaaaatgtgttattattttccaaagagcagcccttatcccagctaacagcaaaagagtgtccagctctctactaaccagtgctgaagaatcctttcccctggcccaaggtccaacccaggttccttctctaagaagattctggattagtaggtaccaggccgggcacatctcccagatgttgaggcacaaggagcccatttaattccagatattaatctgaagatatctgtgctaaactctctctaaaacacaggagaagaaatgaaaacatctcagctgtacttaataatatacataatggaccaaatgttctcctttataagtgggagctaaataatgtgtacacggtggacatagagtgtgggaaataaacattggagatttggaagagtgggagtgagggaggagggtgagggatgacaaattacttaatgggtacaaggtatattatttgggtgatggttacagtaaaaataaaagctcagacttcacctctatgtgatatatccaatatatccatgtaataagctacgcttctaccccttagatttatacgaacgaaaaaataatatgcagattgggttcagacagggtatgttggctgtcagagtgcgtggaaggagaagtagggttggaggggagtgaggatggaaaagtagagaaaggtgtcccactttctccactcgtttttctttcagaattctgccaggaagggattctatttgcttttcttgggcaactcataaaatcctgtggttggcttctgtggtagctttttttttttttttttttttttttaaagacagtcttgctctgttgcccaggctggagtgcggtggcacaatttcggctcactgcaacctccacctcccgggttcaagcaactctcctgcctcagtcccccgagtagctgggactacaggtgtgcaccaccatgcccggctatttttttttgtgtgtgtgtttttagtagagacggggtttcaccatgttagccatgatggtctcgatctcctgacctcgcgatctgctaggattacaggtgtgagccgccatgcctggcctgtggtaactcttctaagttgctgctaaccaataggactgagggaaagaggacctaagaaggcctaagaaggagccacacttcccaaaaggaatccatatatttctgactcctgttctaaggcaactgatgggattattcctgaacttgctgtactcatatttgaaaatgggagccgttctcttcatgctagaggactaggcattggttctcaactttggctcctggaagactcatttggaaaccctgttaaagctattctaaagcctttcccctgatcttcttactcattaggtcttgatatgtccccgaaatgtgctttttcaacactcattccaggtgattttggtgctgggggattccagaccatacattgagaaatactgtgtagagttccagagagtgtatagtttatttaattcactggtgagttaagggaagtcataacatatacatataatctatacccacataacatactctaaacctaacaacagagatcctgttaagactgttttaaatcacatgtctgagcttgagctccatagtcagatgaggagaatgcttgatcgttttgctctttaatttttagccccggtttgagaatggatgtgggtctgtgtttagactgatgtctatagattccttagtgagagtcaagctaacacagggagatcagtggctgttattaagtttgatggactcttggcttcggctgtgattggaaacagataaactctgtcctgcacatacccaatctagaaattgccagatttttgctgagcctgatttttctgttatgctatagaatgagtttcactaaagtaaattaagtatctttagtgtttataccacaaggtttgggatgccaactgaattgaaagttctttatatttattaaatatgtacttacttgccatgtgggcatcataagttggctttcatgcaaagcaagttgtacggtgttcttttagggtttccagattcatagacctccttgtttttctccttttacctttggctggagctagtgaggcctcagaaagaataactaaaataatacagagaacagaggagcttgctctgatgacatctcagaaaggcaacttctggtggaagcctttaacgtaatcaagtcaccagttcaaaaaacatgttttgagcaactaccatgtagtgcttgtgcaactactacaagcacagttggaggtactgtatccccaatacagtagtacatagaacagataaaaacccttcttcatggagtttatattgtaatgggggacatggacaataagcaagctaaataaggaaaacatattgtatgtcagacagtgagaacagtgacagggagaaaaacaatgtaaggaaggggatatgaagtggctcaaacattttaaatagattggccagggaagacatcactgaaaaggtgccttttttttttttttttttttttgacggagtctctcgctttgtcgcccaggctggagtgcagtggggtgatctcagctcactgaaacctccgcctcccaggttgaagtgattctcctgcctcagcctcccaagtagctgggattacaggcatctgccaccacacccggctaagttttgtattttttgtagagacagagtttcatcatgttggccaagctggcctcaaactcctgacctcagttgatctgcgtacctcagcctcccaaagtgctgagattacaggcgtgagcccaccacaccaggccatgaaaaggtggcttttgaatcaaaacctgaaaaaagtaggggagctagccacatggacatgggggaagagcatgcctagcagagggaacagcaggcacaatggccccaaggggagagcatgcctgaagtgcttgaagaacagcagaccagcagtgtgtctggagcaggaaatggctggtaatgtggtcagggataaaaggaagacagatcatgtgaggttagtgggagcatagatgttatcctccagccccaaaagaccagaactatgacaccactctgaggtatgaaagatgttcagaacaataaaagaagagcttttagtctatacactgatatcaaatttatatttccagtagataacataatctaactagatgatatcaggaagaggcagtatataaattcatagatgaaagttgcacaaagaagtaaaggaaatcttgggatcaatcctacttttgtgtgattgatcccacaaaagtcaactgtactatttctctgtcttctccctgaatccaaaactgaatggtctgcaggatttgtcatcagcctgactcattagcactgcgttaagtccccatgcactggaatgacagtgccatcttcataaccaagatagtagctaaggttatcactgcatcaacatacaatggtggtgggaaccatgaaggcatgtgaaagctgcaagtaccaaggggatacctggcactttgcaaaactagcctgaagagaacttagtgggtaaacacaatgggagattctgtctacttgctaaattataatatatggtttgctactagtatctagcagagacagtttatcagctgatcttcaaagggccttctgctaacagaaatcgaaatcttcttagaaatggaaagagctctggggaggctctttgagatatggaaaatgctatgtccagaagcccagaggagactattttgaagatcctacagaggaattcaactaggtgtcccagaaccaaatagtatggagatatggaggccagccataatgaggacagggttacaggctccatcactatcccactggaggttagagcattcagttcctgagggtcctcccatcagtcttgcacccatgaactgtcaatataaataaaaggtagtgtgctgtctatgaaaatgcaccttgcagacaggccctcttccaacctgattttcctccctccacccaaccctccaatatagaaatcccagagctctgctgggtttcactgataccaattgttcctctcaccccagccagatgtcctgttgataagaaggggatctaggacaagagaacatgcaatctctctgactttgcaaactcaattaagtggttgtgttcccatcccaaggacaatggggtgcccctgaaagctttctaagcagaggagtaacccaaacttcttcctgtttcttgttttcatctgcaagaaaaccagtaaaattatggagcttacctctaatgaataagcccattgacaggaaatgtaggaaaggggacaatagttcatgaaggatttcttctttgggaattcttcagccggaagaatatccaacttttgagaccagtaacagcatacgggttgactcgtctattttctcccaccttccccagagcttctctgagttatcatctggacctgattgctcacagtccttgactgcatttgccacacttgcctctaccagtagcacccagctgcccattggtttcagcaccccagccaccacccagggctgtttggattcttcagctgctcgccacaaaatgactttaaatccccgcaaacaaaagaagaaccttcaagtgattgtaagtccttcaagagacagggcactaaactcctgtataagaaaagatgagttccaacctttgcaaactactactagggaaatagtatggtgtaggagactcatgccctaagtaagcttggcaaggtcaagggtgctgtcctaagcttgacacccccagaggggtgagcaagcttgcatctgctgggtgtggtttcctatccatgtggaacttatattagaagggactaaaaggaagcagaaacagtaaatgatttaaacccccataaactgcttattgggctaacatctgggagttcactcagccctatttgtagagaatattcaaccctagcccagatcaggattctttcagttattaatcagatgagacccatgagtcacaaattgcagcactattccacttatttggagatcaagctttcagcaaccctaaacatccagaacttagttgttaacccatccaaagatctccaaatagatgccacatgactttccaggaagcagacctactgtgttaaaaacatggccacagattagactcagacctgacagcaaagagaagtgacagctggtagcagacagaatgacagaaacaatctggggccatttaatataggggctcaagaaccttgcccacctcaatatgtccttcagggccacactatatcatagtccaatgtaatagataattttattatttgtccaagtcatctagaaaaagtagattattttccgtgatccctgtttaaaaagatagagaaataatgcttttggaaaaggcttttagtaaaagttaaggattagggctgggtgcaatggttcatgcctgtaatcccagcactttgggaggccaaggcgggcggatcacctgaggtcaggagtgtgagaccagcctgaccaacatgcagaaaccccgtctctactaaaaatacaaaattaaccaggtgtggtagcacatccctgtaatcccagctactctggaggctgaggcaggagaattgcttgaacccgggaggtggaggttgtggtgagccgagattgtgtcattgcactatagcctggacaagagcaaaactccgtttaaaaaaaaaaagttaaaaaatgttagtgtttagtgtttaaaacgatgtgtcagttgtctataaaactcactttgatcaaaaactgaattcgccagtgattctgggctgaaaggaagagactgtaaatcagaggtgaagtgactaaaagattgtatagtacaaacattttacagagaagggcattaaagcacaaataatttcagatacttacccaaagtcaaacacccaggtgatagcagagctagggccagaatccagtcttctgacttccagctcaacacttttttcatcccaccatcttgcctctagcttaggcatctcaatttcactttaggttttagacaaaatacgagttgaaagaacaggtggaggagcagggcggcagagggaagccctctggtggccttgagagtaccttgttagtttggtgtcaaagaaggggtgaccaattactaggtgccaaaccctatacatgcattatcccctgaatacctcaccacaaacctgggagatggagaaggttggctgagggaagcagtatgacccttctaactttcttctttctgtatagcctagttgagaaaaagcccgggcattaccctctgagaaggccagagcatccacttcttccctgtgactctctctctgacatgtggatgaacataaaaaagatccaggatcatttatgacacagggactactaccactttctccctgctctgtaatttcttagatctacaagtcccacaggaggtttctcctggtcccttatttattgatgtagacacagtgattcagagaataacttgcccaaggtcacgcagcaagtaaatgatgaagagattttgaatccaggccaatctgaccacgtttactcaaaaataaattattatgagctgtgtctgtttgcacaggcactttgagtgggagtgtaaagagttacatgtttgtctttacatgcatgccataaaggcttacactaagcaaattccggacactgttcagtgcagtgctatgctgacatttccagagctgtattgtaattatcagaaaaccttatttatactaaaccaacttcagcccatccagtgtaagggctgaacctttcagctttttctcctttccctcccaacaaaaccccaattctttttcttcttttgatctggaaagagataattcatgctttcattacattccctgaaaagaagccaaaaaggatttgaatttgactcacaggtctggtgaagcaaatcggagaatcccaatatggccgagggcatgattgttgtcaggcccaatgaccccgttttcagattcgtggccttccagtgtggttcagtcatttccagggtattttagagggatccctgcagtgtgtcactcagacattagaaactccaaacctggatgaaccacttccagtaggtaaaatgatccccaaggatctcttggtggaaacaattccattaagaaatccctggaaatatctccattgaaataacgtccatctttaaaggtactgttacgtgcccagcatcaagaacttttttcctgatgctttttctttggcaaccatgcaggcgtggttggaaagcacttcagtaggattcaagctctttcttttcctgtttcaggtggaaccaaaggaggaggagccaaaccttccattggtttctgaagaagaaaagagcataac

SEQ ID NO: 4961 - DNA, 71944 bp, human; identical to SEQ ID NO: 3660

SEQ ID NO: 4962 - DNA, 71944 bp, human; identical to SEQ ID NO: 3660

SEQ ID NO: 4963 - DNA, 55092 bp, human
ttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaagtaagagccgggcggggccggggaaccgggagaccggacgggggtggggtgggggagccgcggcccgacgccgccctgctgcctggactcggggccctggagtagggacggcccccttgtcgatcacctggggacccctcggggcggtgggccacctctatggcccccagagtgcagccccaatgcttttcacgttctcttggggttaccgccctgcaagatgcagttttgtggtccgcagccctggtccgagaggctttccggattggaccgggcgaggaggtggaatgcagcaaaggatttggaggaaaggaatgaaaagctctccagagagatgagtcctaaccatttccaccgtcctccaatttggaaacttttgcttaggctggcttaggaagagagagacccttttaaaggtgtttttgtctgtgtgacccaagccccgagaagaaagtgcttggtgtggggaaaggacccgatccatcgatacgaaaaggccgcagatttttgcccacacatctccccaacttaaatgaagcttgacttcaggctccgacagaggctgcagcttcccctccccaagctgagaacggccccctcagcctaccgcttcaccccactggcctcatttatttgggccttttccaccttctcccacatcaacagctgctccttaggaaaagatctaaaggtgtaaatgcagccttaaagcttccaccgagctcagaggtacctgcatttgaactggaaaccaagcctgaaagaatgaattggtagtgatggcatttcaggaagcagagatgtttctgtattggggggacggtccctgtgttcctcattcagtgggcacagtggcatctttgatatcgccttggctctgaattagacaaacagcccacatttgggagagtcggtcttgaccgcatagtttagtcttggcggctaatagtcaaaggattttgccttgacactgtcactcacctgggaggccagaggtggaaggctcacctggcagccgacaagccgaacggaatcatccttattacctaggcctctaggccagtactcattttgcctctgcctggaaatagagttcccttctcttcctctgcagagggactcatgggtgggaccatgacatttagttaaggccctttttcctccccacctctgcttgccctcatcaacatctggcctgcagtctgtaaacagttctcctctgagtcttaatgactcagtttctcccccacttcaccctcttctctacaaagtagtgtggaaatcttcctttggatgggataaaatatgtccagaggggtggggggcagaacttcaaaggctggtttaagtattgtggctcttctgctaagcacctagtatatgcacattagattttttaagctcctgcctcctgccctgtaaggtccataggacaggaagcattgtgcctgttttacagatgcagaattgggctcagagtgatgacacctcttgtcagtgaccgagctgagctccactacctggccttctgactccaaatctcatagtctttctgttacatcatgctgcctccctgcatccatttgacactaatttagtcaggctacattaagtccccactgtgtgcacgatgctgaggacaatgccaggatggaaggggcatggtccctgtgccccaggagcttacagagtaatagaagagtaagactaatatgtccatgaccataacacacaaggtagcatgtgattgtcatggataatgtgctctagaaatgtacccttctgatgagcgatgaggaggagaaaatgtgaagacttcatagaggagaaaaaaatttgagtttggcattgggagaatgaggagtctgctgggcagagatggagagaaagatactgcagttgatgtcagcaaatgcacagaggtgggaaggcaagcagcacaacaggaagtccaaccagaaaagcaggttggaatgagatattagagggttggattaagggatttggacttgacttggtatccaagggtagctgtgggaggtttttgtggggggtggggggaggtgtgttgtgattaaagcaattcaatggaaatgatcgtcacatcgtggcagagtaagatgactagagaggaggaagagtggagacagcagggccagttaggaacctgttgcactagtccacatagcagctgagggcaccggcaataggtgaccatgggagcagagaggaggagatgtctgggagaacgagaacagagacttacctgggctaggtttgctaggaattttttttcccctacaggattattttctttctgaaaactaaaaggaagtattttggtgaatggcaaggcatagttggaaagcaaagtgtttgattaatcgcgatgccatccttcctacatcaacatgatactcttgattcatcattatactgattcatttctactcttttctgaccatgaatttgcaaaacagttggctgggggcctgtgatcatgggtttgaacaaaacataaacatccagaatgttcagggaatggggtagttaagtgacttgtccacaaatgcaattaatggaagagctggaacttgaagccaagtcttctggctccttagttcaggtctctgtctaccattgcacagcagaaatatctgcttagttggattgacgatcaagagtccactcagtagtctgttgggagctaggttattgtaatgggtggctttcagatgtatcaaatagaagacccccccgccctggaacttcacaaccgcttgtctatcttatctaataaacgttagtttgggtccctgcagctctgaaattgttcataaccaacactatttctttattgaataagcacttcatgagcttatgtttggctgcactggctgccaacctgttaggttgaagtattggcagttataattacacatatccagggtgtgtgttgtatctgtgctggctgaaaggaaggggttgctgcaattcaccagtgtatccagtctcactggaaaaagcttctgtgcatgtatgtgtgggggtgggaggaagaacagaaaagggaacagtgccgccctagcaaatcaaaagtttaagatgcatggactgagatgacatcattggcggattatcagggttgcctgccctgactctgagattctaaggggaacaattgataggacttatctctgtatcagatgggagaagtctgcgaaaaaaggacttcctatggttcttctttttaattgtgtatatttgatattgagactctataaaagaaactgatataaaatacggctcctcttcctagttcatcaagtcattcagtgaattaagggcctgtttcctctccgcttgcccctaccagtcatttccttgtcagaagtgttgaactcccttaggctctatgctgaggactaacacagggtctgatacattgtagaccttcaataaatgagtagtgaattaactatgccctagaagtgaccaagtgggatggggaataagagtgggacaaggagaatgaatggtatttctttgggcatttcaaactccaccttctaggtggttccagcttgctgcagaccgcccctccagtcaaaaatttctttttttttttttggaagaagtattgctctgtcgcccaagttggagtgcagtgacgcaatctcggctcactgcaacctccacctcccgggttcaagcgattctcctgcctcagccttccgagtagctgggattacaggtgcacgccaccatgcctggctaatttttgtattttcagtagagacggggtttcactatgttgaccaggctggtctcgaattcctgacctcgtgatccacctgccttggccttccaaagtgctgggattacaggcgtgagccaccacgcccagccccagtcaaaaatttctacttcctctgtttcccctgtcctttctgaggtccccctccaacttgactggccagggtatagaagagggaggaacgaggaagtgggcaggcaggcagtacaactgaggcagatagtctgttggtgaatgccacctgtttgagaaaaacctctgtcaaacttggtttttcctctgctctcacaccacaacaacaaccctcaacacagaagacttctgtgaccaaatgagtgtggggaaccccacactctgataaatggacaccaactaggtgtcctctgattcagttctgacactgtctacctggacataatgtcagaccaagccacaggttaagggcttggtccccaagaatggcccccaaccagacactagtcacaagtccaggcctccagaacttttttttttttttttttaagactgagtctcgctctgtgacccgggctggagtgcagtgcgtgatctcggctcactgcaacctctgcttcccggattcaaactattctgctgcctcagcctcctgagtaactgggattacaggcgcccgccaccatgcccagctaatttttgtaatttttttactaaagagaaggttttgccatgttggccaggctggtctcgaactcctgacctcaagtgatctgcctgcctcggcctcccaaagtgctgggattacaggcatgagacgccatgcctagccaggcctccagaacttctgaccaaccagcttcaagttggggttcccacgaccccctctttgggttcgattaatttgctagtgcggctcacagaactcagggaaatagttaatgtttaccagttaactacagaggataccacaaaggatacagagaagagatgggcagggtgaggtaaggggcagggggtgtggagcttccatgccctccctgggcacgccacccttcaggaacctccacatgttcagccatccagaaggttcccaaaccctgtcctctcgggtttttatggaagatttgttacagaggcatgattgacaaccatgtagaaatgtgactggatgaaaagcacatgatctaaacccagcaaggcctgtctgttcagacttttcttggcctctatgcagcgttcctttctctagggcagaggtgtccaatcttttggtttccctgggtcacactggaagaagaattgtcgggccacacataaaatacaataacactaacgatagctgatgagctaaaaaaaaaaaaattgcaaaaaaatctcataatgttttaagaaagtttgcaaattggtgttgggccacattcaaagccatcccgggccacatgcggcctgtgggctgtgggttggacaagtttgctctagggtatggggcaggaccctctctgggatgaggatcttttaacccacaatcagattagagtcctaccttgggcaggtaaaaggagggcaggagaaggtcaaagagagaaagattctgtttcctgagacctaaagtgccccaacattataacaaggactagggaagttaggagccaggaaccatgggtgaaaaccaatgtatgtatcatagcaccacatcacctttacttccctgtatgtttaaaagcagctgattaactcaaatgactgtttcagttaatgcggctaaggtaggttgacaaaatgaagtcaagactcctacagcttgaagatgtttttaatcagtgagtgtttacttgaaagcaaaagagctagcctagaaccccttaaatgctttcacctgaatgcccactcttatttctcatgcagcagcccctggcctatgggcaactgaaagaacaggaaatgcacctcctcactggaggtttgaaggctaaggaactggggatgctctcattttaaaaagataggccgggcacagtggctcacacctgtaatcccggcactttgagaggctgaggcgggcagatcacttgagcccaggagtttgagaccaggctagccaacatggcgaaaccctatctctacaaaaaaaaaaaaaaaaaaaaaaaaaatagccaggcatggtggcgcacatctgtagtttcagctactcaggaggctgaggtgggaggatctcttgagcctgggaggtggatgttgcagtgagcccagatcatgccactgtacttctgcgtgggcgatagagtggccaccgcacccggcccagaactgggcactttgggaggccgagcggggtggatcacctgaggtcaggagttcgagaccagtctggccaacatggtgaaactccgtctctactaaaactacaaaaattagctgggcatggtggcgtgcgcctgttgtcccggctacttgtgaggctgaggcatgagaattgcttgaacctggggaacggaagttgaagtgagccgagatcgtgccactgcactccagcctggccaacaaagtgagactctgcctcaaaaaaaaaaaaacgtaattactgagatgctcgaagttatcatttgaagaaattttgttcctttttaagtttcaacagaactgaaagactgcactccagttggtatttaccaggtacttctgtgcatttacaccccacaggcaagccagtgttgacaattatgtagataaaagtagaaaatgctttaagtgggaaggacttgggatagatgtaaattaagaaagttaggcatctcttatagccaactagcatcatataaatatagaaaaatgtaaatgtattattcatgaatgcttatatagtactatagtaacttttcactttgtaaagtactttgaaatgctggaaaatatttcaagaactagtggagagaactctagcacaatccatagttgatttctctggcctttccccctattttctcccagatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtaagatggaccttttcaccttgtccaagaaaaggctatgttctctgaaattacaaatgtattgtatacctttgtgagccactaaatcagttttactgagatcaaggttatatggattcaacctacatagaggcaattagcttcattctattccatagccatacactccactcctaaactttggccagttacatccccgggaggggagtagaccagaaagtggaggtgactcagcaaactggtaagaatgcaattctaaccactctccatctgactgcagaaggagtattcagtgtacatacacattgatatgccatgagggcaactagggtagcaactgtgtcttctggggtctttgtaacctttgccagagctacacatttatggcccaattgcaaaatccagtagactttttccctttatctgaacttggttgcagcatttgataaggttgaccaccccttcttctggaaacttggcttccaggacccctccaagtcctgggtgtcttcccatctctctggcagctctttcttatctgacttatccggcccatctgggtcgtctgatactgccagcccctacatgttgctcttcccctgggctccttccttagctttctttttaccctcccctttagcttgcttctcatcctccaaaccctccctaggtggcctcatctatgctagtggcttaagcaagcgtcagtgtattctgtgacccttattctctacctctttagtaacaatggccaacttttggggggaagtacttaccatgttctgggtactgggccaaatgcattgcatgcgctttctcatgaggccttattttacagatgaggagatagatgcttcaggaagctaagtgacttgcccaagtccacatagatagaaagcaggagaaactagcaatagaactccagagccctctgttagcccctgactgacaccaattcccaatggtagtatgagtccctgctgttggacaccttcacctccatgctccctaggcacatcaaattcaagattaaccctgatgtcctcgttggtctcaaactagctcttcctcctgtgttccctaatgaatgagactaccttcctttcaccccgtggcccaagccagaaaaaaaagcctagggatcacttcaacttctcctctcactccacccccacttgaatcaccaagtcccgtcgatttgactcatcctctttcccacaggtccttacaactcagactctcagggtctcccacagactctggctcctacctgcttccactcttggtatctcctgccccagtcttccccgtgcactgctgcccggctgaggtgatctctccacgtgcaatttcatcgtttcacggccctcatttcactgctctccttaaaaagtattcagcgactcctgagctacaggagaaagcccaaattccttaggacattctagatccttcagacctggcccctgccagtttgtcctacctcatctcctgccatacctccacctgcattcatgctccagcccttcagaaaaacttggatttcctggaaataccactccctttatacatgctattccctttgcctttccactctgtcaaagtctgatgaactcctatttattcctcaagacccagttcaaaagttctctctttcatcaagtccctcctgactcccccaggcaaaattaatccctttgatccttgtgtacctaatgcatttcatatagcccccctgttgtggcacacatcaggggtgttatactgactttgccctggctgtctgttctcctcgatgatgagcatctccagaaattagcccgctcctctttcgattcccagcacctgacatagggcctggcacataacctaagctttccagacattttctgaatgaaggtaaatggaaggttggtgagccaattaaataaacattacatttttctaaagataagcaatttcacttgtattatcccctattttaaatttcattttgagggagaaatttagtccctctgtaaactaaagatggctcctaaaggttctggaagtttgtgaaagtgccacctactatattacttactcaccatctcagttcttagaaaggtgaggaagccacacagtgtagggtgcccactgggccatgatatgaccatgtcattcccaaaggtgaagtcaggtgacctccctcaccatcgagagtctctcactttccagttttcataaaatgtttccttctcagctagagatcagtccctcctgtcctccaaaacataatgaggtgctgcccactggctttttttacttgagtgattttttccccgaacattaaaaaaaagcttcaaacatctagaaaaattaaaagaaatctagagtatacatccatggaccatctagatgctacaattaacattttgctattcatccctccagccattcatcagtccatttttattttatttatttatttatttatttatttatttatttattttttgagacagaatcttgctctgtcacccaggctggagtgcagtggtgcaatctcggctcactgcaacgtctgcctcccaggttcaagcgattctcgtgcctcagcctcccaagtagctgagattacaggcacgcacctccacgcccagttactttttgtatttttagtagagatggagtttccgttttagtagagatggagtttagtagagacgaggtcaggctggtctcgaacccctgacttcaagtgatccgcccacctcggcctcccaaagtgctgggattacaggcgtgagttactgtactcagccagcccaccttttttttttttttaatgatttcagtgtaacttgcaaatatcaatacacttcacccctaaacccttcaacatgtgtgtcattaactagagttcaatatttgtgtatggttcttttttttgagatggagtttctctcttgtcacccatgctggggtgccgtggtgcgatctcagctcactgcaacctctgcctcctgggttcaagtgattcttctgtctcagtctcccaagtagctgggattacaggtgcccaacgccacacccagttactttttgtatttttagtagagatggggtttcaccatgttggccaggctggtctcaaactcctgacctcaggtgatcctcccgccttggcctcccaaagtgctgggattacaggcatgagccaccacgcccagccgtatggttgttttttaaagtacaatttacatccagtaaagtggacaaacctttagtgaaccatttgatgcattttgacaaatgacacaacccctaccaaaatatagcacattatcgcactcaagaaagttccctcatgctccttgggttggagggattttagcaaccccagagcccctcctgttttctttccccggaatccccccaggaatttatgttctcaagccagtgttttcccaagacagcagcagcttctccctggccttgttttgcaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggtgaggagttatcagagtggggtagggggtggaatgctttgtagtgtttgtggtcgggtaataacagcaaagaacactgaccccaagtgatgccaggtttccaaggagcttctgactgctcataaatactgtgcaaacccccactctgtggcatttctgctgctaacctcagagctgttggcttgagccccggctgcctcctcattcccatcctctgttttttggtcttttaagaagcctccaggctaggggcggtgattcacgcctgtaatcccagcactttgggagggcggaggcgggtggatcacttgaggtcaggagtccaagaccagcctggccaacatggtgaaaccccgcctctactaaacaaacaaaaattagctgggcgtggtggcaggcgcctgtaatcccagccactcagaaggctgaggcaggaggatcacttgaacttgagaggcagaggttgcagtgagctgagatcgcgccattgcactccagcctgggtgacacagaaagactatgtctcaaaaaaaagaaagaaaaataagaaagaaagaaaaaaaagaagcctccagatgaggcttctcttttctttcctgacttcctgattatatcacttgtggctctccttcctccaagaccagcagagagtagaatatgaaatgcagcctgctaatgctccctgtccttgctgcctccacagcaaggatgccactcttggtttcctcactgtgccttacctcagtgaagcagactggataggaccaacataagctaggaactgtagctaacaagggtccagcatccctgactccctcgctgaggaaggaactgcatttaaaatgtggcagcatcaggccgggcacggtggctcatgcctgtaatcccagcactttgggaggccgaggtgggcggatcccctgaggtcgggagttcgagaccagcctgaccaacatggagaaaccctgtctctactaaaaatacaaaattagctggttgtggtggcacatgcctgtaatcccagctactcgagaggctaaggcaggagaatcacttgaacccgggaggcagaggttgcagtgagccaagattgcaccattgcactccagcctgggcaacaagagcaaaactctgtctcaaaaaaaaaaaaaaaaaatgaggcggcatcttagtgagaccactgaggcaaaatcctagaatcagaagttccaaagtgagtaattgtcttagcctagaataagccaattttgatcaaagaaaaatcagactagttcaaataaggttgggtgggtaacagttatatctgtacagtgggggcaggcccagaatcctagcagggctgaggtgctgtatcttctcttagccctgctcaggcccttaaaattcaaaaatagctaatgcatgctggacttaatacccaggtgatgggttgataggtgcagcaaaccaccatggcacatgttcacctacgtaacaaacctgcacatcctgcacgtgtaccacagaactaaaaataaaaatttttaaaaaaattccacttccataggctaggctgtctccatggcctcttctgggcaaaccctgatttatacaagcaatatattcctgaagaactctatagaaattaatttggggtcagctgaatccaagtttaaatgagcagtcccagccaagtttggttttcccctgtgactctaacttgtcctcgcttgctcaatgtccctccccgctcccgctttccctctgtagtagtcccggctgccctgggccatcgcttacctcagcactaaacagcctgaaggtgcttatcaaagctgccactccactccctgaaacttcatctgtctgggttgcattcctttcctgtccttgtccaaacagataattgtcgcatcattgtaatggtagtataggtgcaaaatttttctattcgttggtaagaagtctttatatattaaagatattaaccctttgtcatacatttcacacaatttttccagtttgacatttggtgttttttttttttttgagagacagagtctcactctgacacccaggctggagtgcagtggcacaatctcagctcactgcaacctcctcctcctgggtttaagcgattcttctgcctcagcttcccaagagctgggactacaggcatgtgccactacacccagctaatttttgtatttttggtagagatggggtttcactatatgttgaccaggctggtctcgaactcctgagctcaagagatccacccgcctcagcctcccaaagtgctgggattataggcatgagccactgggcccagccaacatttggcttctagtgctatttatgtgttgttggtggtggtgctttgttgtacatatttgtagaattttatctaattatatctattacttttttgtttgtttgtttctgactttgcttttctgcttaaatgtaaagtctgcttagtgcatgcttatcttttttttttaagtatttctaattttaaaaataatgcacatttggaaggccaagatgggaggatcacttgagcccagtagtttgagaccagccttagcaacatagcgagaccttgtctctactaaaaataaaaaattacctgggcatggtggtgtgtacctgtggtcccagctacttgggagactgaagcaggaggattacttgggcccaagaggtcgaggtcacagtgagctataatcctgccaccgcattccagcctgggtgacagagagagaccctgtctcaaagaaaaaaaaaagtaatgcacatatactttaaaatggttaaaatggttcattttatgtatatttgaccacaatgaaaaaaaagtaatacacataagttgtagaaaatttgggacatacagaaaagtgcaaaaaggaaaataaattacccatagcccaacacccatggattataatgattaatagttttccttctatggaccttcatatatatacataaacacactcacacacatataaagatatataaggttatttcttttacaaaattgtgttcacactgtatataaaaattagtatccttaggccgggcgcggtggctcacggctgtaatcccagcactttggggggccgaggcgggtggatcacctgaggtcaggagtttgagaccagcccggccaacatggcgaaaccccgtctctactaaaaaatacaaaaattagctggtcatggtggcacatgcctgtaatcccagctacttgggaggctgaggtaagagaatcccctgaacctgggagatggaggttgcggtgagccgagattgcaccactgcactccagcctgggcgacagagcgagactccatctcaaaaaaaaaaaaaaaaaattagtatccttttttcacttattatataatgggtatttccctgggccattaagtatttaattatcaaataatattccaccatatggatgtgccaaaaatatgtaacaatttctcctttttttaatatttaggctttttctaattcttgagttatactaacattgtaatgaaaacctttgcattttttcatatctgtgatgatatccttaggctatattcctagaaattgacttataggtcacaaaatatgaacaattctaagactcttcatgaaatgtgcactccagaaaggttgtaagtttgtaattccaccagcactaaagcagtggctcagcttctaaactctcaatattcattgatattaattatcaatattaattgtcactttttaaatcattatgaacctaatagctgaaaaatagtatcccatcattttaattttaatttgattgattataagcaaggttgcactggccctttgtatttctttgtaagttttgtatttatgtccttgccctatttttctagaatattcaactttttctattcattggtaagaagtctttatatattaaagatattaaccctttgtcatacatttcatatatttttcccagtttgacatttggcttctaatgctgtttatgtgttggtggtggtggtgggtttttgttttgttttgtttttttagacagggtctcgctatgtcgcccaggctggagtgcagtagcagttcaagcatttctcctgcctcagcctcccaagtagctgggattacaggcacctgccaccatgcctggctaatttttgtatttttgatagagacacggtttcagcatgttggccgggctggagtggtgatgttttgttgtacatatttttagaattttatctaattatatctattagtattatcttctgtttctgactttgcttttgtgcttaaaaggcctattctatcccatgatcctatgactattcacttatatgttatttaaatacttttttagttgtgatttttacacttggcttcttttttttttgagacagggtctcactactgcccaggctggagtgcagtggtgcgatctcagctcactgtagcctcgacttcccaggctcaggtgattctctcacctcagcctcctgagtagctgggactacaggcatgcaccaccacacccagctaattttttttttttttttttttttttgagacggagtcaggctctgttgccaggctgaagtgcagttgcaccatctcggctcactgcaacctccatctccctggttcaagcaattctcttgcctcagcctcctgagtagctgggactacaggcacgtgccaccacacccagctaaatttttttttgtatttttagcagagacggggtttcaccaagttggccaggatggtctcaatctcttgacctcgtgatccgcctgccttggcctcccaaagtgctgggattacaggggtgagccgccgtgcctggccatcatacccagctaatttttgtattttttgtagagacagagacttgccatgttgcccaggctggtatcaaactcctggactcaagcaatcctacccatctcaaactcccaaagtgctgggattacaggcatgagccactgtgcccagccttacacttaacattttaatacatttagaatttacctggtgtggcagggtgcagtggcttgtacctgtaatcccagcactttgggaggccaaggtgggcggatcacctgaggtcaggagttcgagaccagccgggccaacgtggtgaaaccctgtctctactaaaaatgcaaaaattagccgggtgtggtggtgcgtgcctgtagtcccagctactcaggaggctgaggcaagagaatcacttgaactcaggagatggaggttgcagtgagctgagatcatcccattgcactccagcctgggcaacagagcaagactcagtctcaaaaaaaaaaaaaaatttacctggtgcacaggtgccgtgactcctgcctgtaatcccagcactttgggagtttgagataggtaggatcacttgaggctaggagttcgagaccagctggccaacatggtgagacccgtctccataaaaaatacaaaaattaactgggcacacctgtaactggtgcacacctgtagtcccagctacttgggagactgaggagggaggatcacttgagccctggaggtagaggctgcggtgagccgtatttgtgccaccacactccagcctgggtgacagagcaagaccctatctcaaaaaaaaaaaaaaaaaaaagaattttcctggtgcatgatatgaaacagtcatctaagttttttttttaatagtttaccaattgtttaagcaccattttttgaataattcttttctccactactttgtgctgcagctttcaccacatactaaatgtttatatctattctagggtctctatcttaatgaccataactttagaaaaatgccttttttttttttaatttttttgaaatggagtctcgctctgtcgcccatgctggagtgcagtggcgtgatctcagctcactgtaacctccgcctcccaggttaaagcgattctcctgcctcagcctcccgagtagctaggactgcaggcatgtgccaccacgcccggctaagtttttgtatttttagtagagacaaggtttcaccatgttagccaggctggtctcgaactcctggcctcatgatctgcccgctttggcctcccaaagtgctgggattacaggcgtgagccaccgtccccggccaaaaaacaccttttaatgtctagtggaatatagccctcctcattgtttttcttttcaacatttccttgattattttcgggcatttgttcttcctgataactttagaattaccttgtgattatgattggaattatgtaaaacccatacacttggagtaatttatgtaaaatatttcatcttttattcagagacacagtatgtctctcctttactttcaatcttctttctttagcttgaaccagatgaaattaccaatattcaactttgttgacatcattcaaacagcaatttcatctggttcaaaccttagaaaagttgttttcttcaaagggaaattatgctctctctaaacaaacaaaaaaatagtttctcttaaaaaatctggggagaagtagggtaggaaagaagtatgatatactgtaagtgttttattcattttttaaaaatcctggtcctaagaatttctcactgccaggggcatctctccagcactttcagccacttcatgcctagttcaaggcttcgccagcttagcttcctccccatagtgggccagtccaaaacaaccagggccttgagcctcaaggggtagggctagtccgtgaaaaagggtttcaggccaggtgcggtggctcacatctgtaatcccagcactttgggaagccgaggcgggtggatcacctgaggtcaggagttcaagaccaacctgaccaacatgatgaaaccccatctctactgaaaatacaaaaaaaaaaaaattacccaggtgtgttggcacgtgcctgtagtcccagctactcaggaggctgagagaggagaatcacttaaacctgggaggcggaggttgcagtgagctgagattgtgccaccacactccagcctgggtgacagagcgagactctgtctcaaaaaaaagagaaaagaaaagaaaaaggtttcagatgaagttcaatgacatctaaatgggacgggtaagggtcccagtcttccccataaaccttagttttgctttctcttcctgagagctagaacagtgacctcatctgggagaatccagccaacaccgcattctacaccatctgcattctatacccctaccacaacaacccactataaactggggtaagatacactagaagtgggtatttgggggtaatcctgatcatctttttcctcgtatgggagccttccaaataatgcatatatagagcataagaagaagtttcaaatagatgcaaagtcatgatggttgtaaaaaaaaaaaaaaaatccaaagaggtaattgcactgttttcacaaaataggatcaacatgtaattatgaataacaatataaatgtcatccaaagatataggaagtgaacttttagggtttcagtgaaagtgttattttgcaggggttaataaacatactaatactttgtccaccctatgttaaaaaaaaaattcacccccaagacagaactgcaggctgcttttaaatgcaaacatggcattgggcttctctggccattagatgtcactgcagtaaatggagagtagctgagcatcacctgattggagcctgaagttcggtgatctctgtccagttaacaacttcataatccctgcttgaaatccatctttggtttggagaataagaggcctagaaaccacaggctaatgctaaacttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcaggcctgtgcacacatggaatgaggtgcccccaacttggtgtgctttcacggaccccaaccaccctgcctgaaatccccttctccacgcttcagtgcatcttagctcaagcccttccaggtatagcctggcctttttgtctatctcccacacctagcccagggcctgggccagaagagatggcagaacttagtgtattgagagaacaagtaggaagggtaaaatattgacagagatgaattcatctgattaatctgtgcaccccgaataagaaccagggagtcctgagaaaatggctctctgcacaggtgcatgtgaagaagagagggagataggctggggaatactgccctgaaaatccagggagcagctgagaatgtaggagccttggaatctggcaggccttctgaaaggatcaggagggaggtaccagacacatgctcggtccccccacaactctgcctgacaccctcccctattgcccatattaggtgtctccatttcatcaaatataaaaccaagtgtgagcctgttgctttataccccagtggactttgaccccatcacagctcacaaggtaagcaggattgggccaggtcagcatttgaactgaaagcacataagatgaaggacaaaggtggtatccgagtggtacagctgactgagcagaatatacatggtcagtgaataaacagaggccccagcctactcaaatagagatgctcgacacctcgggttacctttgttgaattggacacagtcacttcattcattccctctcagggtgctcatcccctcttgtagtttttcatgttcatatctacatcttcaatcctgacctcccttctgagccatggtcccacatttcccacagcctgctcgacatcactatttggctatcatatccccactgtcacctctaacttaatgtgcatcaagctgacctcttcttttcctaacactgttattccagagttttccatttcaattccatcattgccccagtgactcaggctggaaatccacaacttgtgtttgactcttccccttcccctcacccggttaaccttgagccctgttgcttcttcattcctaacattcccatgctggtctttctttttgtcactgcctcttgccctaatcttggaccttatcagctcatacctaggctattacagtaatctcctcattggtctccaggattaattctaaaaatgatcttaagcattgaatattaatatgtactaggcactgtgctaagtgctttatgttcattatctcatttaatccttacaacagccctacaaggtgggcactgttattattaagtccattttacagatgagaaaactgaggcaccgaaaggttttgtagcctgcaagttcacccatccagtaattgagctgggatataagcccagggagcttgtctccagagtcagtgctcatttcaatcctctccagcccagcccatatgggattctgtcagatgaatctttctcagatctgtctgcgttagatccttttttttttttttttttctttttgtgagacagggtcttgctctctctcccaggctggagtgcagtggcacaatcacagctcattgtagcctcaacctcccgggcccaagcaatccttccacctcagcctcccaagtagctgggaccacaggcatgcgccacctatgcctgactaatattttaaatgttttgtagagatgaggtctcctggtctccttatgttgcctaggctggtctcaaactcctgggctcaagccatcctcccgctttgacctcccaaagtggtgggattacaggcatgagccactgtactcagcctgttgttgtgtccttcttgatggtccccagagaaaaaaggctgagccccttggcttggcatgtttcccttaccaactgtgcgatccttgttgcacagaggccctttatataagaagttacaaaaacaaatgcctgcagaaacttggaagtaacatgaaaaagagaatgtagggaaacccagataacatacactcaccctgtaaagaataagccttcaggctgggcctggtggcccacgtctgtaatcccaccactttgggaagccaaggtgggtggatcacttgaggtcaggagttcaagaccagcctggtcaacataatgaaaccccgtctctactaaaacacacacaaaaaaattagctgggcatcatggcaggtgcctgtagtcccagctactcaggaggctgaggcgggaggatcgcttgaacctaggaggtggaggttgcagtgagttgagattgtgccactgcactccagcctcggtgacagagcgaaacttcatctcaaaaaaaaaaaaaaaaaaaaaaaaaaaaagccttcaaatgcattccgagccatcatggctttcaaaagcattctggagagctaaacttcactgtgctcacaaaatgtgatttgcatctaaatatggatgacagaaaggaagaaagagagccagtagaggctgtggccagttcctcctctccaaaggacggatgccatttagaaatgtaggcccagttttcaaaggagtctaaaatccagatttttatgtaaaatctcccagtttttcactgctggcaaatgaaaattgttaagtactggctgggctaaacaaaacacacattcgtatgacctctgctctattcaagcctccaagttcatcaaactaatcttcttagccccttctcccaagccctgaagactaagtgcatttcacattccagtcaccaggcctttgttcatgaggttacctctgtcttggaacatctgcccaattttcttaaaggctcaactgaggtttgtctcagtgatggctgtcttttctgacctactgtagcacatacctgttgtttaagaaatgagttggcttttcccatccccaaaacagctgtcctatcttgatggatcaaggtagatgttttgcctttgtagaaccacaatggaggtgctccagcccacttcagaggggattctggggcaagagaagctgagttaactaacaatctactcagttaataactgcagatgccgtattttcactgtcccccacccaacccccaagggcatagttattttgttctaagagctttgtgggtgaataccacccaccccctttttatttttgagacaagagtctcgctctgtcacccaggctggagtgcagtggtgcaatctcggctcactgcaacctccgcctcctgggttcaagtgattctcctgcctcagcctcccgagtagctgggactacaggcatgcactaccacacccagctaattttgtatttttagtagagatggggtttcaccatgttgcccaggctggtctcgaactcctgacctctggtgatccacccgcctcagcctcccaaactgctgggattacaggcatgagccaccgtgcccggccaaataaccccttttaaatgatgctgttagcctatacgtgccctctgatccagccagtttcttttccatggcatttctgtccatgccctacctcttcccatcttaacactattgccctgctgttccctcactatcaaagccgcctcctgaagtcttctcccatctccccaagcagtagtctcccgctcctgaatggctcactcttgctagagctgtcttatggcccatgccacatgcttccttttgttataatcttttgtgtcccttatttcctctagattgcaaactctttgcctgtgggaagtatgtcttacacatttgtatatcctcacaacacacagcctcatgtagcagacatctaatacttgtttaaaaatgaagtttagggacagcttaggagatctcgctgtctgctaggtgagtcccaagtccgtgtggttgtacctacccaagatgaaggtaagaacacccaagcctgcctcctgctcaacctgctgccctaagaaaacctctgcatgtcccctgtctaaaactgtctatgcacttcgctctgagaatgcactgtcttccatctcctaccctagcaatcaggttctatgcatctcagtgcaaacagccgttaacgtttcaggatagacaaatatgctaaaaggacaaaaggaaaaattcttgacaccattttgatttacacctcctcttcattccagcctcctggcgctttgtatggtggctggaagtgcttgacaaatcatagcaccatcaaatttatacagtcgtccctaggtgtctgcaggccattggttgcagaatccctctctgataccaaaatccactcatttctcagccctgaagtcggccctgtgaaacctgtggacacaaaaagttggccctccttatacacaagtcccgcatcccaaatttgattgtggatgcagaacccacagaaacagagggccgactgtatttattgaaaaaaatccacatataagtgaaccagcacaactcaaatccatgttgttcaaaggtcaactgtaggccgggcgcagtggcccacgcctgtaatcaccacactttgggaggctgaggcaggccgatcaacggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagtactcttagtactcctattttatagatgaggaaacaaggcacaaggtgtaagtcacttacccaaccatcacatagctagtaagtaagtggcgaagctgggacttgaacctatgtctctccttcctcaggccctttttttattcaccaagagtacaggagcctaatcctgtaggcaagggaactggatcattttgactttagttcccttgccccaggtgtgggactagaggatgagggagcgggaaagcaaaccttgatattgggagtccacagcctcagtgcaagagttgagaaaatcaatactttgcaagctcagaaactgagaggccatagccttgtcttaatccgttcaggctgcaataacaaaatatcataaactagatggcttataaacaaccaaaatgtatttctcaccgttctggagactgagaagtccaaggtcaaggcagatttgatacctggcgaaggccagcttcctagagccttcttgctttgccctcacatggtggaagggggagctagctttcttccatctcttttaaaaggacccgaatcccattcatgagagctttgccttcatggcctaatcacctcccaaaggccctgcctcctaaaaccatcaccctaggagtcaggatttcaacagatgaattttgggaggacacaaacactcagagcataacgagcctggctttggccagggaatggttaactcaagttagagagaggaaaaaaaaaaaatctttggaaaactgggctgtcctggggtctgctttagtccctggcagtctggcaatggaaagccctacttgttgctttgacttgagaagccgtaatgagcagtgagccacaggcatagaccattcagtagacacaggtctttggccagccttgaacgacaactgctcagagggactgggaagaaagcccgcctaccacagggggcagggctgggagcagaagcaaagccccaggatgggagagtaaattgttataactatccctgcgaggaggtgctaacaaagttccaggttttctgcctacttcaatatttcccggttggcatagcatctactcttagtaggaacagagttctatttgcctaacagagtcaaattacctgtccagaggtacaaacactgctaggttctaagccttcagggtagtggagaggagtggagccttacctttagtttgttgtattttcaactctctgctgtcatcttacttttaggtctggcccctttgtgaaccaaattcttctaactgagtagcattgcgttagcagtcagaaaaaaaaaaaaaaaagatgcttttcaaatataggtagatgtctggacatcccttaggcaaggtggctctgtatgagcgtcactattaaagtgaaaggaaaggaaaagtctccccacccttgtttttttttcaaaaggtatagagtgcccgaaatactttagggatggcagctgttgagcatggaaacaagacttgtccctagagggaaggcaaggaaggcatggggaagagccttcctaactccacttagtgtaaaatcactctgtcctcttcccctgacctgagctggcttattccttggaagagataaagatctgggagtcaaaatgaccaccctgtgctgagcaggcttctttgaactccagctaaacggtaacagcacctaagataggatgttcccaccctcactccccacctcaaagtggaggtgaagagggagataagggaaagggagagaaaggtcccaggaaaggtctgctgtcaagagggaggacccgcagctggctgggagcattcacaggaagtaccaattttcacctccttttttccacagagctgttgcttatttgcctacgacggctgtgttcctcttgaggctgtaatgggcagactagctcagtgggtaacagtgtgagctttggatcccagccttgccacttactcccgcgtgaacttgtgtacaccacataacccatctgagcctcatcttcctcatctgttttgagggtaagaatggtgcctacctcatctacttgcagcaaagactaaattcgtttagtgcaaatgcagagccaggcccataataagtactgtcaataatgctaagatgccatgtttattgttcttgaagcatcacttcagaatctgtgcacagcatggaaggcctgattagaaccataaaaaccagtccaaggccgggcgcggcgactcacgcctgtaatcccagcactttgggaggccgaggtgggtggatcacttgaggccaggagttccagaccagcctggccaacacgacgaaaccccgtctctaataaaaattaaaaaattagctgggcatggtggcgcgcgcccgtagtcccagctactcaataggctgaggcatgataatcacttgaaccaaggaggcagaggttacagtgagccgagattgcaccactccagcctgggcgacagagtgaaactctatttaaaaaaaaaaaaaagccagtccagatgtgtttccatgtttcctatgattactataaacacacaaatgagctgggctcacagaacctcaatagaccttggatatgtatagctaatgatgagcagcgacaggaatcgagagttcgtacagaattttttggtttggttagcgtaacaacaggctttacagacaggctccatgtgcaagcactgcacacctctgtatgttctcagccttctgagaactgtcactgccaaatcttttccttcaccctccccaccctatctcacccccaggcaaggtgacactttcaaagttggcacggcaggcagcacatgccaggcctgtgacccaggcctcagcagctctgctcacttgcatggcaattgctttctacagtcaggcccagctgcactttgggtctccccaacccccacccccaatcaccacacaggaactggctgtttctcttttcttcgtccaagctgaatactaacctactgtggtttgcttgcttcccccattgtgatcgcaggctttctgagcagctagtcaaccctctagcctgccactgaatcggaaggcattcacactggaggggatcaaggggagcttgtaggcttgccttgctggcgggcagctgcctacacccactcgtaccaatgtccccgctgcagagcccgggtgcttcccagctgtacaaggacaactatttgggtcccggctatgccaagagaaacatgggtcatgtggttcacaggacagaaaggttcatttactccaatatgactggcatttttttttgtttgattattggatatttgccaaaagactgaagcctcctgccacaaccacctcccccacatatatgtcctcagatggtttgggaattggacagcttagtcatcaggtcctgtcctccacatccacagaagatacaagttgtttccagataacatgcagaaggttctgagctccttcctgtgtgctccagctcgaagactcttttcttttccctatgaattttttttccttttctttctctggtctttcctttttaatgcccttttaaaattaagtattctatcttttgagtgggtaacacatacacatgatacaaaatccaaaaggtgcaacgagtatatgctgaaaagtaaacctctctaacctttgtccttagccattcagctctcctgtgagtcagtactgttgttagcagtttacctgtatctttccaaagatggtctatgcaaagatccacataaacttgtacatttatgttctgtttttaggtcagcagcagcacactacatacactcttctgtgccctgttttttttccacctgaaaatgtatctcggctgggcacggtggctcacgcctgcaatcccagcactttgggaggccgaggcaggtggatcacttgaggtcaggagttcaagaccagtctggccaacatggtgaaaccctgtctctactaaaaatatgaaaattagctgagcgtggtggtgggcacctgtaattctagctactcaggaggctgaggcggaggaatcacttgaacctgggaggcagaggttgcagtgagccgagatcacaccattgcactccagcctgggtgataagagtgaaactgtctcaaaaaaaaaaatgtatcttggaaatgataccacatcaatccagataaagctgccacatatttttcatttatgacatagtattcaacggtatgatatactatttatttaactagtccctgattggtggacatttagattatttccagtcttctgctagtactaacaatgctgtaacaaatctccttgttacatacatttttcacgcacatgcaaatagatctgtaggataaaaaggggtccccaacccctggtccgtggcctgttaggaacctggctgggccacacagcgtgaagtgagtggccagcgagtgagcattatggcctgagccccgcctcctgtcagatcagcggcggcattagattctcatagcagtgcaaaccctattgtgagctgtgcgtgcaagggacctgggttgcacactccttatgagaatctaatgcctgatgatctgagatggaacagtttcatcccaaaaccattccccccaaccccttgtccgtggaaaaatggtcctcggcaaaaccagtccctggtgccaaaaaggttagggactgctgggctaaattcctagaatttttgctttggtcaaagggcatatgtgtcttacatcttttttttttttttttgagatggagtcgccaggctgaagtgcagtggcgcaatttcagctcactgcaacctccacctcctaggttcaagcgattctcctgcctcaccctcccgagtagctgggagtacaggcacacgccaccatgcccagctaatttttgtattttcagtagagacagggtttcaccatgttggccaggatggtctccatctcctgacctcatgatccgcctgcctcggcctcccaaagtgctgggattacaggcgtgagctgccgtgcccagctgtgttttacatctttataaatattgttcagttatttcagtactcatggaaagactgaacaaccaaaacgttgcctctgttggaagacctctgaggaatttatcacaggaataatcaagtgctttgcttttaagtctttgttctttatttgtatctactgcaagtttgttatttctttccttcaatatgtattaaacacctcgacctctaccatgcaccaggtaagctttgaggccaaaaccataaacacaacaaatgtggttgctgcccccacagtatttacagtctaggagatggagcagttgggggcaggagtacacatgaacgaaataattatacactgagtcattacaaactgtgttaagtgccatgaaggagaagcacagggtgactgaaagtgttcagtaggctcctgacttcgtgtggaggtctcagaagatttccctggggaaatgatgtttattctgatcaataagacagacttagtgaggccgaggaaatggcaggtttgaagtcctagaggaaggcaggagcaaggattctggccagcagcatggattacaggatctggaaagggtcttcaaggacattttgtttcagtctcctcatttgacatgtgagaaaactaaagtttagggagctaaatgacttgaccagggttatacagatagtaacaaagtcaggctgcagaatccagtgtgctcatcctgggagctgtgggtctgaactagacagctatgggatagttgcctgggtttgtgtagaaggacttaagttcaggttcttgtgacaagctgcgtgacatgtttcatttctctttactagtaagatacagtttggatgaatggccattccaatctagcgggttggtttgttcttcagcatacttgtctttcttacaagtttaaataataataacaatggtggttaattctttagcgcttgctctatgtcaaatacagttctaagcaacttacatgtattaaatcatttcattttgacagcagttcttaaagttggtgttattattattaccccattttacagatgaggaaattgaagctccagaaggtaaaggcacttgccaaccatcacagagctagtgagtggcaaagcagggggaccgagtccaaacagtctggcttcagggcccatgtgctttgtctcccaggcactctcagtgtcagcagcaggctgatggactcaggtttgagcccagagctgccttgtgccatggaaggtccaatcagtggctctcaaccctggctgcacatcagaatcagctggggagcttgtaaaaagtgctaatgtccaggcctcgcccccgttcagttaaattgcaatctctaggggtggatcccagtcactgagggtttttaaaagcttccgtggtcagcctaatgcagctaacggttgagatgtactgggatctaggcttgccattgctttgccctttgggagcaaccagcaccccatacttgcctttgtgttctggacacccacttagtaggacacttgtagaggcacttattcataccacagcacaggctcctgtctcagcctaaagaactcattcagtgtacatgctttggcagccacatccaccagtgatgtgcggtaacaagtctgtaaagggctaagagaatattttcagtcctgagcgtcagaagacagtggagcttagtggagtggagcttggctctgagtcaaacagacccagattcaagttgatgctttgtgtcatggtctgtgattttagagactggcgtttatcctctcaccaactccattttgtcatccatataatcaagctaatacgataatactacctctttcatgaggcttttgtgaggattaaatgagatagtatatagaaagcaatcagtgggccaggcgcagtggctcatgcctgtaatcccagcactttgggaggccgaggtaggcagatcacctgtggtcaggagtccaagaccagcctggccaacatggtgaaaccccatctctactaagaaaaattagccaggcttggtggcagtcacctgtaatcccagctactcaagaggctgaggcaggagaatcgcttgaacctgggaggtggaggttgcagtaagccaagatcgtgccactgcacttcagcccggaagacagtgagactgtgtctccaacagaaaaaaaaaaaagaaaagaaaagaaagaggaaaaaaaagaaagaaagaagaaaaagaaagcactcagtgctaggccatgtctttatttcatgactatccacgtagcttatgtgagtaaacagctatatttgggaaaagctactagtgacactgatattgacaggaatttgatttgacatttaataagtgcctggtatgtacaatgaagagtgaaagatcctgaagagcttggatgactaggaaggccccgtgcctgctgactggcttgctggctgggagggagcataaagacacccagataactcatataaggtagagtgtgccgcagcagaggtctaaacgagaagctaagggaggccaggggcggtggctcatgcttgtaattccagcgctttgggaggctgaggcaggtggatcacttgaggttaggagttcgagaccagcctggccaacatggtgaaatcccatctctactaaaaatacaaaacagctggacatggtggcaggcacctatagtcccagctacttgggaggctgaggcaggagaatcacttgaacccgggaatggggaggttgtagtgagccgagatcgctccaaaaaaaaaaaaagctaagggagcacaagatatggagagagaaagccccaattcaaacagaagctggaaaacaattataaaataaccaaggaaatatgaatactaactgaactcaatatgtgatgatattaaggaattataaatttttaggtgtgataacggtattatacatatatttttgaggagcaattatagtttagataaacataattctaattaataatatgtaagtcagatgaattgaaatgatgtctcgtgggggtagagatgaaagaagattggccacgtatagctaattgttgaagttgggtgatggaactttgtgttcattttactggcctctctacttttatatatggttgagatttttcacaataaaaagttttaaaaagagggccgggcacagtggctcatgcctataatgccagcactttgggaggccaaggcaggcagatcacttgaggccaggatttcgagaccagcctggccaacatcgtgaaaccctgtctctactaaaaatacaaaaattagctgggcgtggtggcacacacctctaatcccagctacttggaggctggggcaggagaatcacttgaacctgggagacagaggttgcagtaagccaagatcgtgccactgcactccagcctcagtgacagagcgagattccataaaaaaaaaaaaaaaaaaaaactttttaaaagaggtaaagttgtggccaggtacagtggctcacgcctgtaatcccagcactttgggaggctgaggcaggtggatcacaaggtcaagagttcaaaaccagcctggccaagatggtgaatccccatctctactaaaaatacaaaaaaaatagccggttgtctgtaatcccagctactcgggaggctgaggcagagaattgtttgaacccgggaggcagaggttgcagtgagccgagattgcaccactgcactccagcctgggcaacagagcgaaactccgtctcaaaaaataaaaataaaagagagaggtaaagttgaagaaaaggaaggaaacaagcagtacacaattgtggaatctggaaaattttcaggatgaggtggcatctgacttgggcatgggtgactagggagagttgatgtcgcagtttaaatctgaagggagtctgctggcagaatctcctcttccttgaggggcttcagtcttttttcttttaaggccctcactgattggaggaggcccactcacattatggacaggaatttgttttactcaaagtctactgatttaaatgtcaaactcatcttaaacatgcctttacagcaacatctagactagtgtttttcccaaatagctgggtactgtggcctaaccaagttgacatatgaaattaatcatcacagggtggcagtgggaaatgatactaggaaaaccggtaggggccaaattgtaaagggttttgaattctgttaaaattgtctttagtaaacttctttggaaaatttttcttctcaaaatgttttcgttagaaaattgggaattgttgaaggcttctgagcaaagcaatggtaacatctgatgagtttggaagggtacttggctgcaatgtggaggatgagttggagagggcagagactgaaggtcaaatgatgggtaaggaaactgacccttgcttaagagagatgatgtgaggtactgggagtagagctgaaaagtatccaaagcatagaatataatgcaggtagcagcaagagatcaggctgagcagtaggcagaggccaggtcatggagcacctggtaagccagattaaagagcctggagtttatcctgatgataatgggggacccactgaagagttgaagtcaagggagtaacctgattaaatcgctctgactgctagatggggaataagggcaggtagaccagctagtaacagttgtagtagtgtgggcaaaagatgatggtggcttggactagggtgagagtggaaagaaagaaaagtaaacaaatttgggacatgtttggagccactggaacttggttagtgatggattagatcagagaaaggtgagagacagagaaaacttaaaggtgactcaggttttgggcctgagcaagtaggttgatgacagtgccatttgctgacatgaggaaaactagaggacagtcaggattggagtggagcaaaatcaagagttctgattaggacatataaagtttcagatgttcagtagacttctgagtagcaatgtcaagtagctagttgattacatgatcctgtggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgttaaaaaaaaaaaaaaattttgagacagagtccgctgcgacgtccaggttggagtggaatggcgtgatctcggctcacttcttcctgggttcaagccatctctgcttcctgggttcaagccattctcgtgcttcagcctcccgagtagctgggactacaggcatgcgccaccacgcctggctaatttttgtatttttagtagaaatggggtttcaccatattggccaggctggtctcaaactcccaacctcaagttatctgcccacctcggcctcccaaaatgctgggattacaggcgtgagccactgcacccaacttaaaaaatatttttttaaaaaaagaaaaaaatcggtgggcagagcagatcatataggaccttgtagcctacgagcatgctggaaccacttcctactggctcaggagaactgactgttaaatttcaggaaatttgggagctggtcgacttcgcatttggcagcctgaaatcagccatagtgggagtactgatgctgttgaaattggtaaatgctacaattcagcccttttttattttcccccagagaaccagttgttaaactttgccaccatattagtactatggcttgtaggctccagtaagaaatttagattttattcttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcataattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagcatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccacatttcttggaggctttgctcatttctttttattcttttttctctaaacttcccttctcgcttcatttcattcatttcatcttccattggtgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagactgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtcgtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccgctttgttttctttttcatctcagtttttgaggataagaatgctttgttttaaaagggatcatctgtgtctttttaaaagcttactgaattttcctggtgtgaattatttgcacgtactcatttttgtggttgatttggattttacagtgattaagattttacagtacctgctccaccgggcccagatcctgcttcccagatcttcctgggaagcaccaagaaatttagattttattctaagtgtgatgtaaagtcattaaaatgttttaagcaggtgagtaaaaggatctgatttttaaaaatcactgtacgtggccaggcgcagtggctcacgcctgtaatcccagcactttgggaggccgaggcaggtggatcacatgaagtcaggagttcaagaccagctgggcaacatggtgaaaccccgtctgtactaacatacaaaaaaattagccaggcctggtggtgcacacctgtaatcccagctactcaggaagctgaggcaggagaatcgcttgaacccgggagacggaggttgcaatgagccgagattgcgccgctgcactccagcctgggtgacagagcgagactccatctcaaaaaataataataataatacatcactgtacaagaatggactcccagtgggagaaggcaagatcgctaaggaaactgctgcaacaatccacatgcgcagtggtgccttggcagtgcaggtaagagttcagtcaagaaatttggaagattgttaacatcctaagactggatatagatggaccttgatttatcacaagttgattataattgacctgttatgtaattcgtgttacttagtgtctttttgttttagttgtggggagcaccagattacagaatgattaccttgactcatgacccagggctctttacaattcttaccagaaactggcagatgataaatcagtcatcttatttggtagcaaaataaggaggttactttcctgcatgaacataaatttcctcttttcaatatttcagtcttacattagcaggaggaacttgaagtcttgtgattaggcagattctttgtaagggaaaaggcagcttactatccttttggtaacagttctttactgatagggtaagaaggaaaggaggttgagtccgaacaatgctaaaggaaacactttaaagtaagacatccactgaagacccctagccattttgcctactgtaaaatagaaccatctacaatgtcttgtgaagagagaaatgaaatgaattttgatatttgttttctgcaaagattctacattacattgtgtaagtcttgacccacgatttttataactcatgcataaaattatgtgcaaatgctttaaaaattccagcccactcttatactgagcattttatgtactcattcagcaaaccattcattgagcaccagtcatgtgtcagctgctgcttaaggcactagagatacgaaaattaaaaagacccagtcctcacagagttcacagaacactaggaaaaatagacatgtaaattggacatgattacagtacaattgtgaaagaggtctctttgaaagagttgtctgtatttatttaccatctccagtctttcttttcccattctctctctttttttttttttttttttttgagacagaatctcactctgtcacccaggctggagtgcagtggcacaatcttggctcactgcaacctccacctcccaggttcaagcgattctcatgcctcagcctcccgagtggccgggattacaggcatctgccaccatgcccggctaatttttgtatttttagcagagacagggttttgccatgttggcaaggctggtttcgaactcctgacctcaggtgatctacttcccttggcttcccaaagtgctagaattaacaggtgtgagccaccgcgcccagcccccattctctattctctctctctctctcttttttttttttttttttgagacagagtcttactctgttgcccaggctggagtgcagtggcacaatctcagctcactgcaacctccgcctcccgggttcaagcaattctcctgcctcagcctcccaagtagctgggattacaaccaggctgggagattcagcttgtccatttcatgttctgtttctcacaatcatctgtgtttgcttgtcactgcactttaaagagaaggcataactcaaaagtttcacccttcaacttgatggagaattattttttatttatttatttatttatttatttatttttatttttttgaaacagggtttttctctgttgcccaggctggattgccgtggtgcaatctcggctcactgcagcctcaacttcctgggctcggtcgatcctcctgcctcaggatctactccctcctgagtagctgggactacaggtacatgccatcatgcccggctaatttttttttcttttgtagagatgaggtttcgtcatgttgcccaggctggtcttggactcctgggatcaagcgatctgccagcctcagcctcccaaagtgctggaattacaggcatgagccactgcacccagccattctatatttttaaagcatagaatattgattctttgagctggattaatgaggaaagatataacaatcattaatataaaataaagaattgtgaaacctcattaatttgcatgccactaacctaaaattgtaataacccagggcttagtaagcaaattagtcatataaacagcataactatagggatatttaaactgtttaccaaaagaagctgcttttaaagcctgctgaagtacttatttattactaataatgtctaatattattgacacttataatgttgctggcactcttcattgtcttatttaatttccatagcaactctaagagctaggtattatcactcccatttttgaaataaagaaattgaggccaggcgcagtggctcatgcctgtaatcccagcactttgggaggccgaggtgggtggatcacgaggtcgagagatcgagatcaccctgaccaacatggtgaaaccccatctctactaaaaatacaaaaaaagccaggcatggtggcaggcacctgtaatcccagctacttgggaggctgaggcaggagaatcacttgaacccaggaggcggaagttgcagtgagccaagatcgtggcattgcactccagcctgggcaaaaagagtgaaactgtgtctcaaaaaaaaaaaaaaaagaagaaattgaagctcagagaagttaaggaactcactgggtgcagtggctcacgcctgtaatcccagcactttggcaggccgaggtgggtggctcacttgaggtcaggagtttgagaccagcctggccaacatggcaaaaccctgtctctacgaaaaatacaaaaattagccaggcgatgtggcacgtgcctgtaatcccagctactcaggaggttgaggcacaagaatcgcttgaaactgggaggcagaggttgcagtgagccaagatcatgccactgcactgcagcagcctgggtgacagagtaagaccctgtctccaaaaaaaaaaaaaaaaaaaaaaaaaaaggaacttgcttaagatcaaaaatagctaatgagtagaagagacaagggttccaatccaggtctgtgtgatgctgaagcccacaggcagaagattcgcactctacctaggcttccacagatcactcaaccatgcatgaaagtaaggcctgaaaagtgtctctactaggttgcccttcattaatctagttccagtcatgtataataaaatggagtgtctttccaaaatttcataatttagatttcactcatttaggccgacttcccccctatacatacccactagttggaattagttgccttttactatatgctgtattgaatgtccttatagttgggggtcatgagaaaagctaaagtctaacttggacaagatgacgactggcattgccagggttgtgcagcaacagtagtggggtggggtgtcctgcaaggacatgagttaggtggctgttaggggcagcataagttgtagtgtaaagccttggagcctagatgccaaggtcgcagagtcaccaggaggcaggatcctggagtacagattgcagtggcccagtaggcacagcatctggcctctaggtctgcctctgctatgcaccagctgggggctttggttaagttgctctgcttctccaggtcataggtttttgtttgtgaaacgaataattggaagggaagatcttagggtccatttcagattggggtctctggtttagggatctgcgttatcagagtctaaagtaatcaagtccttggagatctagtaatcagaaggagagcaagaaagagccagctttcattgtcaggggcaacaaagaggtggctcatgcccataatcccagcactttgggaggccgaggcaggaggatcacctgaggtcaagagtttgaggccagcctggccaacatggtgaaaccccacctctactaaaagtacaaaaattagctgggtgtggtggcatgcacctgcaatcccagctactcgggaggctgaggcaggagaattgcttgaatctgggaggcagaggttgcagtgagccgagatcaaccactgctctctagcctgagtgacagagtgggactccatctcaaaaaaaaaaaaaaaaaaaaaaaaaaagaaagtccagaaagcctggtttgaatcagtaaaatcgagttttcacactgcttcactgattgtaattcattcttctacagatttttaaggagggtggaagagagaaaagctaagtaaaatgtggtcctagccatcacaggtctcatagtatcctgagggaaagagacaggaaacaactaactggaatataaaacagaataaaatgtgttcattacctgctgtatgaccttggtcaaatcacttaacctgtccctgagcctcagtttcctcaactttaacagacacataagcagtcaataaatgtcagcagctatgcatcagtagtggcaatagtaatatggactacatgtgtaatattttgtactatgccattacatcttagtaaaatagaaccatctacaatgtcttgtgaagagagaaatgaaatgaattttgatatttgttttctgcaaagattctacattacattgtataagtcttgacctaccgtttttataactcatgcataaaattatgtgaaaatgctttaaaaattccagcccactcttatactgggcattttatgtactcattcagcaagccattcattgagcaccagtcatgtgtcagctgctgcttaaggcactagagatacagaaattaaaaagacccagtcctcagagttcacagaacactaggaaaaacagacatgtaaattggacatgattacagtacaattgtgaaagaggcctctttgaaagagttgtctatattcaccatctccaatctttctcttcccattctctttttttttgagacagagtctcactctgttgcccaggctggagtgcagtggcgtgatctcagctcactgcaacctccacctcccgggttcaagtgattctcatgactcagcttcctgagtagctgggattacaggcacccaccaccatgcccagctcatttttgtatttttagcagagacagggttttgccatgttggccaggctggtctctaactcctgacctcaggtgatccacttgccttggcctcccaaagtgctagaattacaggcgtgagccaccatgcccagcccgattctctcttgagtccattccagtcagacttttgctccaccatccaataaacttctcttttattttttgagacatggactcactctatcgcccaggctggagtacagtggcacaatcatggttcactgcagcctcaacctcatgggctcaagcaaccctcccacctcagcccccccaagtaactgggactacaggtgtgcaccaccacacccagctaatttttatattttttgcagagataggggtcccactgtgttgcccaggctggtcttgaactcctgggctcaagcaatcctccccctatggcctcccaaagtgctgggattgcacatgtgagccactgcacccagccaaaacttctctttttatgataaccagtgacctccatgtgtttagatccaatggtcacttctcagtcttcatcttactgggccctcagcagctcaccactcctccttgacataccaccttcacttggcttcctggacaccacactttccttttccttcttcaccaactgctccttctcagtcttctttgtggggtctaatgtggaagtatccccaggctcaagccctaagtgatctcatctggtctcctggctttaaataccacccatgtactgatcactccctaattatgtctccggccctgacctctcccctgaactccagactcatgtagccaactctccatctccatttgaatggctaacaagcattgcgcagttgaactcctgatgttttcacccaccctcaaaaaacaaaaacaaaaagccaacctgcttctcccatagcgtcctccatctcagttcatggcacttctgtctatcccgtcacttaggccagaaactttagagccatccttgactctcctctcacaccctcatccagtccatcagccaatcctgttgactctaccttcagaatatatcgagtctgatcactgctcaccactccaccactagcatcccagtccaagctaccgtcatctcttgcctaaattactctagtaatctcctaaccagtctccatcctacttttccctccattcttgagtctttttcaacacagcagccagtgatcatgtgaaaatataaattaggtcatgccattcttctattcataaccccccccagtgaccagtcttctcagtaaaagccaaaattcttactgtgtgccctaccagccttatacaacctagccaccatttacttttgtgaagtcatatcccattactctctattttgttcattccattaccaccacattggcctcctcattgcctctgtaacaccccggacatgctcctgtcccagggcctttgaagatatctgtacaacttgcttcctcacttccttcagatctccaaaaagccatcttcttggtgaggtcttctctgattaccctaataaaaacttcagcatcctccagacactccttatgttccccctgcttttattttatccagagcactcacctcctcttagtatttggtgtaatttacttatttattttctttctttgtcttgtcttcccctgcaattagactttcagctttataggaacagggacttttgtctgtttggttcactaatgtatcctgagtgtcgggcatatagtaagtatcaataaatatgcaaataaatgaatagtctttagaggagataatgggagtataaaaaagagctaaggagtgcagtcagtatgattggggtgagtgatgcttttcatgttggaaaagttgtcatgaagggccttacatgtcattctaaggagcttagattttatcctataggcggtaaaatgtcagtaaagtagtcagtggtctgaattggaattttagaaatgcgttctggctgtagtataaagaatgaggccgggcacggtggctcatacctgtaatctcagcactttgggaggccgaggcaggtggatcacctgaggtcaggagttcaagaccagcctgcccaacacagggaaaccccatctctactaaaaatacaaaaattaggcaggtgcgatggcatgcacctgtaatcccagctacttgggaggctgaggcaggagaattgcttgaacccaggaggcagaggttgcagtgagccgagatcgtgtgactgcactccaacctgagcaacagagcgagactctgtctcaaaaaaaaaaaaaaaagaagaagaatgaattggaggctgggtgtaatggcttatacctgtaatcctagcactatgggaggccaaggtgggaggatcacgtgagcccagaaattcaagaccagcctgggcaacatagggaaaccctgtctctacaaaaaatacaaaaattagcagggcatggtggcacatgccagtagtcccagctaccagggaggctaaggtgggaggatcacctgagcccaggaggttgaggctgcagtgagccgttattgcaccattgcactccagcctgggtaacagagcgagactctgtctcaaaaaaagaaagaaaagaaaagaaaagaaaagaattgaaaaggacaagagtgggtccaagaggccagtaacagactgctacagtaatgcacacatgagatggtggtagcctgaattatgggagtgccagtggggatggaaaggaggattgcttggatagggcagtaagggtgggcgaaatgaaggaattccaggtttctggcttggggtagcttgttaaagacttgggccattcatcactgagataagaaatacagaagaaagaataaatctgacactgtcaagaagaaaggcaacgatagattctaggtgtgtcgagttttgagtacttgtgtactatccaggtagagctgcccagtaggcagttaggtgcttggttttggaggtcagtgggaggtcagagccaaagataaagatttgggagccatctgcctgtaggaggtgtttaaagcaaaagctatggtagaatttcctagaaaaggtatataaattgaggaggaccaaaagagttcctggttatcagtgccaaatattgccccctaagaaatccagtaataatatagccaaaaagagccactggatttggaaaccaggaggtcgacaatggaatacatttcatttattcaaatgtttattaaatatctactatgtgttaagaatactaaggatacagaagtcaataaaacagatcaaaaaatccctccttacatgtagctgaaattctagttgcagagaaggagcagataaataaaggaaataaataagtaaattattccaaatattaaaaggcagtgaatgctctgaaggttagataagctgcctagggtcacagggccaagtaagtgaagaaactaggactagaaacgaacctgctcaactccagagttgtgctcttcttactgttgtaccacacctcctctcccacatcgataatcttggttccattgccacagaatgccatatagccccaactaaacatttcagaaacaaaccaaagtatgtgtatagcttaatctaaactcaacaccatttctgaaagccagctctgaggggacatccccttcacagtggacaggtagtaccagttttatatgtagatggtatattgaaaagtcatttcatctgatcgtaaaattatttttctaagaggatggctgggtgcagtggctcacgcctgtaatcctagcactttgggaggccaaggcaggtggatcacttgaggccaggagtttcagaccagcctggccaacatcgtgaaaccccatctctactaaaaatataaaaattagccaggtgtggtggtgtgcacctgtagtcctagatactcaggaggctgtgacaggagaatcgcttgaacccgggaggtggaggctgcagtgagccgagatcatgccactgcacaccagcctgggcaacagagtgtgagactctgtcgcaaaaaaaataataatattaaaggagaaaacgttcctttcagagatggagcattttggtaataatagggttccgtcaggatggctctgaaggtggtgatgatgtccacggggtggccaaaatggtataaaggtgaggatcactgaagccgaaggccagaaactggtcatgggctgggtcgtctttatagatgccaaagttacctaagatgacggcgaggctaggagagggtgagccaccaggtatcacagtcttcaatgaacgtggaagagtggccagattagtagataatagcaggccaaggagtatggttcagtgacatcagccccagctaagtgcttctgtcgtgagagtgaaggaggaagggtttgggaacagcaacagagagcgagaagaatgccaccatcacaatgctccctaccctgtcacatctgtgaggtggagaaatgaacagcctccgcttgggagcttcacaggggaaggaccagtaaagacaaggaaacagaatactttaaaaaggctaagggcatgggattatgtttatcatgtccagaaggcacaggttgggagggaatgtaagtatgaaattgaatctgtcccaaatgtctgcttccttccaggcaaaataaacgacaaatatatggacagggtatcatgattgtattgcacgttaatatctgttctaagcccacagaacaagaagaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtcatgcccttcaatcactgtcattcctctcccaacccacactgagccagctttccttttgccatctttcctgattccaaaaagagttaccatttgtattgccaccgccattatctcactttacaagataatttaccctgatccaagttgactgcagacacattgatgttttctttttaagaacttaacttgattttcatttttggttttaacagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaattttttggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacactcatacatagagagagattttcggtatgttgcaagtattttttccgattaaatttattttccaaag

SEQ ID NO: 4964 - DNA, 55418 bp, human
agggaggggcggcgggggcgcactgaacatttaggaagcaagatgtctagcaggctgggccttgagagaacagtaactgtttcgcaactgaaagtcgctactcgagccttgccaactggggagactatgcccatgatatccgcggcctcggaccccggaccctccaggccctcgcgccccacccccgaccagcctcgggccaggctagggcgtagacggggcttcccgtccctcacgcgggcccgccccatgccgggcggggcctggggcccgccacctccgcccgtggccggagagccccaggcccgagccacgcggtcttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaagtaagagccgggcggggccggggaaccgggagaccggacgggggtggggtgggggagccgcggcccgacgccgccctgctgcctggactcggggccctggagtagggacggcccccttgtcgatcacctggggacccctcggggcggtgggccacctctatggcccccagagtgcagccccaatgcttttcacgttctcttggggttaccgccctgcaagatgcagttttgtggtccgcagccctggtccgagaggctttccggattggaccgggcgaggaggtggaatgcagcaaaggatttggaggaaaggaatgaaaagctctccagagagatgagtcctaaccatttccaccgtcctccaatttggaaacttttgcttaggctggcttaggaagagagagacccttttaaaggtgtttttgtctgtgtgacccaagccccgagaagaaagtgcttggtgtggggaaaggacccgatccatcgatacgaaaaggccgcagatttttgcccacacatctccccaacttaaatgaagcttgacttcaggctccgacagaggctgcagcttcccctccccaagctgagaacggccccctcagcctaccgcttcaccccactggcctcatttatttgggccttttccaccttctcccacatcaacagctgctccttaggaaaagatctaaaggtgtaaatgcagccttaaagcttccaccgagctcagaggtacctgcatttgaactggaaaccaagcctgaaagaatgaattggtagtgatggcatttcaggaagcagagatgtttctgtattggggggacggtccctgtgttcctcattcagtgggcacagtggcatctttgatatcgccttggctctgaattagacaaacagcccacatttgggagagtcggtcttgaccgcatagtttagtcttggcggctaatagtcaaaggattttgccttgacactgtcactcacctgggaggccagaggtggaaggctcacctggcagccgacaagccgaacggaatcatccttattacctaggcctctaggccagtactcattttgcctctgcctggaaatagagttcccttctcttcctctgcagagggactcatgggtgggaccatgacatttagttaaggccctttttcctccccacctctgcttgccctcatcaacatctggcctgcagtctgtaaacagttctcctctgagtcttaatgactcagtttctcccccacttcaccctcttctctacaaagtagtgtggaaatcttcctttggatgggataaaatatgtccagaggggtggggggcagaacttcaaaggctggtttaagtattgtggctcttctgctaagcacctagtatatgcacattagattttttaagctcctgcctcctgccctgtaaggtccataggacaggaagcattgtgcctgttttacagatgcagaattgggctcagagtgatgacacctcttgtcagtgaccgagctgagctccactacctggccttctgactccaaatctcatagtctttctgttacatcatgctgcctccctgcatccatttgacactaatttagtcaggctacattaagtccccactgtgtgcacgatgctgaggacaatgccaggatggaaggggcatggtccctgtgccccaggagcttacagagtaatagaagagtaagactaatatgtccatgaccataacacacaaggtagcatgtgattgtcatggataatgtgctctagaaatgtacccttctgatgagcgatgaggaggagaaaatgtgaagacttcatagaggagaaaaaaatttgagtttggcattgggagaatgaggagtctgctgggcagagatggagagaaagatactgcagttgatgtcagcaaatgcacagaggtgggaaggcaagcagcacaacaggaagtccaaccagaaaagcaggttggaatgagatattagagggttggattaagggatttggacttgacttggtatccaagggtagctgtgggaggtttttgtggggggtggggggaggtgtgttgtgattaaagcaattcaatggaaatgatcgtcacatcgtggcagagtaagatgactagagaggaggaagagtggagacagcagggccagttaggaacctgttgcactagtccacatagcagctgagggcaccggcaataggtgaccatgggagcagagaggaggagatgtctgggagaacgagaacagagacttacctgggctaggtttgctaggaattttttttcccctacaggattattttctttctgaaaactaaaaggaagtattttggtgaatggcaaggcatagttggaaagcaaagtgtttgattaatcgcgatgccatccttcctacatcaacatgatactcttgattcatcattatactgattcatttctactcttttctgaccatgaatttgcaaaacagttggctgggggcctgtgatcatgggtttgaacaaaacataaacatccagaatgttcagggaatggggtagttaagtgacttgtccacaaatgcaattaatggaagagctggaacttgaagccaagtcttctggctccttagttcaggtctctgtctaccattgcacagcagaaatatctgcttagttggattgacgatcaagagtccactcagtagtctgttgggagctaggttattgtaatgggtggctttcagatgtatcaaatagaagacccccccgccctggaacttcacaaccgcttgtctatcttatctaataaacgttagtttgggtccctgcagctctgaaattgttcataaccaacactatttctttattgaataagcacttcatgagcttatgtttggctgcactggctgccaacctgttaggttgaagtattggcagttataattacacatatccagggtgtgtgttgtatctgtgctggctgaaaggaaggggttgctgcaattcaccagtgtatccagtctcactggaaaaagcttctgtgcatgtatgtgtgggggtgggaggaagaacagaaaagggaacagtgccgccctagcaaatcaaaagtttaagatgcatggactgagatgacatcattggcggattatcagggttgcctgccctgactctgagattctaaggggaacaattgataggacttatctctgtatcagatgggagaagtctgcgaaaaaaggacttcctatggttcttctttttaattgtgtatatttgatattgagactctataaaagaaactgatataaaatacggctcctcttcctagttcatcaagtcattcagtgaattaagggcctgtttcctctccgcttgcccctaccagtcatttccttgtcagaagtgttgaactcccttaggctctatgctgaggactaacacagggtctgatacattgtagaccttcaataaatgagtagtgaattaactatgccctagaagtgaccaagtgggatggggaataagagtgggacaaggagaatgaatggtatttctttgggcatttcaaactccaccttctaggtggttccagcttgctgcagaccgcccctccagtcaaaaatttctttttttttttttggaagaagtattgctctgtcgcccaagttggagtgcagtgacgcaatctcggctcactgcaacctccacctcccgggttcaagcgattctcctgcctcagccttccgagtagctgggattacaggtgcacgccaccatgcctggctaatttttgtattttcagtagagacggggtttcactatgttgaccaggctggtctcgaattcctgacctcgtgatccacctgccttggccttccaaagtgctgggattacaggcgtgagccaccacgcccagccccagtcaaaaatttctacttcctctgtttcccctgtcctttctgaggtccccctccaacttgactggccagggtatagaagagggaggaacgaggaagtgggcaggcaggcagtacaactgaggcagatagtctgttggtgaatgccacctgtttgagaaaaacctctgtcaaacttggtttttcctctgctctcacaccacaacaacaaccctcaacacagaagacttctgtgaccaaatgagtgtggggaaccccacactctgataaatggacaccaactaggtgtcctctgattcagttctgacactgtctacctggacataatgtcagaccaagccacaggttaagggcttggtccccaagaatggcccccaaccagacactagtcacaagtccaggcctccagaacttttttttttttttttttaagactgagtctcgctctgtgacccgggctggagtgcagtgcgtgatctcggctcactgcaacctctgcttcccggattcaaactattctgctgcctcagcctcctgagtaactgggattacaggcgcccgccaccatgcccagctaatttttgtaatttttttactaaagagaaggttttgccatgttggccaggctggtctcgaactcctgacctcaagtgatctgcctgcctcggcctcccaaagtgctgggattacaggcatgagacgccatgcctagccaggcctccagaacttctgaccaaccagcttcaagttggggttcccacgaccccctctttgggttcgattaatttgctagtgcggctcacagaactcagggaaatagttaatgtttaccagttaactacagaggataccacaaaggatacagagaagagatgggcagggtgaggtaaggggcagggggtgtggagcttccatgccctccctgggcacgccacccttcaggaacctccacatgttcagccatccagaaggttcccaaaccctgtcctctcgggtttttatggaagatttgttacagaggcatgattgacaaccatgtagaaatgtgactggatgaaaagcacatgatctaaacccagcaaggcctgtctgttcagacttttcttggcctctatgcagcgttcctttctctagggcagaggtgtccaatcttttggtttccctgggtcacactggaagaagaattgtcgggccacacataaaatacaataacactaacgatagctgatgagctaaaaaaaaaaaaattgcaaaaaaatctcataatgttttaagaaagtttgcaaattggtgttgggccacattcaaagccatcccgggccacatgcggcctgtgggctgtgggttggacaagtttgctctagggtatggggcaggaccctctctgggatgaggatcttttaacccacaatcagattagagtcctaccttgggcaggtaaaaggagggcaggagaaggtcaaagagagaaagattctgtttcctgagacctaaagtgccccaacattataacaaggactagggaagttaggagccaggaaccatgggtgaaaaccaatgtatgtatcatagcaccacatcacctttacttccctgtatgtttaaaagcagctgattaactcaaatgactgtttcagttaatgcggctaaggtaggttgacaaaatgaagtcaagactcctacagcttgaagatgtttttaatcagtgagtgtttacttgaaagcaaaagagctagcctagaaccccttaaatgctttcacctgaatgcccactcttatttctcatgcagcagcccctggcctatgggcaactgaaagaacaggaaatgcacctcctcactggaggtttgaaggctaaggaactggggatgctctcattttaaaaagataggccgggcacagtggctcacacctgtaatcccggcactttgagaggctgaggcgggcagatcacttgagcccaggagtttgagaccaggctagccaacatggcgaaaccctatctctacaaaaaaaaaaaaaaaaaaaaaaaaaatagccaggcatggtggcgcacatctgtagtttcagctactcaggaggctgaggtgggaggatctcttgagcctgggaggtggatgttgcagtgagcccagatcatgccactgtacttctgcgtgggcgatagagtggccaccgcacccggcccagaactgggcactttgggaggccgagcggggtggatcacctgaggtcaggagttcgagaccagtctggccaacatggtgaaactccgtctctactaaaactacaaaaattagctgggcatggtggcgtgcgcctgttgtcccggctacttgtgaggctgaggcatgagaattgcttgaacctggggaacggaagttgaagtgagccgagatcgtgccactgcactccagcctggccaacaaagtgagactctgcctcaaaaaaaaaaaaacgtaattactgagatgctcgaagttatcatttgaagaaattttgttcctttttaagtttcaacagaactgaaagactgcactccagttggtatttaccaggtacttctgtgcatttacaccccacaggcaagccagtgttgacaattatgtagataaaagtagaaaatgctttaagtgggaaggacttgggatagatgtaaattaagaaagttaggcatctcttatagccaactagcatcatataaatatagaaaaatgtaaatgtattattcatgaatgcttatatagtactatagtaacttttcactttgtaaagtactttgaaatgctggaaaatatttcaagaactagtggagagaactctagcacaatccatagttgatttctctggcctttccccctattttctcccagatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtaagatggaccttttcaccttgtccaagaaaaggctatgttctctgaaattacaaatgtattgtatacctttgtgagccactaaatcagttttactgagatcaaggttatatggattcaacctacatagaggcaattagcttcattctattccatagccatacactccactcctaaactttggccagttacatccccgggaggggagtagaccagaaagtggaggtgactcagcaaactggtaagaatgcaattctaaccactctccatctgactgcagaaggagtattcagtgtacatacacattgatatgccatgagggcaactagggtagcaactgtgtcttctggggtctttgtaacctttgccagagctacacatttatggcccaattgcaaaatccagtagactttttccctttatctgaacttggttgcagcatttgataaggttgaccaccccttcttctggaaacttggcttccaggacccctccaagtcctgggtgtcttcccatctctctggcagctctttcttatctgacttatccggcccatctgggtcgtctgatactgccagcccctacatgttgctcttcccctgggctccttccttagctttctttttaccctcccctttagcttgcttctcatcctccaaaccctccctaggtggcctcatctatgctagtggcttaagcaagcgtcagtgtattctgtgacccttattctctacctctttagtaacaatggccaacttttggggggaagtacttaccatgttctgggtactgggccaaatgcattgcatgcgctttctcatgaggccttattttacagatgaggagatagatgcttcaggaagctaagtgacttgcccaagtccacatagatagaaagcaggagaaactagcaatagaactccagagccctctgttagcccctgactgacaccaattcccaatggtagtatgagtccctgctgttggacaccttcacctccatgctccctaggcacatcaaattcaagattaaccctgatgtcctcgttggtctcaaactagctcttcctcctgtgttccctaatgaatgagactaccttcctttcaccccgtggcccaagccagaaaaaaaagcctagggatcacttcaacttctcctctcactccacccccacttgaatcaccaagtcccgtcgatttgactcatcctctttcccacaggtccttacaactcagactctcagggtctcccacagactctggctcctacctgcttccactcttggtatctcctgccccagtcttccccgtgcactgctgcccggctgaggtgatctctccacgtgcaatttcatcgtttcacggccctcatttcactgctctccttaaaaagtattcagcgactcctgagctacaggagaaagcccaaattccttaggacattctagatccttcagacctggcccctgccagtttgtcctacctcatctcctgccatacctccacctgcattcatgctccagcccttcagaaaaacttggatttcctggaaataccactccctttatacatgctattccctttgcctttccactctgtcaaagtctgatgaactcctatttattcctcaagacccagttcaaaagttctctctttcatcaagtccctcctgactcccccaggcaaaattaatccctttgatccttgtgtacctaatgcatttcatatagcccccctgttgtggcacacatcaggggtgttatactgactttgccctggctgtctgttctcctcgatgatgagcatctccagaaattagcccgctcctctttcgattcccagcacctgacatagggcctggcacataacctaagctttccagacattttctgaatgaaggtaaatggaaggttggtgagccaattaaataaacattacatttttctaaagataagcaatttcacttgtattatcccctattttaaatttcattttgagggagaaatttagtccctctgtaaactaaagatggctcctaaaggttctggaagtttgtgaaagtgccacctactatattacttactcaccatctcagttcttagaaaggtgaggaagccacacagtgtagggtgcccactgggccatgatatgaccatgtcattcccaaaggtgaagtcaggtgacctccctcaccatcgagagtctctcactttccagttttcataaaatgtttccttctcagctagagatcagtccctcctgtcctccaaaacataatgaggtgctgcccactggctttttttacttgagtgattttttccccgaacattaaaaaaaagcttcaaacatctagaaaaattaaaagaaatctagagtatacatccatggaccatctagatgctacaattaacattttgctattcatccctccagccattcatcagtccatttttattttatttatttatttatttatttatttatttatttattttttgagacagaatcttgctctgtcacccaggctggagtgcagtggtgcaatctcggctcactgcaacgtctgcctcccaggttcaagcgattctcgtgcctcagcctcccaagtagctgagattacaggcacgcacctccacgcccagttactttttgtatttttagtagagatggagtttccgttttagtagagatggagtttagtagagacgaggtcaggctggtctcgaacccctgacttcaagtgatccgcccacctcggcctcccaaagtgctgggattacaggcgtgagttactgtactcagccagcccaccttttttttttttttaatgatttcagtgtaacttgcaaatatcaatacacttcacccctaaacccttcaacatgtgtgtcattaactagagttcaatatttgtgtatggttcttttttttgagatggagtttctctcttgtcacccatgctggggtgccgtggtgcgatctcagctcactgcaacctctgcctcctgggttcaagtgattcttctgtctcagtctcccaagtagctgggattacaggtgcccaacgccacacccagttactttttgtatttttagtagagatggggtttcaccatgttggccaggctggtctcaaactcctgacctcaggtgatcctcccgccttggcctcccaaagtgctgggattacaggcatgagccaccacgcccagccgtatggttgttttttaaagtacaatttacatccagtaaagtggacaaacctttagtgaaccatttgatgcattttgacaaatgacacaacccctaccaaaatatagcacattatcgcactcaagaaagttccctcatgctccttgggttggagggattttagcaaccccagagcccctcctgttttctttccccggaatccccccaggaatttatgttctcaagccagtgttttcccaagacagcagcagcttctccctggccttgttttgcaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggtgaggagttatcagagtggggtagggggtggaatgctttgtagtgtttgtggtcgggtaataacagcaaagaacactgaccccaagtgatgccaggtttccaaggagcttctgactgctcataaatactgtgcaaacccccactctgtggcatttctgctgctaacctcagagctgttggcttgagccccggctgcctcctcattcccatcctctgttttttggtcttttaagaagcctccaggctaggggcggtgattcacgcctgtaatcccagcactttgggagggcggaggcgggtggatcacttgaggtcaggagtccaagaccagcctggccaacatggtgaaaccccgcctctactaaacaaacaaaaattagctgggcgtggtggcaggcgcctgtaatcccagccactcagaaggctgaggcaggaggatcacttgaacttgagaggcagaggttgcagtgagctgagatcgcgccattgcactccagcctgggtgacacagaaagactatgtctcaaaaaaaagaaagaaaaataagaaagaaagaaaaaaaagaagcctccagatgaggcttctcttttctttcctgacttcctgattatatcacttgtggctctccttcctccaagaccagcagagagtagaatatgaaatgcagcctgctaatgctccctgtccttgctgcctccacagcaaggatgccactcttggtttcctcactgtgccttacctcagtgaagcagactggataggaccaacataagctaggaactgtagctaacaagggtccagcatccctgactccctcgctgaggaaggaactgcatttaaaatgtggcagcatcaggccgggcacggtggctcatgcctgtaatcccagcactttgggaggccgaggtgggcggatcccctgaggtcgggagttcgagaccagcctgaccaacatggagaaaccctgtctctactaaaaatacaaaattagctggttgtggtggcacatgcctgtaatcccagctactcgagaggctaaggcaggagaatcacttgaacccgggaggcagaggttgcagtgagccaagattgcaccattgcactccagcctgggcaacaagagcaaaactctgtctcaaaaaaaaaaaaaaaaaatgaggcggcatcttagtgagaccactgaggcaaaatcctagaatcagaagttccaaagtgagtaattgtcttagcctagaataagccaattttgatcaaagaaaaatcagactagttcaaataaggttgggtgggtaacagttatatctgtacagtgggggcaggcccagaatcctagcagggctgaggtgctgtatcttctcttagccctgctcaggcccttaaaattcaaaaatagctaatgcatgctggacttaatacccaggtgatgggttgataggtgcagcaaaccaccatggcacatgttcacctacgtaacaaacctgcacatcctgcacgtgtaccacagaactaaaaataaaaatttttaaaaaaattccacttccataggctaggctgtctccatggcctcttctgggcaaaccctgatttatacaagcaatatattcctgaagaactctatagaaattaatttggggtcagctgaatccaagtttaaatgagcagtcccagccaagtttggttttcccctgtgactctaacttgtcctcgcttgctcaatgtccctccccgctcccgctttccctctgtagtagtcccggctgccctgggccatcgcttacctcagcactaaacagcctgaaggtgcttatcaaagctgccactccactccctgaaacttcatctgtctgggttgcattcctttcctgtccttgtccaaacagataattgtcgcatcattgtaatggtagtataggtgcaaaatttttctattcgttggtaagaagtctttatatattaaagatattaaccctttgtcatacatttcacacaatttttccagtttgacatttggtgttttttttttttttgagagacagagtctcactctgacacccaggctggagtgcagtggcacaatctcagctcactgcaacctcctcctcctgggtttaagcgattcttctgcctcagcttcccaagagctgggactacaggcatgtgccactacacccagctaatttttgtatttttggtagagatggggtttcactatatgttgaccaggctggtctcgaactcctgagctcaagagatccacccgcctcagcctcccaaagtgctgggattataggcatgagccactgggcccagccaacatttggcttctagtgctatttatgtgttgttggtggtggtgctttgttgtacatatttgtagaattttatctaattatatctattacttttttgtttgtttgtttctgactttgcttttctgcttaaatgtaaagtctgcttagtgcatgcttatcttttttttttaagtatttctaattttaaaaataatgcacatttggaaggccaagatgggaggatcacttgagcccagtagtttgagaccagccttagcaacatagcgagaccttgtctctactaaaaataaaaaattacctgggcatggtggtgtgtacctgtggtcccagctacttgggagactgaagcaggaggattacttgggcccaagaggtcgaggtcacagtgagctataatcctgccaccgcattccagcctgggtgacagagagagaccctgtctcaaagaaaaaaaaaagtaatgcacatatactttaaaatggttaaaatggttcattttatgtatatttgaccacaatgaaaaaaaagtaatacacataagttgtagaaaatttgggacatacagaaaagtgcaaaaaggaaaataaattacccatagcccaacacccatggattataatgattaatagttttccttctatggaccttcatatatatacataaacacactcacacacatataaagatatataaggttatttcttttacaaaattgtgttcacactgtatataaaaattagtatccttaggccgggcgcggtggctcacggctgtaatcccagcactttggggggccgaggcgggtggatcacctgaggtcaggagtttgagaccagcccggccaacatggcgaaaccccgtctctactaaaaaatacaaaaattagctggtcatggtggcacatgcctgtaatcccagctacttgggaggctgaggtaagagaatcccctgaacctgggagatggaggttgcggtgagccgagattgcaccactgcactccagcctgggcgacagagcgagactccatctcaaaaaaaaaaaaaaaaaattagtatccttttttcacttattatataatgggtatttccctgggccattaagtatttaattatcaaataatattccaccatatggatgtgccaaaaatatgtaacaatttctcctttttttaatatttaggctttttctaattcttgagttatactaacattgtaatgaaaacctttgcattttttcatatctgtgatgatatccttaggctatattcctagaaattgacttataggtcacaaaatatgaacaattctaagactcttcatgaaatgtgcactccagaaaggttgtaagtttgtaattccaccagcactaaagcagtggctcagcttctaaactctcaatattcattgatattaattatcaatattaattgtcactttttaaatcattatgaacctaatagctgaaaaatagtatcccatcattttaattttaatttgattgattataagcaaggttgcactggccctttgtatttctttgtaagttttgtatttatgtccttgccctatttttctagaatattcaactttttctattcattggtaagaagtctttatatattaaagatattaaccctttgtcatacatttcatatatttttcccagtttgacatttggcttctaatgctgtttatgtgttggtggtggtggtgggtttttgttttgttttgtttttttagacagggtctcgctatgtcgcccaggctggagtgcagtagcagttcaagcatttctcctgcctcagcctcccaagtagctgggattacaggcacctgccaccatgcctggctaatttttgtatttttgatagagacacggtttcagcatgttggccgggctggagtggtgatgttttgttgtacatatttttagaattttatctaattatatctattagtattatcttctgtttctgactttgcttttgtgcttaaaaggcctattctatcccatgatcctatgactattcacttatatgttatttaaatacttttttagttgtgatttttacacttggcttcttttttttttgagacagggtctcactactgcccaggctggagtgcagtggtgcgatctcagctcactgtagcctcgacttcccaggctcaggtgattctctcacctcagcctcctgagtagctgggactacaggcatgcaccaccacacccagctaattttttttttttttttttttttttgagacggagtcaggctctgttgccaggctgaagtgcagttgcaccatctcggctcactgcaacctccatctccctggttcaagcaattctcttgcctcagcctcctgagtagctgggactacaggcacgtgccaccacacccagctaaatttttttttgtatttttagcagagacggggtttcaccaagttggccaggatggtctcaatctcttgacctcgtgatccgcctgccttggcctcccaaagtgctgggattacaggggtgagccgccgtgcctggccatcatacccagctaatttttgtattttttgtagagacagagacttgccatgttgcccaggctggtatcaaactcctggactcaagcaatcctacccatctcaaactcccaaagtgctgggattacaggcatgagccactgtgcccagccttacacttaacattttaatacatttagaatttacctggtgtggcagggtgcagtggcttgtacctgtaatcccagcactttgggaggccaaggtgggcggatcacctgaggtcaggagttcgagaccagccgggccaacgtggtgaaaccctgtctctactaaaaatgcaaaaattagccgggtgtggtggtgcgtgcctgtagtcccagctactcaggaggctgaggcaagagaatcacttgaactcaggagatggaggttgcagtgagctgagatcatcccattgcactccagcctgggcaacagagcaagactcagtctcaaaaaaaaaaaaaaatttacctggtgcacaggtgccgtgactcctgcctgtaatcccagcactttgggagtttgagataggtaggatcacttgaggctaggagttcgagaccagctggccaacatggtgagacccgtctccataaaaaatacaaaaattaactgggcacacctgtaactggtgcacacctgtagtcccagctacttgggagactgaggagggaggatcacttgagccctggaggtagaggctgcggtgagccgtatttgtgccaccacactccagcctgggtgacagagcaagaccctatctcaaaaaaaaaaaaaaaaaaaagaattttcctggtgcatgatatgaaacagtcatctaagttttttttttaatagtttaccaattgtttaagcaccattttttgaataattcttttctccactactttgtgctgcagctttcaccacatactaaatgtttatatctattctagggtctctatcttaatgaccataactttagaaaaatgccttttttttttttaatttttttgaaatggagtctcgctctgtcgcccatgctggagtgcagtggcgtgatctcagctcactgtaacctccgcctcccaggttaaagcgattctcctgcctcagcctcccgagtagctaggactgcaggcatgtgccaccacgcccggctaagtttttgtatttttagtagagacaaggtttcaccatgttagccaggctggtctcgaactcctggcctcatgatctgcccgctttggcctcccaaagtgctgggattacaggcgtgagccaccgtccccggccaaaaaacaccttttaatgtctagtggaatatagccctcctcattgtttttcttttcaacatttccttgattattttcgggcatttgttcttcctgataactttagaattaccttgtgattatgattggaattatgtaaaacccatacacttggagtaatttatgtaaaatatttcatcttttattcagagacacagtatgtctctcctttactttcaatcttctttctttagcttgaaccagatgaaattaccaatattcaactttgttgacatcattcaaacagcaatttcatctggttcaaaccttagaaaagttgttttcttcaaagggaaattatgctctctctaaacaaacaaaaaaatagtttctcttaaaaaatctggggagaagtagggtaggaaagaagtatgatatactgtaagtgttttattcattttttaaaaatcctggtcctaagaatttctcactgccaggggcatctctccagcactttcagccacttcatgcctagttcaaggcttcgccagcttagcttcctccccatagtgggccagtccaaaacaaccagggccttgagcctcaaggggtagggctagtccgtgaaaaagggtttcaggccaggtgcggtggctcacatctgtaatcccagcactttgggaagccgaggcgggtggatcacctgaggtcaggagttcaagaccaacctgaccaacatgatgaaaccccatctctactgaaaatacaaaaaaaaaaaaattacccaggtgtgttggcacgtgcctgtagtcccagctactcaggaggctgagagaggagaatcacttaaacctgggaggcggaggttgcagtgagctgagattgtgccaccacactccagcctgggtgacagagcgagactctgtctcaaaaaaaagagaaaagaaaagaaaaaggtttcagatgaagttcaatgacatctaaatgggacgggtaagggtcccagtcttccccataaaccttagttttgctttctcttcctgagagctagaacagtgacctcatctgggagaatccagccaacaccgcattctacaccatctgcattctatacccctaccacaacaacccactataaactggggtaagatacactagaagtgggtatttgggggtaatcctgatcatctttttcctcgtatgggagccttccaaataatgcatatatagagcataagaagaagtttcaaatagatgcaaagtcatgatggttgtaaaaaaaaaaaaaaaatccaaagaggtaattgcactgttttcacaaaataggatcaacatgtaattatgaataacaatataaatgtcatccaaagatataggaagtgaacttttagggtttcagtgaaagtgttattttgcaggggttaataaacatactaatactttgtccaccctatgttaaaaaaaaaattcacccccaagacagaactgcaggctgcttttaaatgcaaacatggcattgggcttctctggccattagatgtcactgcagtaaatggagagtagctgagcatcacctgattggagcctgaagttcggtgatctctgtccagttaacaacttcataatccctgcttgaaatccatctttggtttggagaataagaggcctagaaaccacaggctaatgctaaacttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcaggcctgtgcacacatggaatgaggtgcccccaacttggtgtgctttcacggaccccaaccaccctgcctgaaatccccttctccacgcttcagtgcatcttagctcaagcccttccaggtatagcctggcctttttgtctatctcccacacctagcccagggcctgggccagaagagatggcagaacttagtgtattgagagaacaagtaggaagggtaaaatattgacagagatgaattcatctgattaatctgtgcaccccgaataagaaccagggagtcctgagaaaatggctctctgcacaggtgcatgtgaagaagagagggagataggctggggaatactgccctgaaaatccagggagcagctgagaatgtaggagccttggaatctggcaggccttctgaaaggatcaggagggaggtaccagacacatgctcggtccccccacaactctgcctgacaccctcccctattgcccatattaggtgtctccatttcatcaaatataaaaccaagtgtgagcctgttgctttataccccagtggactttgaccccatcacagctcacaaggtaagcaggattgggccaggtcagcatttgaactgaaagcacataagatgaaggacaaaggtggtatccgagtggtacagctgactgagcagaatatacatggtcagtgaataaacagaggccccagcctactcaaatagagatgctcgacacctcgggttacctttgttgaattggacacagtcacttcattcattccctctcagggtgctcatcccctcttgtagtttttcatgttcatatctacatcttcaatcctgacctcccttctgagccatggtcccacatttcccacagcctgctcgacatcactatttggctatcatatccccactgtcacctctaacttaatgtgcatcaagctgacctcttcttttcctaacactgttattccagagttttccatttcaattccatcattgccccagtgactcaggctggaaatccacaacttgtgtttgactcttccccttcccctcacccggttaaccttgagccctgttgcttcttcattcctaacattcccatgctggtctttctttttgtcactgcctcttgccctaatcttggaccttatcagctcatacctaggctattacagtaatctcctcattggtctccaggattaattctaaaaatgatcttaagcattgaatattaatatgtactaggcactgtgctaagtgctttatgttcattatctcatttaatccttacaacagccctacaaggtgggcactgttattattaagtccattttacagatgagaaaactgaggcaccgaaaggttttgtagcctgcaagttcacccatccagtaattgagctgggatataagcccagggagcttgtctccagagtcagtgctcatttcaatcctctccagcccagcccatatgggattctgtcagatgaatctttctcagatctgtctgcgttagatccttttttttttttttttttctttttgtgagacagggtcttgctctctctcccaggctggagtgcagtggcacaatcacagctcattgtagcctcaacctcccgggcccaagcaatccttccacctcagcctcccaagtagctgggaccacaggcatgcgccacctatgcctgactaatattttaaatgttttgtagagatgaggtctcctggtctccttatgttgcctaggctggtctcaaactcctgggctcaagccatcctcccgctttgacctcccaaagtggtgggattacaggcatgagccactgtactcagcctgttgttgtgtccttcttgatggtccccagagaaaaaaggctgagccccttggcttggcatgtttcccttaccaactgtgcgatccttgttgcacagaggccctttatataagaagttacaaaaacaaatgcctgcagaaacttggaagtaacatgaaaaagagaatgtagggaaacccagataacatacactcaccctgtaaagaataagccttcaggctgggcctggtggcccacgtctgtaatcccaccactttgggaagccaaggtgggtggatcacttgaggtcaggagttcaagaccagcctggtcaacataatgaaaccccgtctctactaaaacacacacaaaaaaattagctgggcatcatggcaggtgcctgtagtcccagctactcaggaggctgaggcgggaggatcgcttgaacctaggaggtggaggttgcagtgagttgagattgtgccactgcactccagcctcggtgacagagcgaaacttcatctcaaaaaaaaaaaaaaaaaaaaaaaaaaaaagccttcaaatgcattccgagccatcatggctttcaaaagcattctggagagctaaacttcactgtgctcacaaaatgtgatttgcatctaaatatggatgacagaaaggaagaaagagagccagtagaggctgtggccagttcctcctctccaaaggacggatgccatttagaaatgtaggcccagttttcaaaggagtctaaaatccagatttttatgtaaaatctcccagtttttcactgctggcaaatgaaaattgttaagtactggctgggctaaacaaaacacacattcgtatgacctctgctctattcaagcctccaagttcatcaaactaatcttcttagccccttctcccaagccctgaagactaagtgcatttcacattccagtcaccaggcctttgttcatgaggttacctctgtcttggaacatctgcccaattttcttaaaggctcaactgaggtttgtctcagtgatggctgtcttttctgacctactgtagcacatacctgttgtttaagaaatgagttggcttttcccatccccaaaacagctgtcctatcttgatggatcaaggtagatgttttgcctttgtagaaccacaatggaggtgctccagcccacttcagaggggattctggggcaagagaagctgagttaactaacaatctactcagttaataactgcagatgccgtattttcactgtcccccacccaacccccaagggcatagttattttgttctaagagctttgtgggtgaataccacccaccccctttttatttttgagacaagagtctcgctctgtcacccaggctggagtgcagtggtgcaatctcggctcactgcaacctccgcctcctgggttcaagtgattctcctgcctcagcctcccgagtagctgggactacaggcatgcactaccacacccagctaattttgtatttttagtagagatggggtttcaccatgttgcccaggctggtctcgaactcctgacctctggtgatccacccgcctcagcctcccaaactgctgggattacaggcatgagccaccgtgcccggccaaataaccccttttaaatgatgctgttagcctatacgtgccctctgatccagccagtttcttttccatggcatttctgtccatgccctacctcttcccatcttaacactattgccctgctgttccctcactatcaaagccgcctcctgaagtcttctcccatctccccaagcagtagtctcccgctcctgaatggctcactcttgctagagctgtcttatggcccatgccacatgcttccttttgttataatcttttgtgtcccttatttcctctagattgcaaactctttgcctgtgggaagtatgtcttacacatttgtatatcctcacaacacacagcctcatgtagcagacatctaatacttgtttaaaaatgaagtttagggacagcttaggagatctcgctgtctgctaggtgagtcccaagtccgtgtggttgtacctacccaagatgaaggtaagaacacccaagcctgcctcctgctcaacctgctgccctaagaaaacctctgcatgtcccctgtctaaaactgtctatgcacttcgctctgagaatgcactgtcttccatctcctaccctagcaatcaggttctatgcatctcagtgcaaacagccgttaacgtttcaggatagacaaatatgctaaaaggacaaaaggaaaaattcttgacaccattttgatttacacctcctcttcattccagcctcctggcgctttgtatggtggctggaagtgcttgacaaatcatagcaccatcaaatttatacagtcgtccctaggtgtctgcaggccattggttgcagaatccctctctgataccaaaatccactcatttctcagccctgaagtcggccctgtgaaacctgtggacacaaaaagttggccctccttatacacaagtcccgcatcccaaatttgattgtggatgcagaacccacagaaacagagggccgactgtatttattgaaaaaaatccacatataagtgaaccagcacaactcaaatccatgttgttcaaaggtcaactgtaggccgggcgcagtggcccacgcctgtaatcaccacactttgggaggctgaggcaggccgatcaacggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagtactcttagtactcctattttatagatgaggaaacaaggcacaaggtgtaagtcacttacccaaccatcacatagctagtaagtaagtggcgaagctgggacttgaacctatgtctctccttcctcaggccctttttttattcaccaagagtacaggagcctaatcctgtaggcaagggaactggatcattttgactttagttcccttgccccaggtgtgggactagaggatgagggagcgggaaagcaaaccttgatattgggagtccacagcctcagtgcaagagttgagaaaatcaatactttgcaagctcagaaactgagaggccatagccttgtcttaatccgttcaggctgcaataacaaaatatcataaactagatggcttataaacaaccaaaatgtatttctcaccgttctggagactgagaagtccaaggtcaaggcagatttgatacctggcgaaggccagcttcctagagccttcttgctttgccctcacatggtggaagggggagctagctttcttccatctcttttaaaaggacccgaatcccattcatgagagctttgccttcatggcctaatcacctcccaaaggccctgcctcctaaaaccatcaccctaggagtcaggatttcaacagatgaattttgggaggacacaaacactcagagcataacgagcctggctttggccagggaatggttaactcaagttagagagaggaaaaaaaaaaaatctttggaaaactgggctgtcctggggtctgctttagtccctggcagtctggcaatggaaagccctacttgttgctttgacttgagaagccgtaatgagcagtgagccacaggcatagaccattcagtagacacaggtctttggccagccttgaacgacaactgctcagagggactgggaagaaagcccgcctaccacagggggcagggctgggagcagaagcaaagccccaggatgggagagtaaattgttataactatccctgcgaggaggtgctaacaaagttccaggttttctgcctacttcaatatttcccggttggcatagcatctactcttagtaggaacagagttctatttgcctaacagagtcaaattacctgtccagaggtacaaacactgctaggttctaagccttcagggtagtggagaggagtggagccttacctttagtttgttgtattttcaactctctgctgtcatcttacttttaggtctggcccctttgtgaaccaaattcttctaactgagtagcattgcgttagcagtcagaaaaaaaaaaaaaaaagatgcttttcaaatataggtagatgtctggacatcccttaggcaaggtggctctgtatgagcgtcactattaaagtgaaaggaaaggaaaagtctccccacccttgtttttttttcaaaaggtatagagtgcccgaaatactttagggatggcagctgttgagcatggaaacaagacttgtccctagagggaaggcaaggaaggcatggggaagagccttcctaactccacttagtgtaaaatcactctgtcctcttcccctgacctgagctggcttattccttggaagagataaagatctgggagtcaaaatgaccaccctgtgctgagcaggcttctttgaactccagctaaacggtaacagcacctaagataggatgttcccaccctcactccccacctcaaagtggaggtgaagagggagataagggaaagggagagaaaggtcccaggaaaggtctgctgtcaagagggaggacccgcagctggctgggagcattcacaggaagtaccaattttcacctccttttttccacagagctgttgcttatttgcctacgacggctgtgttcctcttgaggctgtaatgggcagactagctcagtgggtaacagtgtgagctttggatcccagccttgccacttactcccgcgtgaacttgtgtacaccacataacccatctgagcctcatcttcctcatctgttttgagggtaagaatggtgcctacctcatctacttgcagcaaagactaaattcgtttagtgcaaatgcagagccaggcccataataagtactgtcaataatgctaagatgccatgtttattgttcttgaagcatcacttcagaatctgtgcacagcatggaaggcctgattagaaccataaaaaccagtccaaggccgggcgcggcgactcacgcctgtaatcccagcactttgggaggccgaggtgggtggatcacttgaggccaggagttccagaccagcctggccaacacgacgaaaccccgtctctaataaaaattaaaaaattagctgggcatggtggcgcgcgcccgtagtcccagctactcaataggctgaggcatgataatcacttgaaccaaggaggcagaggttacagtgagccgagattgcaccactccagcctgggcgacagagtgaaactctatttaaaaaaaaaaaaaagccagtccagatgtgtttccatgtttcctatgattactataaacacacaaatgagctgggctcacagaacctcaatagaccttggatatgtatagctaatgatgagcagcgacaggaatcgagagttcgtacagaattttttggtttggttagcgtaacaacaggctttacagacaggctccatgtgcaagcactgcacacctctgtatgttctcagccttctgagaactgtcactgccaaatcttttccttcaccctccccaccctatctcacccccaggcaaggtgacactttcaaagttggcacggcaggcagcacatgccaggcctgtgacccaggcctcagcagctctgctcacttgcatggcaattgctttctacagtcaggcccagctgcactttgggtctccccaacccccacccccaatcaccacacaggaactggctgtttctcttttcttcgtccaagctgaatactaacctactgtggtttgcttgcttcccccattgtgatcgcaggctttctgagcagctagtcaaccctctagcctgccactgaatcggaaggcattcacactggaggggatcaaggggagcttgtaggcttgccttgctggcgggcagctgcctacacccactcgtaccaatgtccccgctgcagagcccgggtgcttcccagctgtacaaggacaactatttgggtcccggctatgccaagagaaacatgggtcatgtggttcacaggacagaaaggttcatttactccaatatgactggcatttttttttgtttgattattggatatttgccaaaagactgaagcctcctgccacaaccacctcccccacatatatgtcctcagatggtttgggaattggacagcttagtcatcaggtcctgtcctccacatccacagaagatacaagttgtttccagataacatgcagaaggttctgagctccttcctgtgtgctccagctcgaagactcttttcttttccctatgaattttttttccttttctttctctggtctttcctttttaatgcccttttaaaattaagtattctatcttttgagtgggtaacacatacacatgatacaaaatccaaaaggtgcaacgagtatatgctgaaaagtaaacctctctaacctttgtccttagccattcagctctcctgtgagtcagtactgttgttagcagtttacctgtatctttccaaagatggtctatgcaaagatccacataaacttgtacatttatgttctgtttttaggtcagcagcagcacactacatacactcttctgtgccctgttttttttccacctgaaaatgtatctcggctgggcacggtggctcacgcctgcaatcccagcactttgggaggccgaggcaggtggatcacttgaggtcaggagttcaagaccagtctggccaacatggtgaaaccctgtctctactaaaaatatgaaaattagctgagcgtggtggtgggcacctgtaattctagctactcaggaggctgaggcggaggaatcacttgaacctgggaggcagaggttgcagtgagccgagatcacaccattgcactccagcctgggtgataagagtgaaactgtctcaaaaaaaaaaatgtatcttggaaatgataccacatcaatccagataaagctgccacatatttttcatttatgacatagtattcaacggtatgatatactatttatttaactagtccctgattggtggacatttagattatttccagtcttctgctagtactaacaatgctgtaacaaatctccttgttacatacatttttcacgcacatgcaaatagatctgtaggataaaaaggggtccccaacccctggtccgtggcctgttaggaacctggctgggccacacagcgtgaagtgagtggccagcgagtgagcattatggcctgagccccgcctcctgtcagatcagcggcggcattagattctcatagcagtgcaaaccctattgtgagctgtgcgtgcaagggacctgggttgcacactccttatgagaatctaatgcctgatgatctgagatggaacagtttcatcccaaaaccattccccccaaccccttgtccgtggaaaaatggtcctcggcaaaaccagtccctggtgccaaaaaggttagggactgctgggctaaattcctagaatttttgctttggtcaaagggcatatgtgtcttacatcttttttttttttttttgagatggagtcgccaggctgaagtgcagtggcgcaatttcagctcactgcaacctccacctcctaggttcaagcgattctcctgcctcaccctcccgagtagctgggagtacaggcacacgccaccatgcccagctaatttttgtattttcagtagagacagggtttcaccatgttggccaggatggtctccatctcctgacctcatgatccgcctgcctcggcctcccaaagtgctgggattacaggcgtgagctgccgtgcccagctgtgttttacatctttataaatattgttcagttatttcagtactcatggaaagactgaacaaccaaaacgttgcctctgttggaagacctctgaggaatttatcacaggaataatcaagtgctttgcttttaagtctttgttctttatttgtatctactgcaagtttgttatttctttccttcaatatgtattaaacacctcgacctctaccatgcaccaggtaagctttgaggccaaaaccataaacacaacaaatgtggttgctgcccccacagtatttacagtctaggagatggagcagttgggggcaggagtacacatgaacgaaataattatacactgagtcattacaaactgtgttaagtgccatgaaggagaagcacagggtgactgaaagtgttcagtaggctcctgacttcgtgtggaggtctcagaagatttccctggggaaatgatgtttattctgatcaataagacagacttagtgaggccgaggaaatggcaggtttgaagtcctagaggaaggcaggagcaaggattctggccagcagcatggattacaggatctggaaagggtcttcaaggacattttgtttcagtctcctcatttgacatgtgagaaaactaaagtttagggagctaaatgacttgaccagggttatacagatagtaacaaagtcaggctgcagaatccagtgtgctcatcctgggagctgtgggtctgaactagacagctatgggatagttgcctgggtttgtgtagaaggacttaagttcaggttcttgtgacaagctgcgtgacatgtttcatttctctttactagtaagatacagtttggatgaatggccattccaatctagcgggttggtttgttcttcagcatacttgtctttcttacaagtttaaataataataacaatggtggttaattctttagcgcttgctctatgtcaaatacagttctaagcaacttacatgtattaaatcatttcattttgacagcagttcttaaagttggtgttattattattaccccattttacagatgaggaaattgaagctccagaaggtaaaggcacttgccaaccatcacagagctagtgagtggcaaagcagggggaccgagtccaaacagtctggcttcagggcccatgtgctttgtctcccaggcactctcagtgtcagcagcaggctgatggactcaggtttgagcccagagctgccttgtgccatggaaggtccaatcagtggctctcaaccctggctgcacatcagaatcagctggggagcttgtaaaaagtgctaatgtccaggcctcgcccccgttcagttaaattgcaatctctaggggtggatcccagtcactgagggtttttaaaagcttccgtggtcagcctaatgcagctaacggttgagatgtactgggatctaggcttgccattgctttgccctttgggagcaaccagcaccccatacttgcctttgtgttctggacacccacttagtaggacacttgtagaggcacttattcataccacagcacaggctcctgtctcagcctaaagaactcattcagtgtacatgctttggcagccacatccaccagtgatgtgcggtaacaagtctgtaaagggctaagagaatattttcagtcctgagcgtcagaagacagtggagcttagtggagtggagcttggctctgagtcaaacagacccagattcaagttgatgctttgtgtcatggtctgtgattttagagactggcgtttatcctctcaccaactccattttgtcatccatataatcaagctaatacgataatactacctctttcatgaggcttttgtgaggattaaatgagatagtatatagaaagcaatcagtgggccaggcgcagtggctcatgcctgtaatcccagcactttgggaggccgaggtaggcagatcacctgtggtcaggagtccaagaccagcctggccaacatggtgaaaccccatctctactaagaaaaattagccaggcttggtggcagtcacctgtaatcccagctactcaagaggctgaggcaggagaatcgcttgaacctgggaggtggaggttgcagtaagccaagatcgtgccactgcacttcagcccggaagacagtgagactgtgtctccaacagaaaaaaaaaaaagaaaagaaaagaaagaggaaaaaaaagaaagaaagaagaaaaagaaagcactcagtgctaggccatgtctttatttcatgactatccacgtagcttatgtgagtaaacagctatatttgggaaaagctactagtgacactgatattgacaggaatttgatttgacatttaataagtgcctggtatgtacaatgaagagtgaaagatcctgaagagcttggatgactaggaaggccccgtgcctgctgactggcttgctggctgggagggagcataaagacacccagataactcatataaggtagagtgtgccgcagcagaggtctaaacgagaagctaagggaggccaggggcggtggctcatgcttgtaattccagcgctttgggaggctgaggcaggtggatcacttgaggttaggagttcgagaccagcctggccaacatggtgaaatcccatctctactaaaaatacaaaacagctggacatggtggcaggcacctatagtcccagctacttgggaggctgaggcaggagaatcacttgaacccgggaatggggaggttgtagtgagccgagatcgctccaaaaaaaaaaaaagctaagggagcacaagatatggagagagaaagccccaattcaaacagaagctggaaaacaattataaaataaccaaggaaatatgaatactaactgaactcaatatgtgatgatattaaggaattataaatttttaggtgtgataacggtattatacatatatttttgaggagcaattatagtttagataaacataattctaattaataatatgtaagtcagatgaattgaaatgatgtctcgtgggggtagagatgaaagaagattggccacgtatagctaattgttgaagttgggtgatggaactttgtgttcattttactggcctctctacttttatatatggttgagatttttcacaataaaaagttttaaaaagagggccgggcacagtggctcatgcctataatgccagcactttgggaggccaaggcaggcagatcacttgaggccaggatttcgagaccagcctggccaacatcgtgaaaccctgtctctactaaaaatacaaaaattagctgggcgtggtggcacacacctctaatcccagctacttggaggctggggcaggagaatcacttgaacctgggagacagaggttgcagtaagccaagatcgtgccactgcactccagcctcagtgacagagcgagattccataaaaaaaaaaaaaaaaaaaaactttttaaaagaggtaaagttgtggccaggtacagtggctcacgcctgtaatcccagcactttgggaggctgaggcaggtggatcacaaggtcaagagttcaaaaccagcctggccaagatggtgaatccccatctctactaaaaatacaaaaaaaatagccggttgtctgtaatcccagctactcgggaggctgaggcagagaattgtttgaacccgggaggcagaggttgcagtgagccgagattgcaccactgcactccagcctgggcaacagagcgaaactccgtctcaaaaaataaaaataaaagagagaggtaaagttgaagaaaaggaaggaaacaagcagtacacaattgtggaatctggaaaattttcaggatgaggtggcatctgacttgggcatgggtgactagggagagttgatgtcgcagtttaaatctgaagggagtctgctggcagaatctcctcttccttgaggggcttcagtcttttttcttttaaggccctcactgattggaggaggcccactcacattatggacaggaatttgttttactcaaagtctactgatttaaatgtcaaactcatcttaaacatgcctttacagcaacatctagactagtgtttttcccaaatagctgggtactgtggcctaaccaagttgacatatgaaattaatcatcacagggtggcagtgggaaatgatactaggaaaaccggtaggggccaaattgtaaagggttttgaattctgttaaaattgtctttagtaaacttctttggaaaatttttcttctcaaaatgttttcgttagaaaattgggaattgttgaaggcttctgagcaaagcaatggtaacatctgatgagtttggaagggtacttggctgcaatgtggaggatgagttggagagggcagagactgaaggtcaaatgatgggtaaggaaactgacccttgcttaagagagatgatgtgaggtactgggagtagagctgaaaagtatccaaagcatagaatataatgcaggtagcagcaagagatcaggctgagcagtaggcagaggccaggtcatggagcacctggtaagccagattaaagagcctggagtttatcctgatgataatgggggacccactgaagagttgaagtcaagggagtaacctgattaaatcgctctgactgctagatggggaataagggcaggtagaccagctagtaacagttgtagtagtgtgggcaaaagatgatggtggcttggactagggtgagagtggaaagaaagaaaagtaaacaaatttgggacatgtttggagccactggaacttggttagtgatggattagatcagagaaaggtgagagacagagaaaacttaaaggtgactcaggttttgggcctgagcaagtaggttgatgacagtgccatttgctgacatgaggaaaactagaggacagtcaggattggagtggagcaaaatcaagagttctgattaggacatataaagtttcagatgttcagtagacttctgagtagcaatgtcaagtagctagttgattacatgatcctgtggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgttaaaaaaaaaaaaaaattttgagacagagtccgctgcgacgtccaggttggagtggaatggcgtgatctcggctcacttcttcctgggttcaagccatctctgcttcctgggttcaagccattctcgtgcttcagcctcccgagtagctgggactacaggcatgcgccaccacgcctggctaatttttgtatttttagtagaaatggggtttcaccatattggccaggctggtctcaaactcccaacctcaagttatctgcccacctcggcctcccaaaatgctgggattacaggcgtgagccactgcacccaacttaaaaaatatttttttaaaaaaagaaaaaaatcggtgggcagagcagatcatataggaccttgtagcctacgagcatgctggaaccacttcctactggctcaggagaactgactgttaaatttcaggaaatttgggagctggtcgacttcgcatttggcagcctgaaatcagccatagtgggagtactgatgctgttgaaattggtaaatgctacaattcagcccttttttattttcccccagagaaccagttgttaaactttgccaccatattagtactatggcttgtaggctccagtaagaaatttagattttattcttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcataattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagcatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccacatttcttggaggctttgctcatttctttttattcttttttctctaaacttcccttctcgcttcatttcattcatttcatcttccattggtgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagactgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtcgtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccgctttgttttctttttcatctcagtttttgaggataagaatgctttgttttaaaagggatcatctgtgtctttttaaaagcttactgaattttcctggtgtgaattatttgcacgtactcatttttgtggttgatttggattttacagtgattaagattttacagtacctgctccaccgggcccagatcctgcttcccagatcttcctgggaagcaccaagaaatttagattttattctaagtgtgatgtaaagtcattaaaatgttttaagcaggtgagtaaaaggatctgatttttaaaaatcactgtacgtggccaggcgcagtggctcacgcctgtaatcccagcactttgggaggccgaggcaggtggatcacatgaagtcaggagttcaagaccagctgggcaacatggtgaaaccccgtctgtactaacatacaaaaaaattagccaggcctggtggtgcacacctgtaatcccagctactcaggaagctgaggcaggagaatcgcttgaacccgggagacggaggttgcaatgagccgagattgcgccgctgcactccagcctgggtgacagagcgagactccatctcaaaaaataataataataatacatcactgtacaagaatggactcccagtgggagaaggcaagatcgctaaggaaactgctgcaacaatccacatgcgcagtggtgccttggcagtgcaggtaagagttcagtcaagaaatttggaagattgttaacatcctaagactggatatagatggaccttgatttatcacaagttgattataattgacctgttatgtaattcgtgttacttagtgtctttttgttttagttgtggggagcaccagattacagaatgattaccttgactcatgacccagggctctttacaattcttaccagaaactggcagatgataaatcagtcatcttatttggtagcaaaataaggaggttactttcctgcatgaacataaatttcctcttttcaatatttcagtcttacattagcaggaggaacttgaagtcttgtgattaggcagattctttgtaagggaaaaggcagcttactatccttttggtaacagttctttactgatagggtaagaaggaaaggaggttgagtccgaacaatgctaaaggaaacactttaaagtaagacatccactgaagacccctagccattttgcctactgtaaaatagaaccatctacaatgtcttgtgaagagagaaatgaaatgaattttgatatttgttttctgcaaagattctacattacattgtgtaagtcttgacccacgatttttataactcatgcataaaattatgtgcaaatgctttaaaaattccagcccactcttatactgagcattttatgtactcattcagcaaaccattcattgagcaccagtcatgtgtcagctgctgcttaaggcactagagatacgaaaattaaaaagacccagtcctcacagagttcacagaacactaggaaaaatagacatgtaaattggacatgattacagtacaattgtgaaagaggtctctttgaaagagttgtctgtatttatttaccatctccagtctttcttttcccattctctctctttttttttttttttttttttgagacagaatctcactctgtcacccaggctggagtgcagtggcacaatcttggctcactgcaacctccacctcccaggttcaagcgattctcatgcctcagcctcccgagtggccgggattacaggcatctgccaccatgcccggctaatttttgtatttttagcagagacagggttttgccatgttggcaaggctggtttcgaactcctgacctcaggtgatctacttcccttggcttcccaaagtgctagaattaacaggtgtgagccaccgcgcccagcccccattctctattctctctctctctctcttttttttttttttttttgagacagagtcttactctgttgcccaggctggagtgcagtggcacaatctcagctcactgcaacctccgcctcccgggttcaagcaattctcctgcctcagcctcccaagtagctgggattacaaccaggctgggagattcagcttgtccatttcatgttctgtttctcacaatcatctgtgtttgcttgtcactgcactttaaagagaaggcataactcaaaagtttcacccttcaacttgatggagaattattttttatttatttatttatttatttatttatttttatttttttgaaacagggtttttctctgttgcccaggctggattgccgtggtgcaatctcggctcactgcagcctcaacttcctgggctcggtcgatcctcctgcctcaggatctactccctcctgagtagctgggactacaggtacatgccatcatgcccggctaatttttttttcttttgtagagatgaggtttcgtcatgttgcccaggctggtcttggactcctgggatcaagcgatctgccagcctcagcctcccaaagtgctggaattacaggcatgagccactgcacccagccattctatatttttaaagcatagaatattgattctttgagctggattaatgaggaaagatataacaatcattaatataaaataaagaattgtgaaacctcattaatttgcatgccactaacctaaaattgtaataacccagggcttagtaagcaaattagtcatataaacagcataactatagggatatttaaactgtttaccaaaagaagctgcttttaaagcctgctgaagtacttatttattactaataatgtctaatattattgacacttataatgttgctggcactcttcattgtcttatttaatttccatagcaactctaagagctaggtattatcactcccatttttgaaataaagaaattgaggccaggcgcagtggctcatgcctgtaatcccagcactttgggaggccgaggtgggtggatcacgaggtcgagagatcgagatcaccctgaccaacatggtgaaaccccatctctactaaaaatacaaaaaaagccaggcatggtggcaggcacctgtaatcccagctacttgggaggctgaggcaggagaatcacttgaacccaggaggcggaagttgcagtgagccaagatcgtggcattgcactccagcctgggcaaaaagagtgaaactgtgtctcaaaaaaaaaaaaaaaagaagaaattgaagctcagagaagttaaggaactcactgggtgcagtggctcacgcctgtaatcccagcactttggcaggccgaggtgggtggctcacttgaggtcaggagtttgagaccagcctggccaacatggcaaaaccctgtctctacgaaaaatacaaaaattagccaggcgatgtggcacgtgcctgtaatcccagctactcaggaggttgaggcacaagaatcgcttgaaactgggaggcagaggttgcagtgagccaagatcatgccactgcactgcagcagcctgggtgacagagtaagaccctgtctccaaaaaaaaaaaaaaaaaaaaaaaaaaaggaacttgcttaagatcaaaaatagctaatgagtagaagagacaagggttccaatccaggtctgtgtgatgctgaagcccacaggcagaagattcgcactctacctaggcttccacagatcactcaaccatgcatgaaagtaaggcctgaaaagtgtctctactaggttgcccttcattaatctagttccagtcatgtataataaaatggagtgtctttccaaaatttcataatttagatttcactcatttaggccgacttcccccctatacatacccactagttggaattagttgccttttactatatgctgtattgaatgtccttatagttgggggtcatgagaaaagctaaagtctaacttggacaagatgacgactggcattgccagggttgtgcagcaacagtagtggggtggggtgtcctgcaaggacatgagttaggtggctgttaggggcagcataagttgtagtgtaaagccttggagcctagatgccaaggtcgcagagtcaccaggaggcaggatcctggagtacagattgcagtggcccagtaggcacagcatctggcctctaggtctgcctctgctatgcaccagctgggggctttggttaagttgctctgcttctccaggtcataggtttttgtttgtgaaacgaataattggaagggaagatcttagggtccatttcagattggggtctctggtttagggatctgcgttatcagagtctaaagtaatcaagtccttggagatctagtaatcagaaggagagcaagaaagagccagctttcattgtcaggggcaacaaagaggtggctcatgcccataatcccagcactttgggaggccgaggcaggaggatcacctgaggtcaagagtttgaggccagcctggccaacatggtgaaaccccacctctactaaaagtacaaaaattagctgggtgtggtggcatgcacctgcaatcccagctactcgggaggctgaggcaggagaattgcttgaatctgggaggcagaggttgcagtgagccgagatcaaccactgctctctagcctgagtgacagagtgggactccatctcaaaaaaaaaaaaaaaaaaaaaaaaaaagaaagtccagaaagcctggtttgaatcagtaaaatcgagttttcacactgcttcactgattgtaattcattcttctacagatttttaaggagggtggaagagagaaaagctaagtaaaatgtggtcctagccatcacaggtctcatagtatcctgagggaaagagacaggaaacaactaactggaatataaaacagaataaaatgtgttcattacctgctgtatgaccttggtcaaatcacttaacctgtccctgagcctcagtttcctcaactttaacagacacataagcagtcaataaatgtcagcagctatgcatcagtagtggcaatagtaatatggactacatgtgtaatattttgtactatgccattacatcttagtaaaatagaaccatctacaatgtcttgtgaagagagaaatgaaatgaattttgatatttgttttctgcaaagattctacattacattgtataagtcttgacctaccgtttttataactcatgcataaaattatgtgaaaatgctttaaaaattccagcccactcttatactgggcattttatgtactcattcagcaagccattcattgagcaccagtcatgtgtcagctgctgcttaaggcactagagatacagaaattaaaaagacccagtcctcagagttcacagaacactaggaaaaacagacatgtaaattggacatgattacagtacaattgtgaaagaggcctctttgaaagagttgtctatattcaccatctccaatctttctcttcccattctctttttttttgagacagagtctcactctgttgcccaggctggagtgcagtggcgtgatctcagctcactgcaacctccacctcccgggttcaagtgattctcatgactcagcttcctgagtagctgggattacaggcacccaccaccatgcccagctcatttttgtatttttagcagagacagggttttgccatgttggccaggctggtctctaactcctgacctcaggtgatccacttgccttggcctcccaaagtgctagaattacaggcgtgagccaccatgcccagcccgattctctcttgagtccattccagtcagacttttgctccaccatccaataaacttctcttttattttttgagacatggactcactctatcgcccaggctggagtacagtggcacaatcatggttcactgcagcctcaacctcatgggctcaagcaaccctcccacctcagcccccccaagtaactgggactacaggtgtgcaccaccacacccagctaatttttatattttttgcagagataggggtcccactgtgttgcccaggctggtcttgaactcctgggctcaagcaatcctccccctatggcctcccaaagtgctgggattgcacatgtgagccactgcacccagccaaaacttctctttttatgataaccagtgacctccatgtgtttagatccaatggtcacttctcagtcttcatcttactgggccctcagcagctcaccactcctccttgacataccaccttcacttggcttcctggacaccacactttccttttccttcttcaccaactgctccttctcagtcttctttgtggggtctaatgtggaagtatccccaggctcaagccctaagtgatctcatctggtctcctggctttaaataccacccatgtactgatcactccctaattatgtctccggccctgacctctcccctgaactccagactcatgtagccaactctccatctccatttgaatggctaacaagcattgcgcagttgaactcctgatgttttcacccaccctcaaaaaacaaaaacaaaaagccaacctgcttctcccatagcgtcctccatctcagttcatggcacttctgtctatcccgtcacttaggccagaaactttagagccatccttgactctcctctcacaccctcatccagtccatcagccaatcctgttgactctaccttcagaatatatcgagtctgatcactgctcaccactccaccactagcatcccagtccaagctaccgtcatctcttgcctaaattactctagtaatctcctaaccagtctccatcctacttttccctccattcttgagtctttttcaacacagcagccagtgatcatgtgaaaatataaattaggtcatgccattcttctattcataaccccccccagtgaccagtcttctcagtaaaagccaaaattcttactgtgtgccctaccagccttatacaacctagccaccatttacttttgtgaagtcatatcccattactctctattttgttcattccattaccaccacattggcctcctcattgcctctgtaacaccccggacatgctcctgtcccagggcctttgaagatatctgtacaacttgcttcctcacttccttcagatctccaaaaagccatcttcttggtgaggtcttctctgattaccctaataaaaacttcagcatcctccagacactccttatgttccccctgcttttattttatccagagcactcacctcctcttagtatttggtgtaatttacttatttattttctttctttgtcttgtcttcccctgcaattagactttcagctttataggaacagggacttttgtctgtttggttcactaatgtatcctgagtgtcgggcatatagtaagtatcaataaatatgcaaataaatgaatagtctttagaggagataatgggagtataaaaaagagctaaggagtgcagtcagtatgattggggtgagtgatgcttttcatgttggaaaagttgtcatgaagggccttacatgtcattctaaggagcttagattttatcctataggcggtaaaatgtcagtaaagtagtcagtggtctgaattggaattttagaaatgcgttctggctgtagtataaagaatgaggccgggcacggtggctcatacctgtaatctcagcactttgggaggccgaggcaggtggatcacctgaggtcaggagttcaagaccagcctgcccaacacagggaaaccccatctctactaaaaatacaaaaattaggcaggtgcgatggcatgcacctgtaatcccagctacttgggaggctgaggcaggagaattgcttgaacccaggaggcagaggttgcagtgagccgagatcgtgtgactgcactccaacctgagcaacagagcgagactctgtctcaaaaaaaaaaaaaaaagaagaagaatgaattggaggctgggtgtaatggcttatacctgtaatcctagcactatgggaggccaaggtgggaggatcacgtgagcccagaaattcaagaccagcctgggcaacatagggaaaccctgtctctacaaaaaatacaaaaattagcagggcatggtggcacatgccagtagtcccagctaccagggaggctaaggtgggaggatcacctgagcccaggaggttgaggctgcagtgagccgttattgcaccattgcactccagcctgggtaacagagcgagactctgtctcaaaaaaagaaagaaaagaaaagaaaagaaaagaattgaaaaggacaagagtgggtccaagaggccagtaacagactgctacagtaatgcacacatgagatggtggtagcctgaattatgggagtgccagtggggatggaaaggaggattgcttggatagggcagtaagggtgggcgaaatgaaggaattccaggtttctggcttggggtagcttgttaaagacttgggccattcatcactgagataagaaatacagaagaaagaataaatctgacactgtcaagaagaaaggcaacgatagattctaggtgtgtcgagttttgagtacttgtgtactatccaggtagagctgcccagtaggcagttaggtgcttggttttggaggtcagtgggaggtcagagccaaagataaagatttgggagccatctgcctgtaggaggtgtttaaagcaaaagctatggtagaatttcctagaaaaggtatataaattgaggaggaccaaaagagttcctggttatcagtgccaaatattgccccctaagaaatccagtaataatatagccaaaaagagccactggatttggaaaccaggaggtcgacaatggaatacatttcatttattcaaatgtttattaaatatctactatgtgttaagaatactaaggatacagaagtcaataaaacagatcaaaaaatccctccttacatgtagctgaaattctagttgcagagaaggagcagataaataaaggaaataaataagtaaattattccaaatattaaaaggcagtgaatgctctgaaggttagataagctgcctagggtcacagggccaagtaagtgaagaaactaggactagaaacgaacctgctcaactccagagttgtgctcttcttactgttgtaccacacctcctctcccacatcgataatcttggttccattgccacagaatgccatatagccccaactaaacatttcagaaacaaaccaaagtatgtgtatagcttaatctaaactcaacaccatttctgaaagccagctctgaggggacatccccttcacagtggacaggtagtaccagttttatatgtagatggtatattgaaaagtcatttcatctgatcgtaaaattatttttctaagaggatggctgggtgcagtggctcacgcctgtaatcctagcactttgggaggccaaggcaggtggatcacttgaggccaggagtttcagaccagcctggccaacatcgtgaaaccccatctctactaaaaatataaaaattagccaggtgtggtggtgtgcacctgtagtcctagatactcaggaggctgtgacaggagaatcgcttgaacccgggaggtggaggctgcagtgagccgagatcatgccactgcacaccagcctgggcaacagagtgtgagactctgtcgcaaaaaaaataataatattaaaggagaaaacgttcctttcagagatggagcattttggtaataatagggttccgtcaggatggctctgaaggtggtgatgatgtccacggggtggccaaaatggtataaaggtgaggatcactgaagccgaaggccagaaactggtcatgggctgggtcgtctttatagatgccaaagttacctaagatgacggcgaggctaggagagggtgagccaccaggtatcacagtcttcaatgaacgtggaagagtggccagattagtagataatagcaggccaaggagtatggttcagtgacatcagccccagctaagtgcttctgtcgtgagagtgaaggaggaagggtttgggaacagcaacagagagcgagaagaatgccaccatcacaatgctccctaccctgtcacatctgtgaggtggagaaatgaacagcctccgcttgggagcttcacaggggaaggaccagtaaagacaaggaaacagaatactttaaaaaggctaagggcatgggattatgtttatcatgtccagaaggcacaggttgggagggaatgtaagtatgaaattgaatctgtcccaaatgtctgcttccttccaggcaaaataaacgacaaatatatggacagggtatcatgattgtattgcacgttaatatctgttctaagcccacagaacaagaagaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtcatgcccttcaatcactgtcattcctctcccaacccacactgagccagctttccttttgccatctttcctgattccaaaaagagttaccatttgtattgccaccgccattatctcactttacaagataatttaccctgatccaagttgactgcagacacattgatgttttctttttaagaacttaacttgattttcatttttggttttaacagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaattttttggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacactcatacatagagagagattttcggtatgttgcaagtattttttccgattaaatttattttccaaagaaaaaa

SEQ ID NO: 4965 - DNA, 55064 bp, human
tggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaagtaagagccgggcggggccggggaaccgggagaccggacgggggtggggtgggggagccgcggcccgacgccgccctgctgcctggactcggggccctggagtagggacggcccccttgtcgatcacctggggacccctcggggcggtgggccacctctatggcccccagagtgcagccccaatgcttttcacgttctcttggggttaccgccctgcaagatgcagttttgtggtccgcagccctggtccgagaggctttccggattggaccgggcgaggaggtggaatgcagcaaaggatttggaggaaaggaatgaaaagctctccagagagatgagtcctaaccatttccaccgtcctccaatttggaaacttttgcttaggctggcttaggaagagagagacccttttaaaggtgtttttgtctgtgtgacccaagccccgagaagaaagtgcttggtgtggggaaaggacccgatccatcgatacgaaaaggccgcagatttttgcccacacatctccccaacttaaatgaagcttgacttcaggctccgacagaggctgcagcttcccctccccaagctgagaacggccccctcagcctaccgcttcaccccactggcctcatttatttgggccttttccaccttctcccacatcaacagctgctccttaggaaaagatctaaaggtgtaaatgcagccttaaagcttccaccgagctcagaggtacctgcatttgaactggaaaccaagcctgaaagaatgaattggtagtgatggcatttcaggaagcagagatgtttctgtattggggggacggtccctgtgttcctcattcagtgggcacagtggcatctttgatatcgccttggctctgaattagacaaacagcccacatttgggagagtcggtcttgaccgcatagtttagtcttggcggctaatagtcaaaggattttgccttgacactgtcactcacctgggaggccagaggtggaaggctcacctggcagccgacaagccgaacggaatcatccttattacctaggcctctaggccagtactcattttgcctctgcctggaaatagagttcccttctcttcctctgcagagggactcatgggtgggaccatgacatttagttaaggccctttttcctccccacctctgcttgccctcatcaacatctggcctgcagtctgtaaacagttctcctctgagtcttaatgactcagtttctcccccacttcaccctcttctctacaaagtagtgtggaaatcttcctttggatgggataaaatatgtccagaggggtggggggcagaacttcaaaggctggtttaagtattgtggctcttctgctaagcacctagtatatgcacattagattttttaagctcctgcctcctgccctgtaaggtccataggacaggaagcattgtgcctgttttacagatgcagaattgggctcagagtgatgacacctcttgtcagtgaccgagctgagctccactacctggccttctgactccaaatctcatagtctttctgttacatcatgctgcctccctgcatccatttgacactaatttagtcaggctacattaagtccccactgtgtgcacgatgctgaggacaatgccaggatggaaggggcatggtccctgtgccccaggagcttacagagtaatagaagagtaagactaatatgtccatgaccataacacacaaggtagcatgtgattgtcatggataatgtgctctagaaatgtacccttctgatgagcgatgaggaggagaaaatgtgaagacttcatagaggagaaaaaaatttgagtttggcattgggagaatgaggagtctgctgggcagagatggagagaaagatactgcagttgatgtcagcaaatgcacagaggtgggaaggcaagcagcacaacaggaagtccaaccagaaaagcaggttggaatgagatattagagggttggattaagggatttggacttgacttggtatccaagggtagctgtgggaggtttttgtggggggtggggggaggtgtgttgtgattaaagcaattcaatggaaatgatcgtcacatcgtggcagagtaagatgactagagaggaggaagagtggagacagcagggccagttaggaacctgttgcactagtccacatagcagctgagggcaccggcaataggtgaccatgggagcagagaggaggagatgtctgggagaacgagaacagagacttacctgggctaggtttgctaggaattttttttcccctacaggattattttctttctgaaaactaaaaggaagtattttggtgaatggcaaggcatagttggaaagcaaagtgtttgattaatcgcgatgccatccttcctacatcaacatgatactcttgattcatcattatactgattcatttctactcttttctgaccatgaatttgcaaaacagttggctgggggcctgtgatcatgggtttgaacaaaacataaacatccagaatgttcagggaatggggtagttaagtgacttgtccacaaatgcaattaatggaagagctggaacttgaagccaagtcttctggctccttagttcaggtctctgtctaccattgcacagcagaaatatctgcttagttggattgacgatcaagagtccactcagtagtctgttgggagctaggttattgtaatgggtggctttcagatgtatcaaatagaagacccccccgccctggaacttcacaaccgcttgtctatcttatctaataaacgttagtttgggtccctgcagctctgaaattgttcataaccaacactatttctttattgaataagcacttcatgagcttatgtttggctgcactggctgccaacctgttaggttgaagtattggcagttataattacacatatccagggtgtgtgttgtatctgtgctggctgaaaggaaggggttgctgcaattcaccagtgtatccagtctcactggaaaaagcttctgtgcatgtatgtgtgggggtgggaggaagaacagaaaagggaacagtgccgccctagcaaatcaaaagtttaagatgcatggactgagatgacatcattggcggattatcagggttgcctgccctgactctgagattctaaggggaacaattgataggacttatctctgtatcagatgggagaagtctgcgaaaaaaggacttcctatggttcttctttttaattgtgtatatttgatattgagactctataaaagaaactgatataaaatacggctcctcttcctagttcatcaagtcattcagtgaattaagggcctgtttcctctccgcttgcccctaccagtcatttccttgtcagaagtgttgaactcccttaggctctatgctgaggactaacacagggtctgatacattgtagaccttcaataaatgagtagtgaattaactatgccctagaagtgaccaagtgggatggggaataagagtgggacaaggagaatgaatggtatttctttgggcatttcaaactccaccttctaggtggttccagcttgctgcagaccgcccctccagtcaaaaatttctttttttttttttggaagaagtattgctctgtcgcccaagttggagtgcagtgacgcaatctcggctcactgcaacctccacctcccgggttcaagcgattctcctgcctcagccttccgagtagctgggattacaggtgcacgccaccatgcctggctaatttttgtattttcagtagagacggggtttcactatgttgaccaggctggtctcgaattcctgacctcgtgatccacctgccttggccttccaaagtgctgggattacaggcgtgagccaccacgcccagccccagtcaaaaatttctacttcctctgtttcccctgtcctttctgaggtccccctccaacttgactggccagggtatagaagagggaggaacgaggaagtgggcaggcaggcagtacaactgaggcagatagtctgttggtgaatgccacctgtttgagaaaaacctctgtcaaacttggtttttcctctgctctcacaccacaacaacaaccctcaacacagaagacttctgtgaccaaatgagtgtggggaaccccacactctgataaatggacaccaactaggtgtcctctgattcagttctgacactgtctacctggacataatgtcagaccaagccacaggttaagggcttggtccccaagaatggcccccaaccagacactagtcacaagtccaggcctccagaacttttttttttttttttttaagactgagtctcgctctgtgacccgggctggagtgcagtgcgtgatctcggctcactgcaacctctgcttcccggattcaaactattctgctgcctcagcctcctgagtaactgggattacaggcgcccgccaccatgcccagctaatttttgtaatttttttactaaagagaaggttttgccatgttggccaggctggtctcgaactcctgacctcaagtgatctgcctgcctcggcctcccaaagtgctgggattacaggcatgagacgccatgcctagccaggcctccagaacttctgaccaaccagcttcaagttggggttcccacgaccccctctttgggttcgattaatttgctagtgcggctcacagaactcagggaaatagttaatgtttaccagttaactacagaggataccacaaaggatacagagaagagatgggcagggtgaggtaaggggcagggggtgtggagcttccatgccctccctgggcacgccacccttcaggaacctccacatgttcagccatccagaaggttcccaaaccctgtcctctcgggtttttatggaagatttgttacagaggcatgattgacaaccatgtagaaatgtgactggatgaaaagcacatgatctaaacccagcaaggcctgtctgttcagacttttcttggcctctatgcagcgttcctttctctagggcagaggtgtccaatcttttggtttccctgggtcacactggaagaagaattgtcgggccacacataaaatacaataacactaacgatagctgatgagctaaaaaaaaaaaaattgcaaaaaaatctcataatgttttaagaaagtttgcaaattggtgttgggccacattcaaagccatcccgggccacatgcggcctgtgggctgtgggttggacaagtttgctctagggtatggggcaggaccctctctgggatgaggatcttttaacccacaatcagattagagtcctaccttgggcaggtaaaaggagggcaggagaaggtcaaagagagaaagattctgtttcctgagacctaaagtgccccaacattataacaaggactagggaagttaggagccaggaaccatgggtgaaaaccaatgtatgtatcatagcaccacatcacctttacttccctgtatgtttaaaagcagctgattaactcaaatgactgtttcagttaatgcggctaaggtaggttgacaaaatgaagtcaagactcctacagcttgaagatgtttttaatcagtgagtgtttacttgaaagcaaaagagctagcctagaaccccttaaatgctttcacctgaatgcccactcttatttctcatgcagcagcccctggcctatgggcaactgaaagaacaggaaatgcacctcctcactggaggtttgaaggctaaggaactggggatgctctcattttaaaaagataggccgggcacagtggctcacacctgtaatcccggcactttgagaggctgaggcgggcagatcacttgagcccaggagtttgagaccaggctagccaacatggcgaaaccctatctctacaaaaaaaaaaaaaaaaaaaaaaaaaatagccaggcatggtggcgcacatctgtagtttcagctactcaggaggctgaggtgggaggatctcttgagcctgggaggtggatgttgcagtgagcccagatcatgccactgtacttctgcgtgggcgatagagtggccaccgcacccggcccagaactgggcactttgggaggccgagcggggtggatcacctgaggtcaggagttcgagaccagtctggccaacatggtgaaactccgtctctactaaaactacaaaaattagctgggcatggtggcgtgcgcctgttgtcccggctacttgtgaggctgaggcatgagaattgcttgaacctggggaacggaagttgaagtgagccgagatcgtgccactgcactccagcctggccaacaaagtgagactctgcctcaaaaaaaaaaaaacgtaattactgagatgctcgaagttatcatttgaagaaattttgttcctttttaagtttcaacagaactgaaagactgcactccagttggtatttaccaggtacttctgtgcatttacaccccacaggcaagccagtgttgacaattatgtagataaaagtagaaaatgctttaagtgggaaggacttgggatagatgtaaattaagaaagttaggcatctcttatagccaactagcatcatataaatatagaaaaatgtaaatgtattattcatgaatgcttatatagtactatagtaacttttcactttgtaaagtactttgaaatgctggaaaatatttcaagaactagtggagagaactctagcacaatccatagttgatttctctggcctttccccctattttctcccagatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtaagatggaccttttcaccttgtccaagaaaaggctatgttctctgaaattacaaatgtattgtatacctttgtgagccactaaatcagttttactgagatcaaggttatatggattcaacctacatagaggcaattagcttcattctattccatagccatacactccactcctaaactttggccagttacatccccgggaggggagtagaccagaaagtggaggtgactcagcaaactggtaagaatgcaattctaaccactctccatctgactgcagaaggagtattcagtgtacatacacattgatatgccatgagggcaactagggtagcaactgtgtcttctggggtctttgtaacctttgccagagctacacatttatggcccaattgcaaaatccagtagactttttccctttatctgaacttggttgcagcatttgataaggttgaccaccccttcttctggaaacttggcttccaggacccctccaagtcctgggtgtcttcccatctctctggcagctctttcttatctgacttatccggcccatctgggtcgtctgatactgccagcccctacatgttgctcttcccctgggctccttccttagctttctttttaccctcccctttagcttgcttctcatcctccaaaccctccctaggtggcctcatctatgctagtggcttaagcaagcgtcagtgtattctgtgacccttattctctacctctttagtaacaatggccaacttttggggggaagtacttaccatgttctgggtactgggccaaatgcattgcatgcgctttctcatgaggccttattttacagatgaggagatagatgcttcaggaagctaagtgacttgcccaagtccacatagatagaaagcaggagaaactagcaatagaactccagagccctctgttagcccctgactgacaccaattcccaatggtagtatgagtccctgctgttggacaccttcacctccatgctccctaggcacatcaaattcaagattaaccctgatgtcctcgttggtctcaaactagctcttcctcctgtgttccctaatgaatgagactaccttcctttcaccccgtggcccaagccagaaaaaaaagcctagggatcacttcaacttctcctctcactccacccccacttgaatcaccaagtcccgtcgatttgactcatcctctttcccacaggtccttacaactcagactctcagggtctcccacagactctggctcctacctgcttccactcttggtatctcctgccccagtcttccccgtgcactgctgcccggctgaggtgatctctccacgtgcaatttcatcgtttcacggccctcatttcactgctctccttaaaaagtattcagcgactcctgagctacaggagaaagcccaaattccttaggacattctagatccttcagacctggcccctgccagtttgtcctacctcatctcctgccatacctccacctgcattcatgctccagcccttcagaaaaacttggatttcctggaaataccactccctttatacatgctattccctttgcctttccactctgtcaaagtctgatgaactcctatttattcctcaagacccagttcaaaagttctctctttcatcaagtccctcctgactcccccaggcaaaattaatccctttgatccttgtgtacctaatgcatttcatatagcccccctgttgtggcacacatcaggggtgttatactgactttgccctggctgtctgttctcctcgatgatgagcatctccagaaattagcccgctcctctttcgattcccagcacctgacatagggcctggcacataacctaagctttccagacattttctgaatgaaggtaaatggaaggttggtgagccaattaaataaacattacatttttctaaagataagcaatttcacttgtattatcccctattttaaatttcattttgagggagaaatttagtccctctgtaaactaaagatggctcctaaaggttctggaagtttgtgaaagtgccacctactatattacttactcaccatctcagttcttagaaaggtgaggaagccacacagtgtagggtgcccactgggccatgatatgaccatgtcattcccaaaggtgaagtcaggtgacctccctcaccatcgagagtctctcactttccagttttcataaaatgtttccttctcagctagagatcagtccctcctgtcctccaaaacataatgaggtgctgcccactggctttttttacttgagtgattttttccccgaacattaaaaaaaagcttcaaacatctagaaaaattaaaagaaatctagagtatacatccatggaccatctagatgctacaattaacattttgctattcatccctccagccattcatcagtccatttttattttatttatttatttatttatttatttatttatttattttttgagacagaatcttgctctgtcacccaggctggagtgcagtggtgcaatctcggctcactgcaacgtctgcctcccaggttcaagcgattctcgtgcctcagcctcccaagtagctgagattacaggcacgcacctccacgcccagttactttttgtatttttagtagagatggagtttccgttttagtagagatggagtttagtagagacgaggtcaggctggtctcgaacccctgacttcaagtgatccgcccacctcggcctcccaaagtgctgggattacaggcgtgagttactgtactcagccagcccaccttttttttttttttaatgatttcagtgtaacttgcaaatatcaatacacttcacccctaaacccttcaacatgtgtgtcattaactagagttcaatatttgtgtatggttcttttttttgagatggagtttctctcttgtcacccatgctggggtgccgtggtgcgatctcagctcactgcaacctctgcctcctgggttcaagtgattcttctgtctcagtctcccaagtagctgggattacaggtgcccaacgccacacccagttactttttgtatttttagtagagatggggtttcaccatgttggccaggctggtctcaaactcctgacctcaggtgatcctcccgccttggcctcccaaagtgctgggattacaggcatgagccaccacgcccagccgtatggttgttttttaaagtacaatttacatccagtaaagtggacaaacctttagtgaaccatttgatgcattttgacaaatgacacaacccctaccaaaatatagcacattatcgcactcaagaaagttccctcatgctccttgggttggagggattttagcaaccccagagcccctcctgttttctttccccggaatccccccaggaatttatgttctcaagccagtgttttcccaagacagcagcagcttctccctggccttgttttgcaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggtgaggagttatcagagtggggtagggggtggaatgctttgtagtgtttgtggtcgggtaataacagcaaagaacactgaccccaagtgatgccaggtttccaaggagcttctgactgctcataaatactgtgcaaacccccactctgtggcatttctgctgctaacctcagagctgttggcttgagccccggctgcctcctcattcccatcctctgttttttggtcttttaagaagcctccaggctaggggcggtgattcacgcctgtaatcccagcactttgggagggcggaggcgggtggatcacttgaggtcaggagtccaagaccagcctggccaacatggtgaaaccccgcctctactaaacaaacaaaaattagctgggcgtggtggcaggcgcctgtaatcccagccactcagaaggctgaggcaggaggatcacttgaacttgagaggcagaggttgcagtgagctgagatcgcgccattgcactccagcctgggtgacacagaaagactatgtctcaaaaaaaagaaagaaaaataagaaagaaagaaaaaaaagaagcctccagatgaggcttctcttttctttcctgacttcctgattatatcacttgtggctctccttcctccaagaccagcagagagtagaatatgaaatgcagcctgctaatgctccctgtccttgctgcctccacagcaaggatgccactcttggtttcctcactgtgccttacctcagtgaagcagactggataggaccaacataagctaggaactgtagctaacaagggtccagcatccctgactccctcgctgaggaaggaactgcatttaaaatgtggcagcatcaggccgggcacggtggctcatgcctgtaatcccagcactttgggaggccgaggtgggcggatcccctgaggtcgggagttcgagaccagcctgaccaacatggagaaaccctgtctctactaaaaatacaaaattagctggttgtggtggcacatgcctgtaatcccagctactcgagaggctaaggcaggagaatcacttgaacccgggaggcagaggttgcagtgagccaagattgcaccattgcactccagcctgggcaacaagagcaaaactctgtctcaaaaaaaaaaaaaaaaaatgaggcggcatcttagtgagaccactgaggcaaaatcctagaatcagaagttccaaagtgagtaattgtcttagcctagaataagccaattttgatcaaagaaaaatcagactagttcaaataaggttgggtgggtaacagttatatctgtacagtgggggcaggcccagaatcctagcagggctgaggtgctgtatcttctcttagccctgctcaggcccttaaaattcaaaaatagctaatgcatgctggacttaatacccaggtgatgggttgataggtgcagcaaaccaccatggcacatgttcacctacgtaacaaacctgcacatcctgcacgtgtaccacagaactaaaaataaaaatttttaaaaaaattccacttccataggctaggctgtctccatggcctcttctgggcaaaccctgatttatacaagcaatatattcctgaagaactctatagaaattaatttggggtcagctgaatccaagtttaaatgagcagtcccagccaagtttggttttcccctgtgactctaacttgtcctcgcttgctcaatgtccctccccgctcccgctttccctctgtagtagtcccggctgccctgggccatcgcttacctcagcactaaacagcctgaaggtgcttatcaaagctgccactccactccctgaaacttcatctgtctgggttgcattcctttcctgtccttgtccaaacagataattgtcgcatcattgtaatggtagtataggtgcaaaatttttctattcgttggtaagaagtctttatatattaaagatattaaccctttgtcatacatttcacacaatttttccagtttgacatttggtgttttttttttttttgagagacagagtctcactctgacacccaggctggagtgcagtggcacaatctcagctcactgcaacctcctcctcctgggtttaagcgattcttctgcctcagcttcccaagagctgggactacaggcatgtgccactacacccagctaatttttgtatttttggtagagatggggtttcactatatgttgaccaggctggtctcgaactcctgagctcaagagatccacccgcctcagcctcccaaagtgctgggattataggcatgagccactgggcccagccaacatttggcttctagtgctatttatgtgttgttggtggtggtgctttgttgtacatatttgtagaattttatctaattatatctattacttttttgtttgtttgtttctgactttgcttttctgcttaaatgtaaagtctgcttagtgcatgcttatcttttttttttaagtatttctaattttaaaaataatgcacatttggaaggccaagatgggaggatcacttgagcccagtagtttgagaccagccttagcaacatagcgagaccttgtctctactaaaaataaaaaattacctgggcatggtggtgtgtacctgtggtcccagctacttgggagactgaagcaggaggattacttgggcccaagaggtcgaggtcacagtgagctataatcctgccaccgcattccagcctgggtgacagagagagaccctgtctcaaagaaaaaaaaaagtaatgcacatatactttaaaatggttaaaatggttcattttatgtatatttgaccacaatgaaaaaaaagtaatacacataagttgtagaaaatttgggacatacagaaaagtgcaaaaaggaaaataaattacccatagcccaacacccatggattataatgattaatagttttccttctatggaccttcatatatatacataaacacactcacacacatataaagatatataaggttatttcttttacaaaattgtgttcacactgtatataaaaattagtatccttaggccgggcgcggtggctcacggctgtaatcccagcactttggggggccgaggcgggtggatcacctgaggtcaggagtttgagaccagcccggccaacatggcgaaaccccgtctctactaaaaaatacaaaaattagctggtcatggtggcacatgcctgtaatcccagctacttgggaggctgaggtaagagaatcccctgaacctgggagatggaggttgcggtgagccgagattgcaccactgcactccagcctgggcgacagagcgagactccatctcaaaaaaaaaaaaaaaaaattagtatccttttttcacttattatataatgggtatttccctgggccattaagtatttaattatcaaataatattccaccatatggatgtgccaaaaatatgtaacaatttctcctttttttaatatttaggctttttctaattcttgagttatactaacattgtaatgaaaacctttgcattttttcatatctgtgatgatatccttaggctatattcctagaaattgacttataggtcacaaaatatgaacaattctaagactcttcatgaaatgtgcactccagaaaggttgtaagtttgtaattccaccagcactaaagcagtggctcagcttctaaactctcaatattcattgatattaattatcaatattaattgtcactttttaaatcattatgaacctaatagctgaaaaatagtatcccatcattttaattttaatttgattgattataagcaaggttgcactggccctttgtatttctttgtaagttttgtatttatgtccttgccctatttttctagaatattcaactttttctattcattggtaagaagtctttatatattaaagatattaaccctttgtcatacatttcatatatttttcccagtttgacatttggcttctaatgctgtttatgtgttggtggtggtggtgggtttttgttttgttttgtttttttagacagggtctcgctatgtcgcccaggctggagtgcagtagcagttcaagcatttctcctgcctcagcctcccaagtagctgggattacaggcacctgccaccatgcctggctaatttttgtatttttgatagagacacggtttcagcatgttggccgggctggagtggtgatgttttgttgtacatatttttagaattttatctaattatatctattagtattatcttctgtttctgactttgcttttgtgcttaaaaggcctattctatcccatgatcctatgactattcacttatatgttatttaaatacttttttagttgtgatttttacacttggcttcttttttttttgagacagggtctcactactgcccaggctggagtgcagtggtgcgatctcagctcactgtagcctcgacttcccaggctcaggtgattctctcacctcagcctcctgagtagctgggactacaggcatgcaccaccacacccagctaattttttttttttttttttttttttgagacggagtcaggctctgttgccaggctgaagtgcagttgcaccatctcggctcactgcaacctccatctccctggttcaagcaattctcttgcctcagcctcctgagtagctgggactacaggcacgtgccaccacacccagctaaatttttttttgtatttttagcagagacggggtttcaccaagttggccaggatggtctcaatctcttgacctcgtgatccgcctgccttggcctcccaaagtgctgggattacaggggtgagccgccgtgcctggccatcatacccagctaatttttgtattttttgtagagacagagacttgccatgttgcccaggctggtatcaaactcctggactcaagcaatcctacccatctcaaactcccaaagtgctgggattacaggcatgagccactgtgcccagccttacacttaacattttaatacatttagaatttacctggtgtggcagggtgcagtggcttgtacctgtaatcccagcactttgggaggccaaggtgggcggatcacctgaggtcaggagttcgagaccagccgggccaacgtggtgaaaccctgtctctactaaaaatgcaaaaattagccgggtgtggtggtgcgtgcctgtagtcccagctactcaggaggctgaggcaagagaatcacttgaactcaggagatggaggttgcagtgagctgagatcatcccattgcactccagcctgggcaacagagcaagactcagtctcaaaaaaaaaaaaaaatttacctggtgcacaggtgccgtgactcctgcctgtaatcccagcactttgggagtttgagataggtaggatcacttgaggctaggagttcgagaccagctggccaacatggtgagacccgtctccataaaaaatacaaaaattaactgggcacacctgtaactggtgcacacctgtagtcccagctacttgggagactgaggagggaggatcacttgagccctggaggtagaggctgcggtgagccgtatttgtgccaccacactccagcctgggtgacagagcaagaccctatctcaaaaaaaaaaaaaaaaaaaagaattttcctggtgcatgatatgaaacagtcatctaagttttttttttaatagtttaccaattgtttaagcaccattttttgaataattcttttctccactactttgtgctgcagctttcaccacatactaaatgtttatatctattctagggtctctatcttaatgaccataactttagaaaaatgccttttttttttttaatttttttgaaatggagtctcgctctgtcgcccatgctggagtgcagtggcgtgatctcagctcactgtaacctccgcctcccaggttaaagcgattctcctgcctcagcctcccgagtagctaggactgcaggcatgtgccaccacgcccggctaagtttttgtatttttagtagagacaaggtttcaccatgttagccaggctggtctcgaactcctggcctcatgatctgcccgctttggcctcccaaagtgctgggattacaggcgtgagccaccgtccccggccaaaaaacaccttttaatgtctagtggaatatagccctcctcattgtttttcttttcaacatttccttgattattttcgggcatttgttcttcctgataactttagaattaccttgtgattatgattggaattatgtaaaacccatacacttggagtaatttatgtaaaatatttcatcttttattcagagacacagtatgtctctcctttactttcaatcttctttctttagcttgaaccagatgaaattaccaatattcaactttgttgacatcattcaaacagcaatttcatctggttcaaaccttagaaaagttgttttcttcaaagggaaattatgctctctctaaacaaacaaaaaaatagtttctcttaaaaaatctggggagaagtagggtaggaaagaagtatgatatactgtaagtgttttattcattttttaaaaatcctggtcctaagaatttctcactgccaggggcatctctccagcactttcagccacttcatgcctagttcaaggcttcgccagcttagcttcctccccatagtgggccagtccaaaacaaccagggccttgagcctcaaggggtagggctagtccgtgaaaaagggtttcaggccaggtgcggtggctcacatctgtaatcccagcactttgggaagccgaggcgggtggatcacctgaggtcaggagttcaagaccaacctgaccaacatgatgaaaccccatctctactgaaaatacaaaaaaaaaaaaattacccaggtgtgttggcacgtgcctgtagtcccagctactcaggaggctgagagaggagaatcacttaaacctgggaggcggaggttgcagtgagctgagattgtgccaccacactccagcctgggtgacagagcgagactctgtctcaaaaaaaagagaaaagaaaagaaaaaggtttcagatgaagttcaatgacatctaaatgggacgggtaagggtcccagtcttccccataaaccttagttttgctttctcttcctgagagctagaacagtgacctcatctgggagaatccagccaacaccgcattctacaccatctgcattctatacccctaccacaacaacccactataaactggggtaagatacactagaagtgggtatttgggggtaatcctgatcatctttttcctcgtatgggagccttccaaataatgcatatatagagcataagaagaagtttcaaatagatgcaaagtcatgatggttgtaaaaaaaaaaaaaaaatccaaagaggtaattgcactgttttcacaaaataggatcaacatgtaattatgaataacaatataaatgtcatccaaagatataggaagtgaacttttagggtttcagtgaaagtgttattttgcaggggttaataaacatactaatactttgtccaccctatgttaaaaaaaaaattcacccccaagacagaactgcaggctgcttttaaatgcaaacatggcattgggcttctctggccattagatgtcactgcagtaaatggagagtagctgagcatcacctgattggagcctgaagttcggtgatctctgtccagttaacaacttcataatccctgcttgaaatccatctttggtttggagaataagaggcctagaaaccacaggctaatgctaaacttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcaggcctgtgcacacatggaatgaggtgcccccaacttggtgtgctttcacggaccccaaccaccctgcctgaaatccccttctccacgcttcagtgcatcttagctcaagcccttccaggtatagcctggcctttttgtctatctcccacacctagcccagggcctgggccagaagagatggcagaacttagtgtattgagagaacaagtaggaagggtaaaatattgacagagatgaattcatctgattaatctgtgcaccccgaataagaaccagggagtcctgagaaaatggctctctgcacaggtgcatgtgaagaagagagggagataggctggggaatactgccctgaaaatccagggagcagctgagaatgtaggagccttggaatctggcaggccttctgaaaggatcaggagggaggtaccagacacatgctcggtccccccacaactctgcctgacaccctcccctattgcccatattaggtgtctccatttcatcaaatataaaaccaagtgtgagcctgttgctttataccccagtggactttgaccccatcacagctcacaaggtaagcaggattgggccaggtcagcatttgaactgaaagcacataagatgaaggacaaaggtggtatccgagtggtacagctgactgagcagaatatacatggtcagtgaataaacagaggccccagcctactcaaatagagatgctcgacacctcgggttacctttgttgaattggacacagtcacttcattcattccctctcagggtgctcatcccctcttgtagtttttcatgttcatatctacatcttcaatcctgacctcccttctgagccatggtcccacatttcccacagcctgctcgacatcactatttggctatcatatccccactgtcacctctaacttaatgtgcatcaagctgacctcttcttttcctaacactgttattccagagttttccatttcaattccatcattgccccagtgactcaggctggaaatccacaacttgtgtttgactcttccccttcccctcacccggttaaccttgagccctgttgcttcttcattcctaacattcccatgctggtctttctttttgtcactgcctcttgccctaatcttggaccttatcagctcatacctaggctattacagtaatctcctcattggtctccaggattaattctaaaaatgatcttaagcattgaatattaatatgtactaggcactgtgctaagtgctttatgttcattatctcatttaatccttacaacagccctacaaggtgggcactgttattattaagtccattttacagatgagaaaactgaggcaccgaaaggttttgtagcctgcaagttcacccatccagtaattgagctgggatataagcccagggagcttgtctccagagtcagtgctcatttcaatcctctccagcccagcccatatgggattctgtcagatgaatctttctcagatctgtctgcgttagatccttttttttttttttttttctttttgtgagacagggtcttgctctctctcccaggctggagtgcagtggcacaatcacagctcattgtagcctcaacctcccgggcccaagcaatccttccacctcagcctcccaagtagctgggaccacaggcatgcgccacctatgcctgactaatattttaaatgttttgtagagatgaggtctcctggtctccttatgttgcctaggctggtctcaaactcctgggctcaagccatcctcccgctttgacctcccaaagtggtgggattacaggcatgagccactgtactcagcctgttgttgtgtccttcttgatggtccccagagaaaaaaggctgagccccttggcttggcatgtttcccttaccaactgtgcgatccttgttgcacagaggccctttatataagaagttacaaaaacaaatgcctgcagaaacttggaagtaacatgaaaaagagaatgtagggaaacccagataacatacactcaccctgtaaagaataagccttcaggctgggcctggtggcccacgtctgtaatcccaccactttgggaagccaaggtgggtggatcacttgaggtcaggagttcaagaccagcctggtcaacataatgaaaccccgtctctactaaaacacacacaaaaaaattagctgggcatcatggcaggtgcctgtagtcccagctactcaggaggctgaggcgggaggatcgcttgaacctaggaggtggaggttgcagtgagttgagattgtgccactgcactccagcctcggtgacagagcgaaacttcatctcaaaaaaaaaaaaaaaaaaaaaaaaaaaaagccttcaaatgcattccgagccatcatggctttcaaaagcattctggagagctaaacttcactgtgctcacaaaatgtgatttgcatctaaatatggatgacagaaaggaagaaagagagccagtagaggctgtggccagttcctcctctccaaaggacggatgccatttagaaatgtaggcccagttttcaaaggagtctaaaatccagatttttatgtaaaatctcccagtttttcactgctggcaaatgaaaattgttaagtactggctgggctaaacaaaacacacattcgtatgacctctgctctattcaagcctccaagttcatcaaactaatcttcttagccccttctcccaagccctgaagactaagtgcatttcacattccagtcaccaggcctttgttcatgaggttacctctgtcttggaacatctgcccaattttcttaaaggctcaactgaggtttgtctcagtgatggctgtcttttctgacctactgtagcacatacctgttgtttaagaaatgagttggcttttcccatccccaaaacagctgtcctatcttgatggatcaaggtagatgttttgcctttgtagaaccacaatggaggtgctccagcccacttcagaggggattctggggcaagagaagctgagttaactaacaatctactcagttaataactgcagatgccgtattttcactgtcccccacccaacccccaagggcatagttattttgttctaagagctttgtgggtgaataccacccaccccctttttatttttgagacaagagtctcgctctgtcacccaggctggagtgcagtggtgcaatctcggctcactgcaacctccgcctcctgggttcaagtgattctcctgcctcagcctcccgagtagctgggactacaggcatgcactaccacacccagctaattttgtatttttagtagagatggggtttcaccatgttgcccaggctggtctcgaactcctgacctctggtgatccacccgcctcagcctcccaaactgctgggattacaggcatgagccaccgtgcccggccaaataaccccttttaaatgatgctgttagcctatacgtgccctctgatccagccagtttcttttccatggcatttctgtccatgccctacctcttcccatcttaacactattgccctgctgttccctcactatcaaagccgcctcctgaagtcttctcccatctccccaagcagtagtctcccgctcctgaatggctcactcttgctagagctgtcttatggcccatgccacatgcttccttttgttataatcttttgtgtcccttatttcctctagattgcaaactctttgcctgtgggaagtatgtcttacacatttgtatatcctcacaacacacagcctcatgtagcagacatctaatacttgtttaaaaatgaagtttagggacagcttaggagatctcgctgtctgctaggtgagtcccaagtccgtgtggttgtacctacccaagatgaaggtaagaacacccaagcctgcctcctgctcaacctgctgccctaagaaaacctctgcatgtcccctgtctaaaactgtctatgcacttcgctctgagaatgcactgtcttccatctcctaccctagcaatcaggttctatgcatctcagtgcaaacagccgttaacgtttcaggatagacaaatatgctaaaaggacaaaaggaaaaattcttgacaccattttgatttacacctcctcttcattccagcctcctggcgctttgtatggtggctggaagtgcttgacaaatcatagcaccatcaaatttatacagtcgtccctaggtgtctgcaggccattggttgcagaatccctctctgataccaaaatccactcatttctcagccctgaagtcggccctgtgaaacctgtggacacaaaaagttggccctccttatacacaagtcccgcatcccaaatttgattgtggatgcagaacccacagaaacagagggccgactgtatttattgaaaaaaatccacatataagtgaaccagcacaactcaaatccatgttgttcaaaggtcaactgtaggccgggcgcagtggcccacgcctgtaatcaccacactttgggaggctgaggcaggccgatcaacggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagtactcttagtactcctattttatagatgaggaaacaaggcacaaggtgtaagtcacttacccaaccatcacatagctagtaagtaagtggcgaagctgggacttgaacctatgtctctccttcctcaggccctttttttattcaccaagagtacaggagcctaatcctgtaggcaagggaactggatcattttgactttagttcccttgccccaggtgtgggactagaggatgagggagcgggaaagcaaaccttgatattgggagtccacagcctcagtgcaagagttgagaaaatcaatactttgcaagctcagaaactgagaggccatagccttgtcttaatccgttcaggctgcaataacaaaatatcataaactagatggcttataaacaaccaaaatgtatttctcaccgttctggagactgagaagtccaaggtcaaggcagatttgatacctggcgaaggccagcttcctagagccttcttgctttgccctcacatggtggaagggggagctagctttcttccatctcttttaaaaggacccgaatcccattcatgagagctttgccttcatggcctaatcacctcccaaaggccctgcctcctaaaaccatcaccctaggagtcaggatttcaacagatgaattttgggaggacacaaacactcagagcataacgagcctggctttggccagggaatggttaactcaagttagagagaggaaaaaaaaaaaatctttggaaaactgggctgtcctggggtctgctttagtccctggcagtctggcaatggaaagccctacttgttgctttgacttgagaagccgtaatgagcagtgagccacaggcatagaccattcagtagacacaggtctttggccagccttgaacgacaactgctcagagggactgggaagaaagcccgcctaccacagggggcagggctgggagcagaagcaaagccccaggatgggagagtaaattgttataactatccctgcgaggaggtgctaacaaagttccaggttttctgcctacttcaatatttcccggttggcatagcatctactcttagtaggaacagagttctatttgcctaacagagtcaaattacctgtccagaggtacaaacactgctaggttctaagccttcagggtagtggagaggagtggagccttacctttagtttgttgtattttcaactctctgctgtcatcttacttttaggtctggcccctttgtgaaccaaattcttctaactgagtagcattgcgttagcagtcagaaaaaaaaaaaaaaaagatgcttttcaaatataggtagatgtctggacatcccttaggcaaggtggctctgtatgagcgtcactattaaagtgaaaggaaaggaaaagtctccccacccttgtttttttttcaaaaggtatagagtgcccgaaatactttagggatggcagctgttgagcatggaaacaagacttgtccctagagggaaggcaaggaaggcatggggaagagccttcctaactccacttagtgtaaaatcactctgtcctcttcccctgacctgagctggcttattccttggaagagataaagatctgggagtcaaaatgaccaccctgtgctgagcaggcttctttgaactccagctaaacggtaacagcacctaagataggatgttcccaccctcactccccacctcaaagtggaggtgaagagggagataagggaaagggagagaaaggtcccaggaaaggtctgctgtcaagagggaggacccgcagctggctgggagcattcacaggaagtaccaattttcacctccttttttccacagagctgttgcttatttgcctacgacggctgtgttcctcttgaggctgtaatgggcagactagctcagtgggtaacagtgtgagctttggatcccagccttgccacttactcccgcgtgaacttgtgtacaccacataacccatctgagcctcatcttcctcatctgttttgagggtaagaatggtgcctacctcatctacttgcagcaaagactaaattcgtttagtgcaaatgcagagccaggcccataataagtactgtcaataatgctaagatgccatgtttattgttcttgaagcatcacttcagaatctgtgcacagcatggaaggcctgattagaaccataaaaaccagtccaaggccgggcgcggcgactcacgcctgtaatcccagcactttgggaggccgaggtgggtggatcacttgaggccaggagttccagaccagcctggccaacacgacgaaaccccgtctctaataaaaattaaaaaattagctgggcatggtggcgcgcgcccgtagtcccagctactcaataggctgaggcatgataatcacttgaaccaaggaggcagaggttacagtgagccgagattgcaccactccagcctgggcgacagagtgaaactctatttaaaaaaaaaaaaaagccagtccagatgtgtttccatgtttcctatgattactataaacacacaaatgagctgggctcacagaacctcaatagaccttggatatgtatagctaatgatgagcagcgacaggaatcgagagttcgtacagaattttttggtttggttagcgtaacaacaggctttacagacaggctccatgtgcaagcactgcacacctctgtatgttctcagccttctgagaactgtcactgccaaatcttttccttcaccctccccaccctatctcacccccaggcaaggtgacactttcaaagttggcacggcaggcagcacatgccaggcctgtgacccaggcctcagcagctctgctcacttgcatggcaattgctttctacagtcaggcccagctgcactttgggtctccccaacccccacccccaatcaccacacaggaactggctgtttctcttttcttcgtccaagctgaatactaacctactgtggtttgcttgcttcccccattgtgatcgcaggctttctgagcagctagtcaaccctctagcctgccactgaatcggaaggcattcacactggaggggatcaaggggagcttgtaggcttgccttgctggcgggcagctgcctacacccactcgtaccaatgtccccgctgcagagcccgggtgcttcccagctgtacaaggacaactatttgggtcccggctatgccaagagaaacatgggtcatgtggttcacaggacagaaaggttcatttactccaatatgactggcatttttttttgtttgattattggatatttgccaaaagactgaagcctcctgccacaaccacctcccccacatatatgtcctcagatggtttgggaattggacagcttagtcatcaggtcctgtcctccacatccacagaagatacaagttgtttccagataacatgcagaaggttctgagctccttcctgtgtgctccagctcgaagactcttttcttttccctatgaattttttttccttttctttctctggtctttcctttttaatgcccttttaaaattaagtattctatcttttgagtgggtaacacatacacatgatacaaaatccaaaaggtgcaacgagtatatgctgaaaagtaaacctctctaacctttgtccttagccattcagctctcctgtgagtcagtactgttgttagcagtttacctgtatctttccaaagatggtctatgcaaagatccacataaacttgtacatttatgttctgtttttaggtcagcagcagcacactacatacactcttctgtgccctgttttttttccacctgaaaatgtatctcggctgggcacggtggctcacgcctgcaatcccagcactttgggaggccgaggcaggtggatcacttgaggtcaggagttcaagaccagtctggccaacatggtgaaaccctgtctctactaaaaatatgaaaattagctgagcgtggtggtgggcacctgtaattctagctactcaggaggctgaggcggaggaatcacttgaacctgggaggcagaggttgcagtgagccgagatcacaccattgcactccagcctgggtgataagagtgaaactgtctcaaaaaaaaaaatgtatcttggaaatgataccacatcaatccagataaagctgccacatatttttcatttatgacatagtattcaacggtatgatatactatttatttaactagtccctgattggtggacatttagattatttccagtcttctgctagtactaacaatgctgtaacaaatctccttgttacatacatttttcacgcacatgcaaatagatctgtaggataaaaaggggtccccaacccctggtccgtggcctgttaggaacctggctgggccacacagcgtgaagtgagtggccagcgagtgagcattatggcctgagccccgcctcctgtcagatcagcggcggcattagattctcatagcagtgcaaaccctattgtgagctgtgcgtgcaagggacctgggttgcacactccttatgagaatctaatgcctgatgatctgagatggaacagtttcatcccaaaaccattccccccaaccccttgtccgtggaaaaatggtcctcggcaaaaccagtccctggtgccaaaaaggttagggactgctgggctaaattcctagaatttttgctttggtcaaagggcatatgtgtcttacatcttttttttttttttttgagatggagtcgccaggctgaagtgcagtggcgcaatttcagctcactgcaacctccacctcctaggttcaagcgattctcctgcctcaccctcccgagtagctgggagtacaggcacacgccaccatgcccagctaatttttgtattttcagtagagacagggtttcaccatgttggccaggatggtctccatctcctgacctcatgatccgcctgcctcggcctcccaaagtgctgggattacaggcgtgagctgccgtgcccagctgtgttttacatctttataaatattgttcagttatttcagtactcatggaaagactgaacaaccaaaacgttgcctctgttggaagacctctgaggaatttatcacaggaataatcaagtgctttgcttttaagtctttgttctttatttgtatctactgcaagtttgttatttctttccttcaatatgtattaaacacctcgacctctaccatgcaccaggtaagctttgaggccaaaaccataaacacaacaaatgtggttgctgcccccacagtatttacagtctaggagatggagcagttgggggcaggagtacacatgaacgaaataattatacactgagtcattacaaactgtgttaagtgccatgaaggagaagcacagggtgactgaaagtgttcagtaggctcctgacttcgtgtggaggtctcagaagatttccctggggaaatgatgtttattctgatcaataagacagacttagtgaggccgaggaaatggcaggtttgaagtcctagaggaaggcaggagcaaggattctggccagcagcatggattacaggatctggaaagggtcttcaaggacattttgtttcagtctcctcatttgacatgtgagaaaactaaagtttagggagctaaatgacttgaccagggttatacagatagtaacaaagtcaggctgcagaatccagtgtgctcatcctgggagctgtgggtctgaactagacagctatgggatagttgcctgggtttgtgtagaaggacttaagttcaggttcttgtgacaagctgcgtgacatgtttcatttctctttactagtaagatacagtttggatgaatggccattccaatctagcgggttggtttgttcttcagcatacttgtctttcttacaagtttaaataataataacaatggtggttaattctttagcgcttgctctatgtcaaatacagttctaagcaacttacatgtattaaatcatttcattttgacagcagttcttaaagttggtgttattattattaccccattttacagatgaggaaattgaagctccagaaggtaaaggcacttgccaaccatcacagagctagtgagtggcaaagcagggggaccgagtccaaacagtctggcttcagggcccatgtgctttgtctcccaggcactctcagtgtcagcagcaggctgatggactcaggtttgagcccagagctgccttgtgccatggaaggtccaatcagtggctctcaaccctggctgcacatcagaatcagctggggagcttgtaaaaagtgctaatgtccaggcctcgcccccgttcagttaaattgcaatctctaggggtggatcccagtcactgagggtttttaaaagcttccgtggtcagcctaatgcagctaacggttgagatgtactgggatctaggcttgccattgctttgccctttgggagcaaccagcaccccatacttgcctttgtgttctggacacccacttagtaggacacttgtagaggcacttattcataccacagcacaggctcctgtctcagcctaaagaactcattcagtgtacatgctttggcagccacatccaccagtgatgtgcggtaacaagtctgtaaagggctaagagaatattttcagtcctgagcgtcagaagacagtggagcttagtggagtggagcttggctctgagtcaaacagacccagattcaagttgatgctttgtgtcatggtctgtgattttagagactggcgtttatcctctcaccaactccattttgtcatccatataatcaagctaatacgataatactacctctttcatgaggcttttgtgaggattaaatgagatagtatatagaaagcaatcagtgggccaggcgcagtggctcatgcctgtaatcccagcactttgggaggccgaggtaggcagatcacctgtggtcaggagtccaagaccagcctggccaacatggtgaaaccccatctctactaagaaaaattagccaggcttggtggcagtcacctgtaatcccagctactcaagaggctgaggcaggagaatcgcttgaacctgggaggtggaggttgcagtaagccaagatcgtgccactgcacttcagcccggaagacagtgagactgtgtctccaacagaaaaaaaaaaaagaaaagaaaagaaagaggaaaaaaaagaaagaaagaagaaaaagaaagcactcagtgctaggccatgtctttatttcatgactatccacgtagcttatgtgagtaaacagctatatttgggaaaagctactagtgacactgatattgacaggaatttgatttgacatttaataagtgcctggtatgtacaatgaagagtgaaagatcctgaagagcttggatgactaggaaggccccgtgcctgctgactggcttgctggctgggagggagcataaagacacccagataactcatataaggtagagtgtgccgcagcagaggtctaaacgagaagctaagggaggccaggggcggtggctcatgcttgtaattccagcgctttgggaggctgaggcaggtggatcacttgaggttaggagttcgagaccagcctggccaacatggtgaaatcccatctctactaaaaatacaaaacagctggacatggtggcaggcacctatagtcccagctacttgggaggctgaggcaggagaatcacttgaacccgggaatggggaggttgtagtgagccgagatcgctccaaaaaaaaaaaaagctaagggagcacaagatatggagagagaaagccccaattcaaacagaagctggaaaacaattataaaataaccaaggaaatatgaatactaactgaactcaatatgtgatgatattaaggaattataaatttttaggtgtgataacggtattatacatatatttttgaggagcaattatagtttagataaacataattctaattaataatatgtaagtcagatgaattgaaatgatgtctcgtgggggtagagatgaaagaagattggccacgtatagctaattgttgaagttgggtgatggaactttgtgttcattttactggcctctctacttttatatatggttgagatttttcacaataaaaagttttaaaaagagggccgggcacagtggctcatgcctataatgccagcactttgggaggccaaggcaggcagatcacttgaggccaggatttcgagaccagcctggccaacatcgtgaaaccctgtctctactaaaaatacaaaaattagctgggcgtggtggcacacacctctaatcccagctacttggaggctggggcaggagaatcacttgaacctgggagacagaggttgcagtaagccaagatcgtgccactgcactccagcctcagtgacagagcgagattccataaaaaaaaaaaaaaaaaaaaactttttaaaagaggtaaagttgtggccaggtacagtggctcacgcctgtaatcccagcactttgggaggctgaggcaggtggatcacaaggtcaagagttcaaaaccagcctggccaagatggtgaatccccatctctactaaaaatacaaaaaaaatagccggttgtctgtaatcccagctactcgggaggctgaggcagagaattgtttgaacccgggaggcagaggttgcagtgagccgagattgcaccactgcactccagcctgggcaacagagcgaaactccgtctcaaaaaataaaaataaaagagagaggtaaagttgaagaaaaggaaggaaacaagcagtacacaattgtggaatctggaaaattttcaggatgaggtggcatctgacttgggcatgggtgactagggagagttgatgtcgcagtttaaatctgaagggagtctgctggcagaatctcctcttccttgaggggcttcagtcttttttcttttaaggccctcactgattggaggaggcccactcacattatggacaggaatttgttttactcaaagtctactgatttaaatgtcaaactcatcttaaacatgcctttacagcaacatctagactagtgtttttcccaaatagctgggtactgtggcctaaccaagttgacatatgaaattaatcatcacagggtggcagtgggaaatgatactaggaaaaccggtaggggccaaattgtaaagggttttgaattctgttaaaattgtctttagtaaacttctttggaaaatttttcttctcaaaatgttttcgttagaaaattgggaattgttgaaggcttctgagcaaagcaatggtaacatctgatgagtttggaagggtacttggctgcaatgtggaggatgagttggagagggcagagactgaaggtcaaatgatgggtaaggaaactgacccttgcttaagagagatgatgtgaggtactgggagtagagctgaaaagtatccaaagcatagaatataatgcaggtagcagcaagagatcaggctgagcagtaggcagaggccaggtcatggagcacctggtaagccagattaaagagcctggagtttatcctgatgataatgggggacccactgaagagttgaagtcaagggagtaacctgattaaatcgctctgactgctagatggggaataagggcaggtagaccagctagtaacagttgtagtagtgtgggcaaaagatgatggtggcttggactagggtgagagtggaaagaaagaaaagtaaacaaatttgggacatgtttggagccactggaacttggttagtgatggattagatcagagaaaggtgagagacagagaaaacttaaaggtgactcaggttttgggcctgagcaagtaggttgatgacagtgccatttgctgacatgaggaaaactagaggacagtcaggattggagtggagcaaaatcaagagttctgattaggacatataaagtttcagatgttcagtagacttctgagtagcaatgtcaagtagctagttgattacatgatcctgtggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgttaaaaaaaaaaaaaaattttgagacagagtccgctgcgacgtccaggttggagtggaatggcgtgatctcggctcacttcttcctgggttcaagccatctctgcttcctgggttcaagccattctcgtgcttcagcctcccgagtagctgggactacaggcatgcgccaccacgcctggctaatttttgtatttttagtagaaatggggtttcaccatattggccaggctggtctcaaactcccaacctcaagttatctgcccacctcggcctcccaaaatgctgggattacaggcgtgagccactgcacccaacttaaaaaatatttttttaaaaaaagaaaaaaatcggtgggcagagcagatcatataggaccttgtagcctacgagcatgctggaaccacttcctactggctcaggagaactgactgttaaatttcaggaaatttgggagctggtcgacttcgcatttggcagcctgaaatcagccatagtgggagtactgatgctgttgaaattggtaaatgctacaattcagcccttttttattttcccccagagaaccagttgttaaactttgccaccatattagtactatggcttgtaggctccagtaagaaatttagattttattcttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcataattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagcatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccacatttcttggaggctttgctcatttctttttattcttttttctctaaacttcccttctcgcttcatttcattcatttcatcttccattggtgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagactgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtcgtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccgctttgttttctttttcatctcagtttttgaggataagaatgctttgttttaaaagggatcatctgtgtctttttaaaagcttactgaattttcctggtgtgaattatttgcacgtactcatttttgtggttgatttggattttacagtgattaagattttacagtacctgctccaccgggcccagatcctgcttcccagatcttcctgggaagcaccaagaaatttagattttattctaagtgtgatgtaaagtcattaaaatgttttaagcaggtgagtaaaaggatctgatttttaaaaatcactgtacgtggccaggcgcagtggctcacgcctgtaatcccagcactttgggaggccgaggcaggtggatcacatgaagtcaggagttcaagaccagctgggcaacatggtgaaaccccgtctgtactaacatacaaaaaaattagccaggcctggtggtgcacacctgtaatcccagctactcaggaagctgaggcaggagaatcgcttgaacccgggagacggaggttgcaatgagccgagattgcgccgctgcactccagcctgggtgacagagcgagactccatctcaaaaaataataataataatacatcactgtacaagaatggactcccagtgggagaaggcaagatcgctaaggaaactgctgcaacaatccacatgcgcagtggtgccttggcagtgcaggtaagagttcagtcaagaaatttggaagattgttaacatcctaagactggatatagatggaccttgatttatcacaagttgattataattgacctgttatgtaattcgtgttacttagtgtctttttgttttagttgtggggagcaccagattacagaatgattaccttgactcatgacccagggctctttacaattcttaccagaaactggcagatgataaatcagtcatcttatttggtagcaaaataaggaggttactttcctgcatgaacataaatttcctcttttcaatatttcagtcttacattagcaggaggaacttgaagtcttgtgattaggcagattctttgtaagggaaaaggcagcttactatccttttggtaacagttctttactgatagggtaagaaggaaaggaggttgagtccgaacaatgctaaaggaaacactttaaagtaagacatccactgaagacccctagccattttgcctactgtaaaatagaaccatctacaatgtcttgtgaagagagaaatgaaatgaattttgatatttgttttctgcaaagattctacattacattgtgtaagtcttgacccacgatttttataactcatgcataaaattatgtgcaaatgctttaaaaattccagcccactcttatactgagcattttatgtactcattcagcaaaccattcattgagcaccagtcatgtgtcagctgctgcttaaggcactagagatacgaaaattaaaaagacccagtcctcacagagttcacagaacactaggaaaaatagacatgtaaattggacatgattacagtacaattgtgaaagaggtctctttgaaagagttgtctgtatttatttaccatctccagtctttcttttcccattctctctctttttttttttttttttttttgagacagaatctcactctgtcacccaggctggagtgcagtggcacaatcttggctcactgcaacctccacctcccaggttcaagcgattctcatgcctcagcctcccgagtggccgggattacaggcatctgccaccatgcccggctaatttttgtatttttagcagagacagggttttgccatgttggcaaggctggtttcgaactcctgacctcaggtgatctacttcccttggcttcccaaagtgctagaattaacaggtgtgagccaccgcgcccagcccccattctctattctctctctctctctcttttttttttttttttttgagacagagtcttactctgttgcccaggctggagtgcagtggcacaatctcagctcactgcaacctccgcctcccgggttcaagcaattctcctgcctcagcctcccaagtagctgggattacaaccaggctgggagattcagcttgtccatttcatgttctgtttctcacaatcatctgtgtttgcttgtcactgcactttaaagagaaggcataactcaaaagtttcacccttcaacttgatggagaattattttttatttatttatttatttatttatttatttttatttttttgaaacagggtttttctctgttgcccaggctggattgccgtggtgcaatctcggctcactgcagcctcaacttcctgggctcggtcgatcctcctgcctcaggatctactccctcctgagtagctgggactacaggtacatgccatcatgcccggctaatttttttttcttttgtagagatgaggtttcgtcatgttgcccaggctggtcttggactcctgggatcaagcgatctgccagcctcagcctcccaaagtgctggaattacaggcatgagccactgcacccagccattctatatttttaaagcatagaatattgattctttgagctggattaatgaggaaagatataacaatcattaatataaaataaagaattgtgaaacctcattaatttgcatgccactaacctaaaattgtaataacccagggcttagtaagcaaattagtcatataaacagcataactatagggatatttaaactgtttaccaaaagaagctgcttttaaagcctgctgaagtacttatttattactaataatgtctaatattattgacacttataatgttgctggcactcttcattgtcttatttaatttccatagcaactctaagagctaggtattatcactcccatttttgaaataaagaaattgaggccaggcgcagtggctcatgcctgtaatcccagcactttgggaggccgaggtgggtggatcacgaggtcgagagatcgagatcaccctgaccaacatggtgaaaccccatctctactaaaaatacaaaaaaagccaggcatggtggcaggcacctgtaatcccagctacttgggaggctgaggcaggagaatcacttgaacccaggaggcggaagttgcagtgagccaagatcgtggcattgcactccagcctgggcaaaaagagtgaaactgtgtctcaaaaaaaaaaaaaaaagaagaaattgaagctcagagaagttaaggaactcactgggtgcagtggctcacgcctgtaatcccagcactttggcaggccgaggtgggtggctcacttgaggtcaggagtttgagaccagcctggccaacatggcaaaaccctgtctctacgaaaaatacaaaaattagccaggcgatgtggcacgtgcctgtaatcccagctactcaggaggttgaggcacaagaatcgcttgaaactgggaggcagaggttgcagtgagccaagatcatgccactgcactgcagcagcctgggtgacagagtaagaccctgtctccaaaaaaaaaaaaaaaaaaaaaaaaaaaggaacttgcttaagatcaaaaatagctaatgagtagaagagacaagggttccaatccaggtctgtgtgatgctgaagcccacaggcagaagattcgcactctacctaggcttccacagatcactcaaccatgcatgaaagtaaggcctgaaaagtgtctctactaggttgcccttcattaatctagttccagtcatgtataataaaatggagtgtctttccaaaatttcataatttagatttcactcatttaggccgacttcccccctatacatacccactagttggaattagttgccttttactatatgctgtattgaatgtccttatagttgggggtcatgagaaaagctaaagtctaacttggacaagatgacgactggcattgccagggttgtgcagcaacagtagtggggtggggtgtcctgcaaggacatgagttaggtggctgttaggggcagcataagttgtagtgtaaagccttggagcctagatgccaaggtcgcagagtcaccaggaggcaggatcctggagtacagattgcagtggcccagtaggcacagcatctggcctctaggtctgcctctgctatgcaccagctgggggctttggttaagttgctctgcttctccaggtcataggtttttgtttgtgaaacgaataattggaagggaagatcttagggtccatttcagattggggtctctggtttagggatctgcgttatcagagtctaaagtaatcaagtccttggagatctagtaatcagaaggagagcaagaaagagccagctttcattgtcaggggcaacaaagaggtggctcatgcccataatcccagcactttgggaggccgaggcaggaggatcacctgaggtcaagagtttgaggccagcctggccaacatggtgaaaccccacctctactaaaagtacaaaaattagctgggtgtggtggcatgcacctgcaatcccagctactcgggaggctgaggcaggagaattgcttgaatctgggaggcagaggttgcagtgagccgagatcaaccactgctctctagcctgagtgacagagtgggactccatctcaaaaaaaaaaaaaaaaaaaaaaaaaaagaaagtccagaaagcctggtttgaatcagtaaaatcgagttttcacactgcttcactgattgtaattcattcttctacagatttttaaggagggtggaagagagaaaagctaagtaaaatgtggtcctagccatcacaggtctcatagtatcctgagggaaagagacaggaaacaactaactggaatataaaacagaataaaatgtgttcattacctgctgtatgaccttggtcaaatcacttaacctgtccctgagcctcagtttcctcaactttaacagacacataagcagtcaataaatgtcagcagctatgcatcagtagtggcaatagtaatatggactacatgtgtaatattttgtactatgccattacatcttagtaaaatagaaccatctacaatgtcttgtgaagagagaaatgaaatgaattttgatatttgttttctgcaaagattctacattacattgtataagtcttgacctaccgtttttataactcatgcataaaattatgtgaaaatgctttaaaaattccagcccactcttatactgggcattttatgtactcattcagcaagccattcattgagcaccagtcatgtgtcagctgctgcttaaggcactagagatacagaaattaaaaagacccagtcctcagagttcacagaacactaggaaaaacagacatgtaaattggacatgattacagtacaattgtgaaagaggcctctttgaaagagttgtctatattcaccatctccaatctttctcttcccattctctttttttttgagacagagtctcactctgttgcccaggctggagtgcagtggcgtgatctcagctcactgcaacctccacctcccgggttcaagtgattctcatgactcagcttcctgagtagctgggattacaggcacccaccaccatgcccagctcatttttgtatttttagcagagacagggttttgccatgttggccaggctggtctctaactcctgacctcaggtgatccacttgccttggcctcccaaagtgctagaattacaggcgtgagccaccatgcccagcccgattctctcttgagtccattccagtcagacttttgctccaccatccaataaacttctcttttattttttgagacatggactcactctatcgcccaggctggagtacagtggcacaatcatggttcactgcagcctcaacctcatgggctcaagcaaccctcccacctcagcccccccaagtaactgggactacaggtgtgcaccaccacacccagctaatttttatattttttgcagagataggggtcccactgtgttgcccaggctggtcttgaactcctgggctcaagcaatcctccccctatggcctcccaaagtgctgggattgcacatgtgagccactgcacccagccaaaacttctctttttatgataaccagtgacctccatgtgtttagatccaatggtcacttctcagtcttcatcttactgggccctcagcagctcaccactcctccttgacataccaccttcacttggcttcctggacaccacactttccttttccttcttcaccaactgctccttctcagtcttctttgtggggtctaatgtggaagtatccccaggctcaagccctaagtgatctcatctggtctcctggctttaaataccacccatgtactgatcactccctaattatgtctccggccctgacctctcccctgaactccagactcatgtagccaactctccatctccatttgaatggctaacaagcattgcgcagttgaactcctgatgttttcacccaccctcaaaaaacaaaaacaaaaagccaacctgcttctcccatagcgtcctccatctcagttcatggcacttctgtctatcccgtcacttaggccagaaactttagagccatccttgactctcctctcacaccctcatccagtccatcagccaatcctgttgactctaccttcagaatatatcgagtctgatcactgctcaccactccaccactagcatcccagtccaagctaccgtcatctcttgcctaaattactctagtaatctcctaaccagtctccatcctacttttccctccattcttgagtctttttcaacacagcagccagtgatcatgtgaaaatataaattaggtcatgccattcttctattcataaccccccccagtgaccagtcttctcagtaaaagccaaaattcttactgtgtgccctaccagccttatacaacctagccaccatttacttttgtgaagtcatatcccattactctctattttgttcattccattaccaccacattggcctcctcattgcctctgtaacaccccggacatgctcctgtcccagggcctttgaagatatctgtacaacttgcttcctcacttccttcagatctccaaaaagccatcttcttggtgaggtcttctctgattaccctaataaaaacttcagcatcctccagacactccttatgttccccctgcttttattttatccagagcactcacctcctcttagtatttggtgtaatttacttatttattttctttctttgtcttgtcttcccctgcaattagactttcagctttataggaacagggacttttgtctgtttggttcactaatgtatcctgagtgtcgggcatatagtaagtatcaataaatatgcaaataaatgaatagtctttagaggagataatgggagtataaaaaagagctaaggagtgcagtcagtatgattggggtgagtgatgcttttcatgttggaaaagttgtcatgaagggccttacatgtcattctaaggagcttagattttatcctataggcggtaaaatgtcagtaaagtagtcagtggtctgaattggaattttagaaatgcgttctggctgtagtataaagaatgaggccgggcacggtggctcatacctgtaatctcagcactttgggaggccgaggcaggtggatcacctgaggtcaggagttcaagaccagcctgcccaacacagggaaaccccatctctactaaaaatacaaaaattaggcaggtgcgatggcatgcacctgtaatcccagctacttgggaggctgaggcaggagaattgcttgaacccaggaggcagaggttgcagtgagccgagatcgtgtgactgcactccaacctgagcaacagagcgagactctgtctcaaaaaaaaaaaaaaaagaagaagaatgaattggaggctgggtgtaatggcttatacctgtaatcctagcactatgggaggccaaggtgggaggatcacgtgagcccagaaattcaagaccagcctgggcaacatagggaaaccctgtctctacaaaaaatacaaaaattagcagggcatggtggcacatgccagtagtcccagctaccagggaggctaaggtgggaggatcacctgagcccaggaggttgaggctgcagtgagccgttattgcaccattgcactccagcctgggtaacagagcgagactctgtctcaaaaaaagaaagaaaagaaaagaaaagaaaagaattgaaaaggacaagagtgggtccaagaggccagtaacagactgctacagtaatgcacacatgagatggtggtagcctgaattatgggagtgccagtggggatggaaaggaggattgcttggatagggcagtaagggtgggcgaaatgaaggaattccaggtttctggcttggggtagcttgttaaagacttgggccattcatcactgagataagaaatacagaagaaagaataaatctgacactgtcaagaagaaaggcaacgatagattctaggtgtgtcgagttttgagtacttgtgtactatccaggtagagctgcccagtaggcagttaggtgcttggttttggaggtcagtgggaggtcagagccaaagataaagatttgggagccatctgcctgtaggaggtgtttaaagcaaaagctatggtagaatttcctagaaaaggtatataaattgaggaggaccaaaagagttcctggttatcagtgccaaatattgccccctaagaaatccagtaataatatagccaaaaagagccactggatttggaaaccaggaggtcgacaatggaatacatttcatttattcaaatgtttattaaatatctactatgtgttaagaatactaaggatacagaagtcaataaaacagatcaaaaaatccctccttacatgtagctgaaattctagttgcagagaaggagcagataaataaaggaaataaataagtaaattattccaaatattaaaaggcagtgaatgctctgaaggttagataagctgcctagggtcacagggccaagtaagtgaagaaactaggactagaaacgaacctgctcaactccagagttgtgctcttcttactgttgtaccacacctcctctcccacatcgataatcttggttccattgccacagaatgccatatagccccaactaaacatttcagaaacaaaccaaagtatgtgtatagcttaatctaaactcaacaccatttctgaaagccagctctgaggggacatccccttcacagtggacaggtagtaccagttttatatgtagatggtatattgaaaagtcatttcatctgatcgtaaaattatttttctaagaggatggctgggtgcagtggctcacgcctgtaatcctagcactttgggaggccaaggcaggtggatcacttgaggccaggagtttcagaccagcctggccaacatcgtgaaaccccatctctactaaaaatataaaaattagccaggtgtggtggtgtgcacctgtagtcctagatactcaggaggctgtgacaggagaatcgcttgaacccgggaggtggaggctgcagtgagccgagatcatgccactgcacaccagcctgggcaacagagtgtgagactctgtcgcaaaaaaaataataatattaaaggagaaaacgttcctttcagagatggagcattttggtaataatagggttccgtcaggatggctctgaaggtggtgatgatgtccacggggtggccaaaatggtataaaggtgaggatcactgaagccgaaggccagaaactggtcatgggctgggtcgtctttatagatgccaaagttacctaagatgacggcgaggctaggagagggtgagccaccaggtatcacagtcttcaatgaacgtggaagagtggccagattagtagataatagcaggccaaggagtatggttcagtgacatcagccccagctaagtgcttctgtcgtgagagtgaaggaggaagggtttgggaacagcaacagagagcgagaagaatgccaccatcacaatgctccctaccctgtcacatctgtgaggtggagaaatgaacagcctccgcttgggagcttcacaggggaaggaccagtaaagacaaggaaacagaatactttaaaaaggctaagggcatgggattatgtttatcatgtccagaaggcacaggttgggagggaatgtaagtatgaaattgaatctgtcccaaatgtctgcttccttccaggcaaaataaacgacaaatatatggacagggtatcatgattgtattgcacgttaatatctgttctaagcccacagaacaagaagaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtcatgcccttcaatcactgtcattcctctcccaacccacactgagccagctttccttttgccatctttcctgattccaaaaagagttaccatttgtattgccaccgccattatctcactttacaagataatttaccctgatccaagttgactgcagacacattgatgttttctttttaagaacttaacttgattttcatttttggttttaacagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaattttttggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacactcatacatagagagagattttcggtatgttgcaagtattttttccgattaaatttattttcc

SEQ ID NO: 4966 - DNA, 53397 bp, human
tggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaagtaagagccgggcggggccggggaaccgggagaccggacgggggtggggtgggggagccgcggcccgacgccgccctgctgcctggactcggggccctggagtagggacggcccccttgtcgatcacctggggacccctcggggcggtgggccacctctatggcccccagagtgcagccccaatgcttttcacgttctcttggggttaccgccctgcaagatgcagttttgtggtccgcagccctggtccgagaggctttccggattggaccgggcgaggaggtggaatgcagcaaaggatttggaggaaaggaatgaaaagctctccagagagatgagtcctaaccatttccaccgtcctccaatttggaaacttttgcttaggctggcttaggaagagagagacccttttaaaggtgtttttgtctgtgtgacccaagccccgagaagaaagtgcttggtgtggggaaaggacccgatccatcgatacgaaaaggccgcagatttttgcccacacatctccccaacttaaatgaagcttgacttcaggctccgacagaggctgcagcttcccctccccaagctgagaacggccccctcagcctaccgcttcaccccactggcctcatttatttgggccttttccaccttctcccacatcaacagctgctccttaggaaaagatctaaaggtgtaaatgcagccttaaagcttccaccgagctcagaggtacctgcatttgaactggaaaccaagcctgaaagaatgaattggtagtgatggcatttcaggaagcagagatgtttctgtattggggggacggtccctgtgttcctcattcagtgggcacagtggcatctttgatatcgccttggctctgaattagacaaacagcccacatttgggagagtcggtcttgaccgcatagtttagtcttggcggctaatagtcaaaggattttgccttgacactgtcactcacctgggaggccagaggtggaaggctcacctggcagccgacaagccgaacggaatcatccttattacctaggcctctaggccagtactcattttgcctctgcctggaaatagagttcccttctcttcctctgcagagggactcatgggtgggaccatgacatttagttaaggccctttttcctccccacctctgcttgccctcatcaacatctggcctgcagtctgtaaacagttctcctctgagtcttaatgactcagtttctcccccacttcaccctcttctctacaaagtagtgtggaaatcttcctttggatgggataaaatatgtccagaggggtggggggcagaacttcaaaggctggtttaagtattgtggctcttctgctaagcacctagtatatgcacattagattttttaagctcctgcctcctgccctgtaaggtccataggacaggaagcattgtgcctgttttacagatgcagaattgggctcagagtgatgacacctcttgtcagtgaccgagctgagctccactacctggccttctgactccaaatctcatagtctttctgttacatcatgctgcctccctgcatccatttgacactaatttagtcaggctacattaagtccccactgtgtgcacgatgctgaggacaatgccaggatggaaggggcatggtccctgtgccccaggagcttacagagtaatagaagagtaagactaatatgtccatgaccataacacacaaggtagcatgtgattgtcatggataatgtgctctagaaatgtacccttctgatgagcgatgaggaggagaaaatgtgaagacttcatagaggagaaaaaaatttgagtttggcattgggagaatgaggagtctgctgggcagagatggagagaaagatactgcagttgatgtcagcaaatgcacagaggtgggaaggcaagcagcacaacaggaagtccaaccagaaaagcaggttggaatgagatattagagggttggattaagggatttggacttgacttggtatccaagggtagctgtgggaggtttttgtggggggtggggggaggtgtgttgtgattaaagcaattcaatggaaatgatcgtcacatcgtggcagagtaagatgactagagaggaggaagagtggagacagcagggccagttaggaacctgttgcactagtccacatagcagctgagggcaccggcaataggtgaccatgggagcagagaggaggagatgtctgggagaacgagaacagagacttacctgggctaggtttgctaggaattttttttcccctacaggattattttctttctgaaaactaaaaggaagtattttggtgaatggcaaggcatagttggaaagcaaagtgtttgattaatcgcgatgccatccttcctacatcaacatgatactcttgattcatcattatactgattcatttctactcttttctgaccatgaatttgcaaaacagttggctgggggcctgtgatcatgggtttgaacaaaacataaacatccagaatgttcagggaatggggtagttaagtgacttgtccacaaatgcaattaatggaagagctggaacttgaagccaagtcttctggctccttagttcaggtctctgtctaccattgcacagcagaaatatctgcttagttggattgacgatcaagagtccactcagtagtctgttgggagctaggttattgtaatgggtggctttcagatgtatcaaatagaagacccccccgccctggaacttcacaaccgcttgtctatcttatctaataaacgttagtttgggtccctgcagctctgaaattgttcataaccaacactatttctttattgaataagcacttcatgagcttatgtttggctgcactggctgccaacctgttaggttgaagtattggcagttataattacacatatccagggtgtgtgttgtatctgtgctggctgaaaggaaggggttgctgcaattcaccagtgtatccagtctcactggaaaaagcttctgtgcatgtatgtgtgggggtgggaggaagaacagaaaagggaacagtgccgccctagcaaatcaaaagtttaagatgcatggactgagatgacatcattggcggattatcagggttgcctgccctgactctgagattctaaggggaacaattgataggacttatctctgtatcagatgggagaagtctgcgaaaaaaggacttcctatggttcttctttttaattgtgtatatttgatattgagactctataaaagaaactgatataaaatacggctcctcttcctagttcatcaagtcattcagtgaattaagggcctgtttcctctccgcttgcccctaccagtcatttccttgtcagaagtgttgaactcccttaggctctatgctgaggactaacacagggtctgatacattgtagaccttcaataaatgagtagtgaattaactatgccctagaagtgaccaagtgggatggggaataagagtgggacaaggagaatgaatggtatttctttgggcatttcaaactccaccttctaggtggttccagcttgctgcagaccgcccctccagtcaaaaatttctttttttttttttggaagaagtattgctctgtcgcccaagttggagtgcagtgacgcaatctcggctcactgcaacctccacctcccgggttcaagcgattctcctgcctcagccttccgagtagctgggattacaggtgcacgccaccatgcctggctaatttttgtattttcagtagagacggggtttcactatgttgaccaggctggtctcgaattcctgacctcgtgatccacctgccttggccttccaaagtgctgggattacaggcgtgagccaccacgcccagccccagtcaaaaatttctacttcctctgtttcccctgtcctttctgaggtccccctccaacttgactggccagggtatagaagagggaggaacgaggaagtgggcaggcaggcagtacaactgaggcagatagtctgttggtgaatgccacctgtttgagaaaaacctctgtcaaacttggtttttcctctgctctcacaccacaacaacaaccctcaacacagaagacttctgtgaccaaatgagtgtggggaaccccacactctgataaatggacaccaactaggtgtcctctgattcagttctgacactgtctacctggacataatgtcagaccaagccacaggttaagggcttggtccccaagaatggcccccaaccagacactagtcacaagtccaggcctccagaacttttttttttttttttttaagactgagtctcgctctgtgacccgggctggagtgcagtgcgtgatctcggctcactgcaacctctgcttcccggattcaaactattctgctgcctcagcctcctgagtaactgggattacaggcgcccgccaccatgcccagctaatttttgtaatttttttactaaagagaaggttttgccatgttggccaggctggtctcgaactcctgacctcaagtgatctgcctgcctcggcctcccaaagtgctgggattacaggcatgagacgccatgcctagccaggcctccagaacttctgaccaaccagcttcaagttggggttcccacgaccccctctttgggttcgattaatttgctagtgcggctcacagaactcagggaaatagttaatgtttaccagttaactacagaggataccacaaaggatacagagaagagatgggcagggtgaggtaaggggcagggggtgtggagcttccatgccctccctgggcacgccacccttcaggaacctccacatgttcagccatccagaaggttcccaaaccctgtcctctcgggtttttatggaagatttgttacagaggcatgattgacaaccatgtagaaatgtgactggatgaaaagcacatgatctaaacccagcaaggcctgtctgttcagacttttcttggcctctatgcagcgttcctttctctagggcagaggtgtccaatcttttggtttccctgggtcacactggaagaagaattgtcgggccacacataaaatacaataacactaacgatagctgatgagctaaaaaaaaaaaaattgcaaaaaaatctcataatgttttaagaaagtttgcaaattggtgttgggccacattcaaagccatcccgggccacatgcggcctgtgggctgtgggttggacaagtttgctctagggtatggggcaggaccctctctgggatgaggatcttttaacccacaatcagattagagtcctaccttgggcaggtaaaaggagggcaggagaaggtcaaagagagaaagattctgtttcctgagacctaaagtgccccaacattataacaaggactagggaagttaggagccaggaaccatgggtgaaaaccaatgtatgtatcatagcaccacatcacctttacttccctgtatgtttaaaagcagctgattaactcaaatgactgtttcagttaatgcggctaaggtaggttgacaaaatgaagtcaagactcctacagcttgaagatgtttttaatcagtgagtgtttacttgaaagcaaaagagctagcctagaaccccttaaatgctttcacctgaatgcccactcttatttctcatgcagcagcccctggcctatgggcaactgaaagaacaggaaatgcacctcctcactggaggtttgaaggctaaggaactggggatgctctcattttaaaaagataggccgggcacagtggctcacacctgtaatcccggcactttgagaggctgaggcgggcagatcacttgagcccaggagtttgagaccaggctagccaacatggcgaaaccctatctctacaaaaaaaaaaaaaaaaaaaaaaaaaatagccaggcatggtggcgcacatctgtagtttcagctactcaggaggctgaggtgggaggatctcttgagcctgggaggtggatgttgcagtgagcccagatcatgccactgtacttctgcgtgggcgatagagtggccaccgcacccggcccagaactgggcactttgggaggccgagcggggtggatcacctgaggtcaggagttcgagaccagtctggccaacatggtgaaactccgtctctactaaaactacaaaaattagctgggcatggtggcgtgcgcctgttgtcccggctacttgtgaggctgaggcatgagaattgcttgaacctggggaacggaagttgaagtgagccgagatcgtgccactgcactccagcctggccaacaaagtgagactctgcctcaaaaaaaaaaaaacgtaattactgagatgctcgaagttatcatttgaagaaattttgttcctttttaagtttcaacagaactgaaagactgcactccagttggtatttaccaggtacttctgtgcatttacaccccacaggcaagccagtgttgacaattatgtagataaaagtagaaaatgctttaagtgggaaggacttgggatagatgtaaattaagaaagttaggcatctcttatagccaactagcatcatataaatatagaaaaatgtaaatgtattattcatgaatgcttatatagtactatagtaacttttcactttgtaaagtactttgaaatgctggaaaatatttcaagaactagtggagagaactctagcacaatccatagttgatttctctggcctttccccctattttctcccagatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtaagatggaccttttcaccttgtccaagaaaaggctatgttctctgaaattacaaatgtattgtatacctttgtgagccactaaatcagttttactgagatcaaggttatatggattcaacctacatagaggcaattagcttcattctattccatagccatacactccactcctaaactttggccagttacatccccgggaggggagtagaccagaaagtggaggtgactcagcaaactggtaagaatgcaattctaaccactctccatctgactgcagaaggagtattcagtgtacatacacattgatatgccatgagggcaactagggtagcaactgtgtcttctggggtctttgtaacctttgccagagctacacatttatggcccaattgcaaaatccagtagactttttccctttatctgaacttggttgcagcatttgataaggttgaccaccccttcttctggaaacttggcttccaggacccctccaagtcctgggtgtcttcccatctctctggcagctctttcttatctgacttatccggcccatctgggtcgtctgatactgccagcccctacatgttgctcttcccctgggctccttccttagctttctttttaccctcccctttagcttgcttctcatcctccaaaccctccctaggtggcctcatctatgctagtggcttaagcaagcgtcagtgtattctgtgacccttattctctacctctttagtaacaatggccaacttttggggggaagtacttaccatgttctgggtactgggccaaatgcattgcatgcgctttctcatgaggccttattttacagatgaggagatagatgcttcaggaagctaagtgacttgcccaagtccacatagatagaaagcaggagaaactagcaatagaactccagagccctctgttagcccctgactgacaccaattcccaatggtagtatgagtccctgctgttggacaccttcacctccatgctccctaggcacatcaaattcaagattaaccctgatgtcctcgttggtctcaaactagctcttcctcctgtgttccctaatgaatgagactaccttcctttcaccccgtggcccaagccagaaaaaaaagcctagggatcacttcaacttctcctctcactccacccccacttgaatcaccaagtcccgtcgatttgactcatcctctttcccacaggtccttacaactcagactctcagggtctcccacagactctggctcctacctgcttccactcttggtatctcctgccccagtcttccccgtgcactgctgcccggctgaggtgatctctccacgtgcaatttcatcgtttcacggccctcatttcactgctctccttaaaaagtattcagcgactcctgagctacaggagaaagcccaaattccttaggacattctagatccttcagacctggcccctgccagtttgtcctacctcatctcctgccatacctccacctgcattcatgctccagcccttcagaaaaacttggatttcctggaaataccactccctttatacatgctattccctttgcctttccactctgtcaaagtctgatgaactcctatttattcctcaagacccagttcaaaagttctctctttcatcaagtccctcctgactcccccaggcaaaattaatccctttgatccttgtgtacctaatgcatttcatatagcccccctgttgtggcacacatcaggggtgttatactgactttgccctggctgtctgttctcctcgatgatgagcatctccagaaattagcccgctcctctttcgattcccagcacctgacatagggcctggcacataacctaagctttccagacattttctgaatgaaggtaaatggaaggttggtgagccaattaaataaacattacatttttctaaagataagcaatttcacttgtattatcccctattttaaatttcattttgagggagaaatttagtccctctgtaaactaaagatggctcctaaaggttctggaagtttgtgaaagtgccacctactatattacttactcaccatctcagttcttagaaaggtgaggaagccacacagtgtagggtgcccactgggccatgatatgaccatgtcattcccaaaggtgaagtcaggtgacctccctcaccatcgagagtctctcactttccagttttcataaaatgtttccttctcagctagagatcagtccctcctgtcctccaaaacataatgaggtgctgcccactggctttttttacttgagtgattttttccccgaacattaaaaaaaagcttcaaacatctagaaaaattaaaagaaatctagagtatacatccatggaccatctagatgctacaattaacattttgctattcatccctccagccattcatcagtccatttttattttatttatttatttatttatttatttatttatttattttttgagacagaatcttgctctgtcacccaggctggagtgcagtggtgcaatctcggctcactgcaacgtctgcctcccaggttcaagcgattctcgtgcctcagcctcccaagtagctgagattacaggcacgcacctccacgcccagttactttttgtatttttagtagagatggagtttccgttttagtagagatggagtttagtagagacgaggtcaggctggtctcgaacccctgacttcaagtgatccgcccacctcggcctcccaaagtgctgggattacaggcgtgagttactgtactcagccagcccaccttttttttttttttaatgatttcagtgtaacttgcaaatatcaatacacttcacccctaaacccttcaacatgtgtgtcattaactagagttcaatatttgtgtatggttcttttttttgagatggagtttctctcttgtcacccatgctggggtgccgtggtgcgatctcagctcactgcaacctctgcctcctgggttcaagtgattcttctgtctcagtctcccaagtagctgggattacaggtgcccaacgccacacccagttactttttgtatttttagtagagatggggtttcaccatgttggccaggctggtctcaaactcctgacctcaggtgatcctcccgccttggcctcccaaagtgctgggattacaggcatgagccaccacgcccagccgtatggttgttttttaaagtacaatttacatccagtaaagtggacaaacctttagtgaaccatttgatgcattttgacaaatgacacaacccctaccaaaatatagcacattatcgcactcaagaaagttccctcatgctccttgggttggagggattttagcaaccccagagcccctcctgttttctttccccggaatccccccaggaatttatgttctcaagccagtgttttcccaagacagcagcagcttctccctggccttgttttgcaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggtgaggagttatcagagtggggtagggggtggaatgctttgtagtgtttgtggtcgggtaataacagcaaagaacactgaccccaagtgatgccaggtttccaaggagcttctgactgctcataaatactgtgcaaacccccactctgtggcatttctgctgctaacctcagagctgttggcttgagccccggctgcctcctcattcccatcctctgttttttggtcttttaagaagcctccaggctaggggcggtgattcacgcctgtaatcccagcactttgggagggcggaggcgggtggatcacttgaggtcaggagtccaagaccagcctggccaacatggtgaaaccccgcctctactaaacaaacaaaaattagctgggcgtggtggcaggcgcctgtaatcccagccactcagaaggctgaggcaggaggatcacttgaacttgagaggcagaggttgcagtgagctgagatcgcgccattgcactccagcctgggtgacacagaaagactatgtctcaaaaaaaagaaagaaaaataagaaagaaagaaaaaaaagaagcctccagatgaggcttctcttttctttcctgacttcctgattatatcacttgtggctctccttcctccaagaccagcagagagtagaatatgaaatgcagcctgctaatgctccctgtccttgctgcctccacagcaaggatgccactcttggtttcctcactgtgccttacctcagtgaagcagactggataggaccaacataagctaggaactgtagctaacaagggtccagcatccctgactccctcgctgaggaaggaactgcatttaaaatgtggcagcatcaggccgggcacggtggctcatgcctgtaatcccagcactttgggaggccgaggtgggcggatcccctgaggtcgggagttcgagaccagcctgaccaacatggagaaaccctgtctctactaaaaatacaaaattagctggttgtggtggcacatgcctgtaatcccagctactcgagaggctaaggcaggagaatcacttgaacccgggaggcagaggttgcagtgagccaagattgcaccattgcactccagcctgggcaacaagagcaaaactctgtctcaaaaaaaaaaaaaaaaaatgaggcggcatcttagtgagaccactgaggcaaaatcctagaatcagaagttccaaagtgagtaattgtcttagcctagaataagccaattttgatcaaagaaaaatcagactagttcaaataaggttgggtgggtaacagttatatctgtacagtgggggcaggcccagaatcctagcagggctgaggtgctgtatcttctcttagccctgctcaggcccttaaaattcaaaaatagctaatgcatgctggacttaatacccaggtgatgggttgataggtgcagcaaaccaccatggcacatgttcacctacgtaacaaacctgcacatcctgcacgtgtaccacagaactaaaaataaaaatttttaaaaaaattccacttccataggctaggctgtctccatggcctcttctgggcaaaccctgatttatacaagcaatatattcctgaagaactctatagaaattaatttggggtcagctgaatccaagtttaaatgagcagtcccagccaagtttggttttcccctgtgactctaacttgtcctcgcttgctcaatgtccctccccgctcccgctttccctctgtagtagtcccggctgccctgggccatcgcttacctcagcactaaacagcctgaaggtgcttatcaaagctgccactccactccctgaaacttcatctgtctgggttgcattcctttcctgtccttgtccaaacagataattgtcgcatcattgtaatggtagtataggtgcaaaatttttctattcgttggtaagaagtctttatatattaaagatattaaccctttgtcatacatttcacacaatttttccagtttgacatttggtgttttttttttttttgagagacagagtctcactctgacacccaggctggagtgcagtggcacaatctcagctcactgcaacctcctcctcctgggtttaagcgattcttctgcctcagcttcccaagagctgggactacaggcatgtgccactacacccagctaatttttgtatttttggtagagatggggtttcactatatgttgaccaggctggtctcgaactcctgagctcaagagatccacccgcctcagcctcccaaagtgctgggattataggcatgagccactgggcccagccaacatttggcttctagtgctatttatgtgttgttggtggtggtgctttgttgtacatatttgtagaattttatctaattatatctattacttttttgtttgtttgtttctgactttgcttttctgcttaaatgtaaagtctgcttagtgcatgcttatcttttttttttaagtatttctaattttaaaaataatgcacatttggaaggccaagatgggaggatcacttgagcccagtagtttgagaccagccttagcaacatagcgagaccttgtctctactaaaaataaaaaattacctgggcatggtggtgtgtacctgtggtcccagctacttgggagactgaagcaggaggattacttgggcccaagaggtcgaggtcacagtgagctataatcctgccaccgcattccagcctgggtgacagagagagaccctgtctcaaagaaaaaaaaaagtaatgcacatatactttaaaatggttaaaatggttcattttatgtatatttgaccacaatgaaaaaaaagtaatacacataagttgtagaaaatttgggacatacagaaaagtgcaaaaaggaaaataaattacccatagcccaacacccatggattataatgattaatagttttccttctatggaccttcatatatatacataaacacactcacacacatataaagatatataaggttatttcttttacaaaattgtgttcacactgtatataaaaattagtatccttaggccgggcgcggtggctcacggctgtaatcccagcactttggggggccgaggcgggtggatcacctgaggtcaggagtttgagaccagcccggccaacatggcgaaaccccgtctctactaaaaaatacaaaaattagctggtcatggtggcacatgcctgtaatcccagctacttgggaggctgaggtaagagaatcccctgaacctgggagatggaggttgcggtgagccgagattgcaccactgcactccagcctgggcgacagagcgagactccatctcaaaaaaaaaaaaaaaaaattagtatccttttttcacttattatataatgggtatttccctgggccattaagtatttaattatcaaataatattccaccatatggatgtgccaaaaatatgtaacaatttctcctttttttaatatttaggctttttctaattcttgagttatactaacattgtaatgaaaacctttgcattttttcatatctgtgatgatatccttaggctatattcctagaaattgacttataggtcacaaaatatgaacaattctaagactcttcatgaaatgtgcactccagaaaggttgtaagtttgtaattccaccagcactaaagcagtggctcagcttctaaactctcaatattcattgatattaattatcaatattaattgtcactttttaaatcattatgaacctaatagctgaaaaatagtatcccatcattttaattttaatttgattgattataagcaaggttgcactggccctttgtatttctttgtaagttttgtatttatgtccttgccctatttttctagaatattcaactttttctattcattggtaagaagtctttatatattaaagatattaaccctttgtcatacatttcatatatttttcccagtttgacatttggcttctaatgctgtttatgtgttggtggtggtggtgggtttttgttttgttttgtttttttagacagggtctcgctatgtcgcccaggctggagtgcagtagcagttcaagcatttctcctgcctcagcctcccaagtagctgggattacaggcacctgccaccatgcctggctaatttttgtatttttgatagagacacggtttcagcatgttggccgggctggagtggtgatgttttgttgtacatatttttagaattttatctaattatatctattagtattatcttctgtttctgactttgcttttgtgcttaaaaggcctattctatcccatgatcctatgactattcacttatatgttatttaaatacttttttagttgtgatttttacacttggcttcttttttttttgagacagggtctcactactgcccaggctggagtgcagtggtgcgatctcagctcactgtagcctcgacttcccaggctcaggtgattctctcacctcagcctcctgagtagctgggactacaggcatgcaccaccacacccagctaattttttttttttttttttttttttgagacggagtcaggctctgttgccaggctgaagtgcagttgcaccatctcggctcactgcaacctccatctccctggttcaagcaattctcttgcctcagcctcctgagtagctgggactacaggcacgtgccaccacacccagctaaatttttttttgtatttttagcagagacggggtttcaccaagttggccaggatggtctcaatctcttgacctcgtgatccgcctgccttggcctcccaaagtgctgggattacaggggtgagccgccgtgcctggccatcatacccagctaatttttgtattttttgtagagacagagacttgccatgttgcccaggctggtatcaaactcctggactcaagcaatcctacccatctcaaactcccaaagtgctgggattacaggcatgagccactgtgcccagccttacacttaacattttaatacatttagaatttacctggtgtggcagggtgcagtggcttgtacctgtaatcccagcactttgggaggccaaggtgggcggatcacctgaggtcaggagttcgagaccagccgggccaacgtggtgaaaccctgtctctactaaaaatgcaaaaattagccgggtgtggtggtgcgtgcctgtagtcccagctactcaggaggctgaggcaagagaatcacttgaactcaggagatggaggttgcagtgagctgagatcatcccattgcactccagcctgggcaacagagcaagactcagtctcaaaaaaaaaaaaaaatttacctggtgcacaggtgccgtgactcctgcctgtaatcccagcactttgggagtttgagataggtaggatcacttgaggctaggagttcgagaccagctggccaacatggtgagacccgtctccataaaaaatacaaaaattaactgggcacacctgtaactggtgcacacctgtagtcccagctacttgggagactgaggagggaggatcacttgagccctggaggtagaggctgcggtgagccgtatttgtgccaccacactccagcctgggtgacagagcaagaccctatctcaaaaaaaaaaaaaaaaaaaagaattttcctggtgcatgatatgaaacagtcatctaagttttttttttaatagtttaccaattgtttaagcaccattttttgaataattcttttctccactactttgtgctgcagctttcaccacatactaaatgtttatatctattctagggtctctatcttaatgaccataactttagaaaaatgccttttttttttttaatttttttgaaatggagtctcgctctgtcgcccatgctggagtgcagtggcgtgatctcagctcactgtaacctccgcctcccaggttaaagcgattctcctgcctcagcctcccgagtagctaggactgcaggcatgtgccaccacgcccggctaagtttttgtatttttagtagagacaaggtttcaccatgttagccaggctggtctcgaactcctggcctcatgatctgcccgctttggcctcccaaagtgctgggattacaggcgtgagccaccgtccccggccaaaaaacaccttttaatgtctagtggaatatagccctcctcattgtttttcttttcaacatttccttgattattttcgggcatttgttcttcctgataactttagaattaccttgtgattatgattggaattatgtaaaacccatacacttggagtaatttatgtaaaatatttcatcttttattcagagacacagtatgtctctcctttactttcaatcttctttctttagcttgaaccagatgaaattaccaatattcaactttgttgacatcattcaaacagcaatttcatctggttcaaaccttagaaaagttgttttcttcaaagggaaattatgctctctctaaacaaacaaaaaaatagtttctcttaaaaaatctggggagaagtagggtaggaaagaagtatgatatactgtaagtgttttattcattttttaaaaatcctggtcctaagaatttctcactgccaggggcatctctccagcactttcagccacttcatgcctagttcaaggcttcgccagcttagcttcctccccatagtgggccagtccaaaacaaccagggccttgagcctcaaggggtagggctagtccgtgaaaaagggtttcaggccaggtgcggtggctcacatctgtaatcccagcactttgggaagccgaggcgggtggatcacctgaggtcaggagttcaagaccaacctgaccaacatgatgaaaccccatctctactgaaaatacaaaaaaaaaaaaattacccaggtgtgttggcacgtgcctgtagtcccagctactcaggaggctgagagaggagaatcacttaaacctgggaggcggaggttgcagtgagctgagattgtgccaccacactccagcctgggtgacagagcgagactctgtctcaaaaaaaagagaaaagaaaagaaaaaggtttcagatgaagttcaatgacatctaaatgggacgggtaagggtcccagtcttccccataaaccttagttttgctttctcttcctgagagctagaacagtgacctcatctgggagaatccagccaacaccgcattctacaccatctgcattctatacccctaccacaacaacccactataaactggggtaagatacactagaagtgggtatttgggggtaatcctgatcatctttttcctcgtatgggagccttccaaataatgcatatatagagcataagaagaagtttcaaatagatgcaaagtcatgatggttgtaaaaaaaaaaaaaaaatccaaagaggtaattgcactgttttcacaaaataggatcaacatgtaattatgaataacaatataaatgtcatccaaagatataggaagtgaacttttagggtttcagtgaaagtgttattttgcaggggttaataaacatactaatactttgtccaccctatgttaaaaaaaaaattcacccccaagacagaactgcaggctgcttttaaatgcaaacatggcattgggcttctctggccattagatgtcactgcagtaaatggagagtagctgagcatcacctgattggagcctgaagttcggtgatctctgtccagttaacaacttcataatccctgcttgaaatccatctttggtttggagaataagaggcctagaaaccacaggctaatgctaaacttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcaggcctgtgcacacatggaatgaggtgcccccaacttggtgtgctttcacggaccccaaccaccctgcctgaaatccccttctccacgcttcagtgcatcttagctcaagcccttccaggtatagcctggcctttttgtctatctcccacacctagcccagggcctgggccagaagagatggcagaacttagtgtattgagagaacaagtaggaagggtaaaatattgacagagatgaattcatctgattaatctgtgcaccccgaataagaaccagggagtcctgagaaaatggctctctgcacaggtgcatgtgaagaagagagggagataggctggggaatactgccctgaaaatccagggagcagctgagaatgtaggagccttggaatctggcaggccttctgaaaggatcaggagggaggtaccagacacatgctcggtccccccacaactctgcctgacaccctcccctattgcccatattaggtgtctccatttcatcaaatataaaaccaagtgtgagcctgttgctttataccccagtggactttgaccccatcacagctcacaaggtaagcaggattgggccaggtcagcatttgaactgaaagcacataagatgaaggacaaaggtggtatccgagtggtacagctgactgagcagaatatacatggtcagtgaataaacagaggccccagcctactcaaatagagatgctcgacacctcgggttacctttgttgaattggacacagtcacttcattcattccctctcagggtgctcatcccctcttgtagtttttcatgttcatatctacatcttcaatcctgacctcccttctgagccatggtcccacatttcccacagcctgctcgacatcactatttggctatcatatccccactgtcacctctaacttaatgtgcatcaagctgacctcttcttttcctaacactgttattccagagttttccatttcaattccatcattgccccagtgactcaggctggaaatccacaacttgtgtttgactcttccccttcccctcacccggttaaccttgagccctgttgcttcttcattcctaacattcccatgctggtctttctttttgtcactgcctcttgccctaatcttggaccttatcagctcatacctaggctattacagtaatctcctcattggtctccaggattaattctaaaaatgatcttaagcattgaatattaatatgtactaggcactgtgctaagtgctttatgttcattatctcatttaatccttacaacagccctacaaggtgggcactgttattattaagtccattttacagatgagaaaactgaggcaccgaaaggttttgtagcctgcaagttcacccatccagtaattgagctgggatataagcccagggagcttgtctccagagtcagtgctcatttcaatcctctccagcccagcccatatgggattctgtcagatgaatctttctcagatctgtctgcgttagatccttttttttttttttttttctttttgtgagacagggtcttgctctctctcccaggctggagtgcagtggcacaatcacagctcattgtagcctcaacctcccgggcccaagcaatccttccacctcagcctcccaagtagctgggaccacaggcatgcgccacctatgcctgactaatattttaaatgttttgtagagatgaggtctcctggtctccttatgttgcctaggctggtctcaaactcctgggctcaagccatcctcccgctttgacctcccaaagtggtgggattacaggcatgagccactgtactcagcctgttgttgtgtccttcttgatggtccccagagaaaaaaggctgagccccttggcttggcatgtttcccttaccaactgtgcgatccttgttgcacagaggccctttatataagaagttacaaaaacaaatgcctgcagaaacttggaagtaacatgaaaaagagaatgtagggaaacccagataacatacactcaccctgtaaagaataagccttcaggctgggcctggtggcccacgtctgtaatcccaccactttgggaagccaaggtgggtggatcacttgaggtcaggagttcaagaccagcctggtcaacataatgaaaccccgtctctactaaaacacacacaaaaaaattagctgggcatcatggcaggtgcctgtagtcccagctactcaggaggctgaggcgggaggatcgcttgaacctaggaggtggaggttgcagtgagttgagattgtgccactgcactccagcctcggtgacagagcgaaacttcatctcaaaaaaaaaaaaaaaaaaaaaaaaaaaaagccttcaaatgcattccgagccatcatggctttcaaaagcattctggagagctaaacttcactgtgctcacaaaatgtgatttgcatctaaatatggatgacagaaaggaagaaagagagccagtagaggctgtggccagttcctcctctccaaaggacggatgccatttagaaatgtaggcccagttttcaaaggagtctaaaatccagatttttatgtaaaatctcccagtttttcactgctggcaaatgaaaattgttaagtactggctgggctaaacaaaacacacattcgtatgacctctgctctattcaagcctccaagttcatcaaactaatcttcttagccccttctcccaagccctgaagactaagtgcatttcacattccagtcaccaggcctttgttcatgaggttacctctgtcttggaacatctgcccaattttcttaaaggctcaactgaggtttgtctcagtgatggctgtcttttctgacctactgtagcacatacctgttgtttaagaaatgagttggcttttcccatccccaaaacagctgtcctatcttgatggatcaaggtagatgttttgcctttgtagaaccacaatggaggtgctccagcccacttcagaggggattctggggcaagagaagctgagttaactaacaatctactcagttaataactgcagatgccgtattttcactgtcccccacccaacccccaagggcatagttattttgttctaagagctttgtgggtgaataccacccaccccctttttatttttgagacaagagtctcgctctgtcacccaggctggagtgcagtggtgcaatctcggctcactgcaacctccgcctcctgggttcaagtgattctcctgcctcagcctcccgagtagctgggactacaggcatgcactaccacacccagctaattttgtatttttagtagagatggggtttcaccatgttgcccaggctggtctcgaactcctgacctctggtgatccacccgcctcagcctcccaaactgctgggattacaggcatgagccaccgtgcccggccaaataaccccttttaaatgatgctgttagcctatacgtgccctctgatccagccagtttcttttccatggcatttctgtccatgccctacctcttcccatcttaacactattgccctgctgttccctcactatcaaagccgcctcctgaagtcttctcccatctccccaagcagtagtctcccgctcctgaatggctcactcttgctagagctgtcttatggcccatgccacatgcttccttttgttataatcttttgtgtcccttatttcctctagattgcaaactctttgcctgtgggaagtatgtcttacacatttgtatatcctcacaacacacagcctcatgtagcagacatctaatacttgtttaaaaatgaagtttagggacagcttaggagatctcgctgtctgctaggtgagtcccaagtccgtgtggttgtacctacccaagatgaaggtaagaacacccaagcctgcctcctgctcaacctgctgccctaagaaaacctctgcatgtcccctgtctaaaactgtctatgcacttcgctctgagaatgcactgtcttccatctcctaccctagcaatcaggttctatgcatctcagtgcaaacagccgttaacgtttcaggatagacaaatatgctaaaaggacaaaaggaaaaattcttgacaccattttgatttacacctcctcttcattccagcctcctggcgctttgtatggtggctggaagtgcttgacaaatcatagcaccatcaaatttatacagtcgtccctaggtgtctgcaggccattggttgcagaatccctctctgataccaaaatccactcatttctcagccctgaagtcggccctgtgaaacctgtggacacaaaaagttggccctccttatacacaagtcccgcatcccaaatttgattgtggatgcagaacccacagaaacagagggccgactgtatttattgaaaaaaatccacatataagtgaaccagcacaactcaaatccatgttgttcaaaggtcaactgtaggccgggcgcagtggcccacgcctgtaatcaccacactttgggaggctgaggcaggccgatcaacggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagtactcttagtactcctattttatagatgaggaaacaaggcacaaggtgtaagtcacttacccaaccatcacatagctagtaagtaagtggcgaagctgggacttgaacctatgtctctccttcctcaggccctttttttattcaccaagagtacaggagcctaatcctgtaggcaagggaactggatcattttgactttagttcccttgccccaggtgtgggactagaggatgagggagcgggaaagcaaaccttgatattgggagtccacagcctcagtgcaagagttgagaaaatcaatactttgcaagctcagaaactgagaggccatagccttgtcttaatccgttcaggctgcaataacaaaatatcataaactagatggcttataaacaaccaaaatgtatttctcaccgttctggagactgagaagtccaaggtcaaggcagatttgatacctggcgaaggccagcttcctagagccttcttgctttgccctcacatggtggaagggggagctagctttcttccatctcttttaaaaggacccgaatcccattcatgagagctttgccttcatggcctaatcacctcccaaaggccctgcctcctaaaaccatcaccctaggagtcaggatttcaacagatgaattttgggaggacacaaacactcagagcataacgagcctggctttggccagggaatggttaactcaagttagagagaggaaaaaaaaaaaatctttggaaaactgggctgtcctggggtctgctttagtccctggcagtctggcaatggaaagccctacttgttgctttgacttgagaagccgtaatgagcagtgagccacaggcatagaccattcagtagacacaggtctttggccagccttgaacgacaactgctcagagggactgggaagaaagcccgcctaccacagggggcagggctgggagcagaagcaaagccccaggatgggagagtaaattgttataactatccctgcgaggaggtgctaacaaagttccaggttttctgcctacttcaatatttcccggttggcatagcatctactcttagtaggaacagagttctatttgcctaacagagtcaaattacctgtccagaggtacaaacactgctaggttctaagccttcagggtagtggagaggagtggagccttacctttagtttgttgtattttcaactctctgctgtcatcttacttttaggtctggcccctttgtgaaccaaattcttctaactgagtagcattgcgttagcagtcagaaaaaaaaaaaaaaaagatgcttttcaaatataggtagatgtctggacatcccttaggcaaggtggctctgtatgagcgtcactattaaagtgaaaggaaaggaaaagtctccccacccttgtttttttttcaaaaggtatagagtgcccgaaatactttagggatggcagctgttgagcatggaaacaagacttgtccctagagggaaggcaaggaaggcatggggaagagccttcctaactccacttagtgtaaaatcactctgtcctcttcccctgacctgagctggcttattccttggaagagataaagatctgggagtcaaaatgaccaccctgtgctgagcaggcttctttgaactccagctaaacggtaacagcacctaagataggatgttcccaccctcactccccacctcaaagtggaggtgaagagggagataagggaaagggagagaaaggtcccaggaaaggtctgctgtcaagagggaggacccgcagctggctgggagcattcacaggaagtaccaattttcacctccttttttccacagagctgttgcttatttgcctacgacggctgtgttcctcttgaggctgtaatgggcagactagctcagtgggtaacagtgtgagctttggatcccagccttgccacttactcccgcgtgaacttgtgtacaccacataacccatctgagcctcatcttcctcatctgttttgagggtaagaatggtgcctacctcatctacttgcagcaaagactaaattcgtttagtgcaaatgcagagccaggcccataataagtactgtcaataatgctaagatgccatgtttattgttcttgaagcatcacttcagaatctgtgcacagcatggaaggcctgattagaaccataaaaaccagtccaaggccgggcgcggcgactcacgcctgtaatcccagcactttgggaggccgaggtgggtggatcacttgaggccaggagttccagaccagcctggccaacacgacgaaaccccgtctctaataaaaattaaaaaattagctgggcatggtggcgcgcgcccgtagtcccagctactcaataggctgaggcatgataatcacttgaaccaaggaggcagaggttacagtgagccgagattgcaccactccagcctgggcgacagagtgaaactctatttaaaaaaaaaaaaaagccagtccagatgtgtttccatgtttcctatgattactataaacacacaaatgagctgggctcacagaacctcaatagaccttggatatgtatagctaatgatgagcagcgacaggaatcgagagttcgtacagaattttttggtttggttagcgtaacaacaggctttacagacaggctccatgtgcaagcactgcacacctctgtatgttctcagccttctgagaactgtcactgccaaatcttttccttcaccctccccaccctatctcacccccaggcaaggtgacactttcaaagttggcacggcaggcagcacatgccaggcctgtgacccaggcctcagcagctctgctcacttgcatggcaattgctttctacagtcaggcccagctgcactttgggtctccccaacccccacccccaatcaccacacaggaactggctgtttctcttttcttcgtccaagctgaatactaacctactgtggtttgcttgcttcccccattgtgatcgcaggctttctgagcagctagtcaaccctctagcctgccactgaatcggaaggcattcacactggaggggatcaaggggagcttgtaggcttgccttgctggcgggcagctgcctacacccactcgtaccaatgtccccgctgcagagcccgggtgcttcccagctgtacaaggacaactatttgggtcccggctatgccaagagaaacatgggtcatgtggttcacaggacagaaaggttcatttactccaatatgactggcatttttttttgtttgattattggatatttgccaaaagactgaagcctcctgccacaaccacctcccccacatatatgtcctcagatggtttgggaattggacagcttagtcatcaggtcctgtcctccacatccacagaagatacaagttgtttccagataacatgcagaaggttctgagctccttcctgtgtgctccagctcgaagactcttttcttttccctatgaattttttttccttttctttctctggtctttcctttttaatgcccttttaaaattaagtattctatcttttgagtgggtaacacatacacatgatacaaaatccaaaaggtgcaacgagtatatgctgaaaagtaaacctctctaacctttgtccttagccattcagctctcctgtgagtcagtactgttgttagcagtttacctgtatctttccaaagatggtctatgcaaagatccacataaacttgtacatttatgttctgtttttaggtcagcagcagcacactacatacactcttctgtgccctgttttttttccacctgaaaatgtatctcggctgggcacggtggctcacgcctgcaatcccagcactttgggaggccgaggcaggtggatcacttgaggtcaggagttcaagaccagtctggccaacatggtgaaaccctgtctctactaaaaatatgaaaattagctgagcgtggtggtgggcacctgtaattctagctactcaggaggctgaggcggaggaatcacttgaacctgggaggcagaggttgcagtgagccgagatcacaccattgcactccagcctgggtgataagagtgaaactgtctcaaaaaaaaaaatgtatcttggaaatgataccacatcaatccagataaagctgccacatatttttcatttatgacatagtattcaacggtatgatatactatttatttaactagtccctgattggtggacatttagattatttccagtcttctgctagtactaacaatgctgtaacaaatctccttgttacatacatttttcacgcacatgcaaatagatctgtaggataaaaaggggtccccaacccctggtccgtggcctgttaggaacctggctgggccacacagcgtgaagtgagtggccagcgagtgagcattatggcctgagccccgcctcctgtcagatcagcggcggcattagattctcatagcagtgcaaaccctattgtgagctgtgcgtgcaagggacctgggttgcacactccttatgagaatctaatgcctgatgatctgagatggaacagtttcatcccaaaaccattccccccaaccccttgtccgtggaaaaatggtcctcggcaaaaccagtccctggtgccaaaaaggttagggactgctgggctaaattcctagaatttttgctttggtcaaagggcatatgtgtcttacatcttttttttttttttttgagatggagtcgccaggctgaagtgcagtggcgcaatttcagctcactgcaacctccacctcctaggttcaagcgattctcctgcctcaccctcccgagtagctgggagtacaggcacacgccaccatgcccagctaatttttgtattttcagtagagacagggtttcaccatgttggccaggatggtctccatctcctgacctcatgatccgcctgcctcggcctcccaaagtgctgggattacaggcgtgagctgccgtgcccagctgtgttttacatctttataaatattgttcagttatttcagtactcatggaaagactgaacaaccaaaacgttgcctctgttggaagacctctgaggaatttatcacaggaataatcaagtgctttgcttttaagtctttgttctttatttgtatctactgcaagtttgttatttctttccttcaatatgtattaaacacctcgacctctaccatgcaccaggtaagctttgaggccaaaaccataaacacaacaaatgtggttgctgcccccacagtatttacagtctaggagatggagcagttgggggcaggagtacacatgaacgaaataattatacactgagtcattacaaactgtgttaagtgccatgaaggagaagcacagggtgactgaaagtgttcagtaggctcctgacttcgtgtggaggtctcagaagatttccctggggaaatgatgtttattctgatcaataagacagacttagtgaggccgaggaaatggcaggtttgaagtcctagaggaaggcaggagcaaggattctggccagcagcatggattacaggatctggaaagggtcttcaaggacattttgtttcagtctcctcatttgacatgtgagaaaactaaagtttagggagctaaatgacttgaccagggttatacagatagtaacaaagtcaggctgcagaatccagtgtgctcatcctgggagctgtgggtctgaactagacagctatgggatagttgcctgggtttgtgtagaaggacttaagttcaggttcttgtgacaagctgcgtgacatgtttcatttctctttactagtaagatacagtttggatgaatggccattccaatctagcgggttggtttgttcttcagcatacttgtctttcttacaagtttaaataataataacaatggtggttaattctttagcgcttgctctatgtcaaatacagttctaagcaacttacatgtattaaatcatttcattttgacagcagttcttaaagttggtgttattattattaccccattttacagatgaggaaattgaagctccagaaggtaaaggcacttgccaaccatcacagagctagtgagtggcaaagcagggggaccgagtccaaacagtctggcttcagggcccatgtgctttgtctcccaggcactctcagtgtcagcagcaggctgatggactcaggtttgagcccagagctgccttgtgccatggaaggtccaatcagtggctctcaaccctggctgcacatcagaatcagctggggagcttgtaaaaagtgctaatgtccaggcctcgcccccgttcagttaaattgcaatctctaggggtggatcccagtcactgagggtttttaaaagcttccgtggtcagcctaatgcagctaacggttgagatgtactgggatctaggcttgccattgctttgccctttgggagcaaccagcaccccatacttgcctttgtgttctggacacccacttagtaggacacttgtagaggcacttattcataccacagcacaggctcctgtctcagcctaaagaactcattcagtgtacatgctttggcagccacatccaccagtgatgtgcggtaacaagtctgtaaagggctaagagaatattttcagtcctgagcgtcagaagacagtggagcttagtggagtggagcttggctctgagtcaaacagacccagattcaagttgatgctttgtgtcatggtctgtgattttagagactggcgtttatcctctcaccaactccattttgtcatccatataatcaagctaatacgataatactacctctttcatgaggcttttgtgaggattaaatgagatagtatatagaaagcaatcagtgggccaggcgcagtggctcatgcctgtaatcccagcactttgggaggccgaggtaggcagatcacctgtggtcaggagtccaagaccagcctggccaacatggtgaaaccccatctctactaagaaaaattagccaggcttggtggcagtcacctgtaatcccagctactcaagaggctgaggcaggagaatcgcttgaacctgggaggtggaggttgcagtaagccaagatcgtgccactgcacttcagcccggaagacagtgagactgtgtctccaacagaaaaaaaaaaaagaaaagaaaagaaagaggaaaaaaaagaaagaaagaagaaaaagaaagcactcagtgctaggccatgtctttatttcatgactatccacgtagcttatgtgagtaaacagctatatttgggaaaagctactagtgacactgatattgacaggaatttgatttgacatttaataagtgcctggtatgtacaatgaagagtgaaagatcctgaagagcttggatgactaggaaggccccgtgcctgctgactggcttgctggctgggagggagcataaagacacccagataactcatataaggtagagtgtgccgcagcagaggtctaaacgagaagctaagggaggccaggggcggtggctcatgcttgtaattccagcgctttgggaggctgaggcaggtggatcacttgaggttaggagttcgagaccagcctggccaacatggtgaaatcccatctctactaaaaatacaaaacagctggacatggtggcaggcacctatagtcccagctacttgggaggctgaggcaggagaatcacttgaacccgggaatggggaggttgtagtgagccgagatcgctccaaaaaaaaaaaaagctaagggagcacaagatatggagagagaaagccccaattcaaacagaagctggaaaacaattataaaataaccaaggaaatatgaatactaactgaactcaatatgtgatgatattaaggaattataaatttttaggtgtgataacggtattatacatatatttttgaggagcaattatagtttagataaacataattctaattaataatatgtaagtcagatgaattgaaatgatgtctcgtgggggtagagatgaaagaagattggccacgtatagctaattgttgaagttgggtgatggaactttgtgttcattttactggcctctctacttttatatatggttgagatttttcacaataaaaagttttaaaaagagggccgggcacagtggctcatgcctataatgccagcactttgggaggccaaggcaggcagatcacttgaggccaggatttcgagaccagcctggccaacatcgtgaaaccctgtctctactaaaaatacaaaaattagctgggcgtggtggcacacacctctaatcccagctacttggaggctggggcaggagaatcacttgaacctgggagacagaggttgcagtaagccaagatcgtgccactgcactccagcctcagtgacagagcgagattccataaaaaaaaaaaaaaaaaaaaactttttaaaagaggtaaagttgtggccaggtacagtggctcacgcctgtaatcccagcactttgggaggctgaggcaggtggatcacaaggtcaagagttcaaaaccagcctggccaagatggtgaatccccatctctactaaaaatacaaaaaaaatagccggttgtctgtaatcccagctactcgggaggctgaggcagagaattgtttgaacccgggaggcagaggttgcagtgagccgagattgcaccactgcactccagcctgggcaacagagcgaaactccgtctcaaaaaataaaaataaaagagagaggtaaagttgaagaaaaggaaggaaacaagcagtacacaattgtggaatctggaaaattttcaggatgaggtggcatctgacttgggcatgggtgactagggagagttgatgtcgcagtttaaatctgaagggagtctgctggcagaatctcctcttccttgaggggcttcagtcttttttcttttaaggccctcactgattggaggaggcccactcacattatggacaggaatttgttttactcaaagtctactgatttaaatgtcaaactcatcttaaacatgcctttacagcaacatctagactagtgtttttcccaaatagctgggtactgtggcctaaccaagttgacatatgaaattaatcatcacagggtggcagtgggaaatgatactaggaaaaccggtaggggccaaattgtaaagggttttgaattctgttaaaattgtctttagtaaacttctttggaaaatttttcttctcaaaatgttttcgttagaaaattgggaattgttgaaggcttctgagcaaagcaatggtaacatctgatgagtttggaagggtacttggctgcaatgtggaggatgagttggagagggcagagactgaaggtcaaatgatgggtaaggaaactgacccttgcttaagagagatgatgtgaggtactgggagtagagctgaaaagtatccaaagcatagaatataatgcaggtagcagcaagagatcaggctgagcagtaggcagaggccaggtcatggagcacctggtaagccagattaaagagcctggagtttatcctgatgataatgggggacccactgaagagttgaagtcaagggagtaacctgattaaatcgctctgactgctagatggggaataagggcaggtagaccagctagtaacagttgtagtagtgtgggcaaaagatgatggtggcttggactagggtgagagtggaaagaaagaaaagtaaacaaatttgggacatgtttggagccactggaacttggttagtgatggattagatcagagaaaggtgagagacagagaaaacttaaaggtgactcaggttttgggcctgagcaagtaggttgatgacagtgccatttgctgacatgaggaaaactagaggacagtcaggattggagtggagcaaaatcaagagttctgattaggacatataaagtttcagatgttcagtagacttctgagtagcaatgtcaagtagctagttgattacatgatcctgtggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgttaaaaaaaaaaaaaaattttgagacagagtccgctgcgacgtccaggttggagtggaatggcgtgatctcggctcacttcttcctgggttcaagccatctctgcttcctgggttcaagccattctcgtgcttcagcctcccgagtagctgggactacaggcatgcgccaccacgcctggctaatttttgtatttttagtagaaatggggtttcaccatattggccaggctggtctcaaactcccaacctcaagttatctgcccacctcggcctcccaaaatgctgggattacaggcgtgagccactgcacccaacttaaaaaatatttttttaaaaaaagaaaaaaatcggtgggcagagcagatcatataggaccttgtagcctacgagcatgctggaaccacttcctactggctcaggagaactgactgttaaatttcaggaaatttgggagctggtcgacttcgcatttggcagcctgaaatcagccatagtgggagtactgatgctgttgaaattggtaaatgctacaattcagcccttttttattttcccccagagaaccagttgttaaactttgccaccatattagtactatggcttgtaggctccagtaagaaatttagattttattcttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcataattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagcatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccacatttcttggaggctttgctcatttctttttattcttttttctctaaacttcccttctcgcttcatttcattcatttcatcttccattggtgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagactgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtcgtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccgctttgttttctttttcatctcagtttttgaggataagaatgctttgttttaaaagggatcatctgtgtctttttaaaagcttactgaattttcctggtgtgaattatttgcacgtactcatttttgtggttgatttggattttacagtgattaagattttacagtacctgctccaccgggcccagatcctgcttcccagatcttcctgggaagcaccaagaaatttagattttattctaagtgtgatgtaaagtcattaaaatgttttaagcaggtgagtaaaaggatctgatttttaaaaatcactgtacgtggccaggcgcagtggctcacgcctgtaatcccagcactttgggaggccgaggcaggtggatcacatgaagtcaggagttcaagaccagctgggcaacatggtgaaaccccgtctgtactaacatacaaaaaaattagccaggcctggtggtgcacacctgtaatcccagctactcaggaagctgaggcaggagaatcgcttgaacccgggagacggaggttgcaatgagccgagattgcgccgctgcactccagcctgggtgacagagcgagactccatctcaaaaaataataataataatacatcactgtacaagaatggactcccagtgggagaaggcaagatcgctaaggaaactgctgcaacaatccacatgcgcagtggtgccttggcagtgcaggtaagagttcagtcaagaaatttggaagattgttaacatcctaagactggatatagatggaccttgatttatcacaagttgattataattgacctgttatgtaattcgtgttacttagtgtctttttgttttagttgtggggagcaccagattacagaatgattaccttgactcatgacccagggctctttacaattcttaccagaaactggcagatgataaatcagtcatcttatttggtagcaaaataaggaggttactttcctgcatgaacataaatttcctcttttcaatatttcagtcttacattagcaggaggaacttgaagtcttgtgattaggcagattctttgtaagggaaaaggcagcttactatccttttggtaacagttctttactgatagggtaagaaggaaaggaggttgagtccgaacaatgctaaaggaaacactttaaagtaagacatccactgaagacccctagccattttgcctactgtaaaatagaaccatctacaatgtcttgtgaagagagaaatgaaatgaattttgatatttgttttctgcaaagattctacattacattgtgtaagtcttgacccacgatttttataactcatgcataaaattatgtgcaaatgctttaaaaattccagcccactcttatactgagcattttatgtactcattcagcaaaccattcattgagcaccagtcatgtgtcagctgctgcttaaggcactagagatacgaaaattaaaaagacccagtcctcacagagttcacagaacactaggaaaaatagacatgtaaattggacatgattacagtacaattgtgaaagaggtctctttgaaagagttgtctgtatttatttaccatctccagtctttcttttcccattctctctctttttttttttttttttttttgagacagaatctcactctgtcacccaggctggagtgcagtggcacaatcttggctcactgcaacctccacctcccaggttcaagcgattctcatgcctcagcctcccgagtggccgggattacaggcatctgccaccatgcccggctaatttttgtatttttagcagagacagggttttgccatgttggcaaggctggtttcgaactcctgacctcaggtgatctacttcccttggcttcccaaagtgctagaattaacaggtgtgagccaccgcgcccagcccccattctctattctctctctctctctcttttttttttttttttttgagacagagtcttactctgttgcccaggctggagtgcagtggcacaatctcagctcactgcaacctccgcctcccgggttcaagcaattctcctgcctcagcctcccaagtagctgggattacaaccaggctgggagattcagcttgtccatttcatgttctgtttctcacaatcatctgtgtttgcttgtcactgcactttaaagagaaggcataactcaaaagtttcacccttcaacttgatggagaattattttttatttatttatttatttatttatttatttttatttttttgaaacagggtttttctctgttgcccaggctggattgccgtggtgcaatctcggctcactgcagcctcaacttcctgggctcggtcgatcctcctgcctcaggatctactccctcctgagtagctgggactacaggtacatgccatcatgcccggctaatttttttttcttttgtagagatgaggtttcgtcatgttgcccaggctggtcttggactcctgggatcaagcgatctgccagcctcagcctcccaaagtgctggaattacaggcatgagccactgcacccagccattctatatttttaaagcatagaatattgattctttgagctggattaatgaggaaagatataacaatcattaatataaaataaagaattgtgaaacctcattaatttgcatgccactaacctaaaattgtaataacccagggcttagtaagcaaattagtcatataaacagcataactatagggatatttaaactgtttaccaaaagaagctgcttttaaagcctgctgaagtacttatttattactaataatgtctaatattattgacacttataatgttgctggcactcttcattgtcttatttaatttccatagcaactctaagagctaggtattatcactcccatttttgaaataaagaaattgaggccaggcgcagtggctcatgcctgtaatcccagcactttgggaggccgaggtgggtggatcacgaggtcgagagatcgagatcaccctgaccaacatggtgaaaccccatctctactaaaaatacaaaaaaagccaggcatggtggcaggcacctgtaatcccagctacttgggaggctgaggcaggagaatcacttgaacccaggaggcggaagttgcagtgagccaagatcgtggcattgcactccagcctgggcaaaaagagtgaaactgtgtctcaaaaaaaaaaaaaaaagaagaaattgaagctcagagaagttaaggaactcactgggtgcagtggctcacgcctgtaatcccagcactttggcaggccgaggtgggtggctcacttgaggtcaggagtttgagaccagcctggccaacatggcaaaaccctgtctctacgaaaaatacaaaaattagccaggcgatgtggcacgtgcctgtaatcccagctactcaggaggttgaggcacaagaatcgcttgaaactgggaggcagaggttgcagtgagccaagatcatgccactgcactgcagcagcctgggtgacagagtaagaccctgtctccaaaaaaaaaaaaaaaaaaaaaaaaaaaggaacttgcttaagatcaaaaatagctaatgagtagaagagacaagggttccaatccaggtctgtgtgatgctgaagcccacaggcagaagattcgcactctacctaggcttccacagatcactcaaccatgcatgaaagtaaggcctgaaaagtgtctctactaggttgcccttcattaatctagttccagtcatgtataataaaatggagtgtctttccaaaatttcataatttagatttcactcatttaggccgacttcccccctatacatacccactagttggaattagttgccttttactatatgctgtattgaatgtccttatagttgggggtcatgagaaaagctaaagtctaacttggacaagatgacgactggcattgccagggttgtgcagcaacagtagtggggtggggtgtcctgcaaggacatgagttaggtggctgttaggggcagcataagttgtagtgtaaagccttggagcctagatgccaaggtcgcagagtcaccaggaggcaggatcctggagtacagattgcagtggcccagtaggcacagcatctggcctctaggtctgcctctgctatgcaccagctgggggctttggttaagttgctctgcttctccaggtcataggtttttgtttgtgaaacgaataattggaagggaagatcttagggtccatttcagattggggtctctggtttagggatctgcgttatcagagtctaaagtaatcaagtccttggagatctagtaatcagaaggagagcaagaaagagccagctttcattgtcaggggcaacaaagaggtggctcatgcccataatcccagcactttgggaggccgaggcaggaggatcacctgaggtcaagagtttgaggccagcctggccaacatggtgaaaccccacctctactaaaagtacaaaaattagctgggtgtggtggcatgcacctgcaatcccagctactcgggaggctgaggcaggagaattgcttgaatctgggaggcagaggttgcagtgagccgagatcaaccactgctctctagcctgagtgacagagtgggactccatctcaaaaaaaaaaaaaaaaaaaaaaaaaaagaaagtccagaaagcctggtttgaatcagtaaaatcgagttttcacactgcttcactgattgtaattcattcttctacagatttttaaggagggtggaagagagaaaagctaagtaaaatgtggtcctagccatcacaggtctcatagtatcctgagggaaagagacaggaaacaactaactggaatataaaacagaataaaatgtgttcattacctgctgtatgaccttggtcaaatcacttaacctgtccctgagcctcagtttcctcaactttaacagacacataagcagtcaataaatgtcagcagctatgcatcagtagtggcaatagtaatatggactacatgtgtaatattttgtactatgccattacatcttagtaaaatagaaccatctacaatgtcttgtgaagagagaaatgaaatgaattttgatatttgttttctgcaaagattctacattacattgtataagtcttgacctaccgtttttataactcatgcataaaattatgtgaaaatgctttaaaaattccagcccactcttatactgggcattttatgtactcattcagcaagccattcattgagcaccagtcatgtgtcagctgctgcttaaggcactagagatacagaaattaaaaagacccagtcctcagagttcacagaacactaggaaaaacagacatgtaaattggacatgattacagtacaattgtgaaagaggcctctttgaaagagttgtctatattcaccatctccaatctttctcttcccattctctttttttttgagacagagtctcactctgttgcccaggctggagtgcagtggcgtgatctcagctcactgcaacctccacctcccgggttcaagtgattctcatgactcagcttcctgagtagctgggattacaggcacccaccaccatgcccagctcatttttgtatttttagcagagacagggttttgccatgttggccaggctggtctctaactcctgacctcaggtgatccacttgccttggcctcccaaagtgctagaattacaggcgtgagccaccatgcccagcccgattctctcttgagtccattccagtcagacttttgctccaccatccaataaacttctcttttattttttgagacatggactcactctatcgcccaggctggagtacagtggcacaatcatggttcactgcagcctcaacctcatgggctcaagcaaccctcccacctcagcccccccaagtaactgggactacaggtgtgcaccaccacacccagctaatttttatattttttgcagagataggggtcccactgtgttgcccaggctggtcttgaactcctgggctcaagcaatcctccccctatggcctcccaaagtgctgggattgcacatgtgagccactgcacccagccaaaacttctctttttatgataaccagtgacctccatgtgtttagatccaatggtcacttctcagtcttcatcttactgggccctcagcagctcaccactcctccttgacataccaccttcacttggcttcctggacaccacactttccttttccttcttcaccaactgctccttctcagtcttctttgtggggtctaatgtggaagtatccccaggctcaagccctaagtgatctcatctggtctcctggctttaaataccacccatgtactgatcactccctaattatgtctccggccctgacctctcccctgaactccagactcatgtagccaactctccatctccatttgaatggctaacaagcattgcgcagttgaactcctgatgttttcacccaccctcaaaaaacaaaaacaaaaagccaacctgcttctcccatagcgtcctccatctcagttcatggcacttctgtctatcccgtcacttaggccagaaactttagagccatccttgactctcctctcacaccctcatccagtccatcagccaatcctgttgactctaccttcagaatatatcgagtctgatcactgctcaccactccaccactagcatcccagtccaagctaccgtcatctcttgcctaaattactctagtaatctcctaaccagtctccatcctacttttccctccattcttgagtctttttcaacacagcagccagtgatcatgtgaaaatataaattaggtcatgccattcttctattcataaccccccccagtgaccagtcttctcagtaaaagccaaaattcttactgtgtgccctaccagccttatacaacctagccaccatttacttttgtgaagtcatatcccattactctctattttgttcattccattaccaccacattggcctcctcattgcctctgtaacaccccggacatgctcctgtcccagggcctttgaagatatctgtacaacttgcttcctcacttccttcagatctccaaaaagccatcttcttggtgaggtcttctctgattaccctaataaaaacttcagcatcctccagacactccttatgttccccctgcttttattttatccagagcactcacctcctcttagtatttggtgtaatttacttatttattttctttctttgtcttgtcttcccctgcaattagactttcagctttataggaacagggacttttgtctgtttggttcactaatgtatcctgagtgtcgggcatatagtaagtatcaataaatatgcaaataaatgaatagtctttagaggagataatgggagtataaaaaagagctaaggagtgcagtcagtatgattggggtgagtgatgcttttcatgttggaaaagttgtcatgaagggccttacatgtcattctaaggagcttagattttatcctataggcggtaaaatgtcagtaaagtagtcagtggtctgaattggaattttagaaatgcgttctggctgtagtataaagaatgaggccgggcacggtggctcatacctgtaatctcagcactttgggaggccgaggcaggtggatcacctgaggtcaggagttcaagaccagcctgcccaacacagggaaaccccatctctactaaaaatacaaaaattaggcaggtgcgatggcatgcacctgtaatcccagctacttgggaggctgaggcaggagaattgcttgaacccaggaggcagaggttgcagtgagccgagatcgtgtgactgcactccaacctgagcaacagagcgagactctgtctcaaaaaaaaaaaaaaaagaagaagaatgaattggaggctgggtgtaatggcttatacctgtaatcctagcactatgggaggccaaggtgggaggatcacgtgagcccagaaattcaagaccagcctgggcaacatagggaaaccctgtctctacaaaaaatacaaaaattagcagggcatggtggcacatgccagtagtcccagctaccagggaggctaaggtgggaggatcacctgagcccaggaggttgaggctgcagtgagccgttattgcaccattgcactccagcctgggtaacagagcgagactctgtctcaaaaaaagaaagaaaagaaaagaaaagaaaagaattgaaaaggacaagagtgggtccaagaggccagtaacagactgctacagtaatgcacacatgagatggtggtagcctgaattatgggagtgccagtggggatggaaaggaggattgcttggatagggcagtaagggtgggcgaaatgaaggaattccaggtttctggcttggggtagcttgttaaagacttgggccattcatcactgagataagaaatacagaagaaagaataaatctgacactgtcaagaagaaaggcaacgatagattctaggtgtgtcgagttttgagtacttgtgtactatccaggtagagctgcccagtaggcagttaggtgcttggttttggaggtcagtgggaggtcagagccaaagataaagatttgggagccatctgcctgtaggaggtgtttaaagcaaaagctatggtagaatttcctagaaaaggtatataaattgaggaggaccaaaagagttcctggttatcagtgccaaatattgccccctaagaaatccagtaataatatagccaaaaagagccactggatttggaaaccaggaggtcgacaatggaatacatttcatttattcaaatgtttattaaatatctactatgtgttaagaatactaaggatacagaagtcaataaaacagatcaaaaaatccctccttacatgtagctgaaattctagttgcagagaaggagcagataaataaaggaaataaataagtaaattattccaaatattaaaaggcagtgaatgctctgaaggttagataagctgcctagggtcacagggccaagtaagtgaagaaactaggactagaaacgaacctgctcaactccagagttgtgctcttcttactgttgtaccacacctcctctcccacatcgataatcttggttccattgccacagaatgccatatagccccaactaaacatttcagaaacaaaccaaagtatgtgtatagcttaatctaaactcaacaccatttctgaaagccagctctgaggggacatccccttcacagtggacaggtagtaccagttttatatgtagatggtatattgaaaagtcatttcatctgatcgtaaaattatttttctaagaggatggctgggtgcagtggctcacgcctgtaatcctagcactttgggaggccaaggcaggtggatcacttgaggccaggagtttcagaccagcctggccaacatcgtgaaaccccatctctactaaaaatataaaaattagccaggtgtggtggtgtgcacctgtagtcctagatactcaggaggctgtgacaggagaatcgcttgaacccgggaggtggaggctgcagtgagccgagatcatgccactgcacaccagcctgggcaacagagtgtgagactctgtcgcaaaaaaaataataatattaaaggagaaaacgttcctttcagagatggagcattttggtaataatagggttccgtcaggatggctctgaaggtggtgatgatgtccacggggtggccaaaatggtataaaggtgaggatcactgaagccgaaggccagaaactggtcatgggctgggtcgtctttatagatgccaaagttacctaagatgacggcgaggctaggagagggtgagccaccaggtatcacagtcttcaatgaacgtggaagagtggccagattagtagataatagcaggccaaggagtatggttcagtgacatcagccccagctaagtgcttctgtcgtgagagtgaaggaggaagggtttgggaacagcaacagagagcgagaagaatgccaccatcacaatgctccctaccctgtcacatctgtgaggtggagaaatgaacagcctccgcttgggagcttcacaggggaaggaccagtaaagacaaggaaacagaatactttaaaaaggctaagggcatgggattatgtttatcatgtccagaaggcacaggttgggagggaatgtaagtatgaaattgaatctgtcccaaatgtctgcttccttccaggcaaaataaacgacaaatatatggacagggtatcatgattgtattgcacgttaatatctgttctaagcccacagaacaagaagaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtcatgcccttcaatcactgtcattcctctcccaacccacactgagccagctttccttttgccatctttcctgattccaaaaagagttaccatttgtattgccaccgccattatctcactttacaagataatttaccctgatccaagttgactgcagacacattgatgttttctttttaagaacttaacttgattttcatttttggttttaacagatagttccatattttggaattatgtttagcacc

SEQ ID NO: 4967 - DNA, 53840 bp, human
ttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaagtaagagccgggcggggccggggaaccgggagaccggacgggggtggggtgggggagccgcggcccgacgccgccctgctgcctggactcggggccctggagtagggacggcccccttgtcgatcacctggggacccctcggggcggtgggccacctctatggcccccagagtgcagccccaatgcttttcacgttctcttggggttaccgccctgcaagatgcagttttgtggtccgcagccctggtccgagaggctttccggattggaccgggcgaggaggtggaatgcagcaaaggatttggaggaaaggaatgaaaagctctccagagagatgagtcctaaccatttccaccgtcctccaatttggaaacttttgcttaggctggcttaggaagagagagacccttttaaaggtgtttttgtctgtgtgacccaagccccgagaagaaagtgcttggtgtggggaaaggacccgatccatcgatacgaaaaggccgcagatttttgcccacacatctccccaacttaaatgaagcttgacttcaggctccgacagaggctgcagcttcccctccccaagctgagaacggccccctcagcctaccgcttcaccccactggcctcatttatttgggccttttccaccttctcccacatcaacagctgctccttaggaaaagatctaaaggtgtaaatgcagccttaaagcttccaccgagctcagaggtacctgcatttgaactggaaaccaagcctgaaagaatgaattggtagtgatggcatttcaggaagcagagatgtttctgtattggggggacggtccctgtgttcctcattcagtgggcacagtggcatctttgatatcgccttggctctgaattagacaaacagcccacatttgggagagtcggtcttgaccgcatagtttagtcttggcggctaatagtcaaaggattttgccttgacactgtcactcacctgggaggccagaggtggaaggctcacctggcagccgacaagccgaacggaatcatccttattacctaggcctctaggccagtactcattttgcctctgcctggaaatagagttcccttctcttcctctgcagagggactcatgggtgggaccatgacatttagttaaggccctttttcctccccacctctgcttgccctcatcaacatctggcctgcagtctgtaaacagttctcctctgagtcttaatgactcagtttctcccccacttcaccctcttctctacaaagtagtgtggaaatcttcctttggatgggataaaatatgtccagaggggtggggggcagaacttcaaaggctggtttaagtattgtggctcttctgctaagcacctagtatatgcacattagattttttaagctcctgcctcctgccctgtaaggtccataggacaggaagcattgtgcctgttttacagatgcagaattgggctcagagtgatgacacctcttgtcagtgaccgagctgagctccactacctggccttctgactccaaatctcatagtctttctgttacatcatgctgcctccctgcatccatttgacactaatttagtcaggctacattaagtccccactgtgtgcacgatgctgaggacaatgccaggatggaaggggcatggtccctgtgccccaggagcttacagagtaatagaagagtaagactaatatgtccatgaccataacacacaaggtagcatgtgattgtcatggataatgtgctctagaaatgtacccttctgatgagcgatgaggaggagaaaatgtgaagacttcatagaggagaaaaaaatttgagtttggcattgggagaatgaggagtctgctgggcagagatggagagaaagatactgcagttgatgtcagcaaatgcacagaggtgggaaggcaagcagcacaacaggaagtccaaccagaaaagcaggttggaatgagatattagagggttggattaagggatttggacttgacttggtatccaagggtagctgtgggaggtttttgtggggggtggggggaggtgtgttgtgattaaagcaattcaatggaaatgatcgtcacatcgtggcagagtaagatgactagagaggaggaagagtggagacagcagggccagttaggaacctgttgcactagtccacatagcagctgagggcaccggcaataggtgaccatgggagcagagaggaggagatgtctgggagaacgagaacagagacttacctgggctaggtttgctaggaattttttttcccctacaggattattttctttctgaaaactaaaaggaagtattttggtgaatggcaaggcatagttggaaagcaaagtgtttgattaatcgcgatgccatccttcctacatcaacatgatactcttgattcatcattatactgattcatttctactcttttctgaccatgaatttgcaaaacagttggctgggggcctgtgatcatgggtttgaacaaaacataaacatccagaatgttcagggaatggggtagttaagtgacttgtccacaaatgcaattaatggaagagctggaacttgaagccaagtcttctggctccttagttcaggtctctgtctaccattgcacagcagaaatatctgcttagttggattgacgatcaagagtccactcagtagtctgttgggagctaggttattgtaatgggtggctttcagatgtatcaaatagaagacccccccgccctggaacttcacaaccgcttgtctatcttatctaataaacgttagtttgggtccctgcagctctgaaattgttcataaccaacactatttctttattgaataagcacttcatgagcttatgtttggctgcactggctgccaacctgttaggttgaagtattggcagttataattacacatatccagggtgtgtgttgtatctgtgctggctgaaaggaaggggttgctgcaattcaccagtgtatccagtctcactggaaaaagcttctgtgcatgtatgtgtgggggtgggaggaagaacagaaaagggaacagtgccgccctagcaaatcaaaagtttaagatgcatggactgagatgacatcattggcggattatcagggttgcctgccctgactctgagattctaaggggaacaattgataggacttatctctgtatcagatgggagaagtctgcgaaaaaaggacttcctatggttcttctttttaattgtgtatatttgatattgagactctataaaagaaactgatataaaatacggctcctcttcctagttcatcaagtcattcagtgaattaagggcctgtttcctctccgcttgcccctaccagtcatttccttgtcagaagtgttgaactcccttaggctctatgctgaggactaacacagggtctgatacattgtagaccttcaataaatgagtagtgaattaactatgccctagaagtgaccaagtgggatggggaataagagtgggacaaggagaatgaatggtatttctttgggcatttcaaactccaccttctaggtggttccagcttgctgcagaccgcccctccagtcaaaaatttctttttttttttttggaagaagtattgctctgtcgcccaagttggagtgcagtgacgcaatctcggctcactgcaacctccacctcccgggttcaagcgattctcctgcctcagccttccgagtagctgggattacaggtgcacgccaccatgcctggctaatttttgtattttcagtagagacggggtttcactatgttgaccaggctggtctcgaattcctgacctcgtgatccacctgccttggccttccaaagtgctgggattacaggcgtgagccaccacgcccagccccagtcaaaaatttctacttcctctgtttcccctgtcctttctgaggtccccctccaacttgactggccagggtatagaagagggaggaacgaggaagtgggcaggcaggcagtacaactgaggcagatagtctgttggtgaatgccacctgtttgagaaaaacctctgtcaaacttggtttttcctctgctctcacaccacaacaacaaccctcaacacagaagacttctgtgaccaaatgagtgtggggaaccccacactctgataaatggacaccaactaggtgtcctctgattcagttctgacactgtctacctggacataatgtcagaccaagccacaggttaagggcttggtccccaagaatggcccccaaccagacactagtcacaagtccaggcctccagaacttttttttttttttttttaagactgagtctcgctctgtgacccgggctggagtgcagtgcgtgatctcggctcactgcaacctctgcttcccggattcaaactattctgctgcctcagcctcctgagtaactgggattacaggcgcccgccaccatgcccagctaatttttgtaatttttttactaaagagaaggttttgccatgttggccaggctggtctcgaactcctgacctcaagtgatctgcctgcctcggcctcccaaagtgctgggattacaggcatgagacgccatgcctagccaggcctccagaacttctgaccaaccagcttcaagttggggttcccacgaccccctctttgggttcgattaatttgctagtgcggctcacagaactcagggaaatagttaatgtttaccagttaactacagaggataccacaaaggatacagagaagagatgggcagggtgaggtaaggggcagggggtgtggagcttccatgccctccctgggcacgccacccttcaggaacctccacatgttcagccatccagaaggttcccaaaccctgtcctctcgggtttttatggaagatttgttacagaggcatgattgacaaccatgtagaaatgtgactggatgaaaagcacatgatctaaacccagcaaggcctgtctgttcagacttttcttggcctctatgcagcgttcctttctctagggcagaggtgtccaatcttttggtttccctgggtcacactggaagaagaattgtcgggccacacataaaatacaataacactaacgatagctgatgagctaaaaaaaaaaaaattgcaaaaaaatctcataatgttttaagaaagtttgcaaattggtgttgggccacattcaaagccatcccgggccacatgcggcctgtgggctgtgggttggacaagtttgctctagggtatggggcaggaccctctctgggatgaggatcttttaacccacaatcagattagagtcctaccttgggcaggtaaaaggagggcaggagaaggtcaaagagagaaagattctgtttcctgagacctaaagtgccccaacattataacaaggactagggaagttaggagccaggaaccatgggtgaaaaccaatgtatgtatcatagcaccacatcacctttacttccctgtatgtttaaaagcagctgattaactcaaatgactgtttcagttaatgcggctaaggtaggttgacaaaatgaagtcaagactcctacagcttgaagatgtttttaatcagtgagtgtttacttgaaagcaaaagagctagcctagaaccccttaaatgctttcacctgaatgcccactcttatttctcatgcagcagcccctggcctatgggcaactgaaagaacaggaaatgcacctcctcactggaggtttgaaggctaaggaactggggatgctctcattttaaaaagataggccgggcacagtggctcacacctgtaatcccggcactttgagaggctgaggcgggcagatcacttgagcccaggagtttgagaccaggctagccaacatggcgaaaccctatctctacaaaaaaaaaaaaaaaaaaaaaaaaaatagccaggcatggtggcgcacatctgtagtttcagctactcaggaggctgaggtgggaggatctcttgagcctgggaggtggatgttgcagtgagcccagatcatgccactgtacttctgcgtgggcgatagagtggccaccgcacccggcccagaactgggcactttgggaggccgagcggggtggatcacctgaggtcaggagttcgagaccagtctggccaacatggtgaaactccgtctctactaaaactacaaaaattagctgggcatggtggcgtgcgcctgttgtcccggctacttgtgaggctgaggcatgagaattgcttgaacctggggaacggaagttgaagtgagccgagatcgtgccactgcactccagcctggccaacaaagtgagactctgcctcaaaaaaaaaaaaacgtaattactgagatgctcgaagttatcatttgaagaaattttgttcctttttaagtttcaacagaactgaaagactgcactccagttggtatttaccaggtacttctgtgcatttacaccccacaggcaagccagtgttgacaattatgtagataaaagtagaaaatgctttaagtgggaaggacttgggatagatgtaaattaagaaagttaggcatctcttatagccaactagcatcatataaatatagaaaaatgtaaatgtattattcatgaatgcttatatagtactatagtaacttttcactttgtaaagtactttgaaatgctggaaaatatttcaagaactagtggagagaactctagcacaatccatagttgatttctctggcctttccccctattttctcccagatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtaagatggaccttttcaccttgtccaagaaaaggctatgttctctgaaattacaaatgtattgtatacctttgtgagccactaaatcagttttactgagatcaaggttatatggattcaacctacatagaggcaattagcttcattctattccatagccatacactccactcctaaactttggccagttacatccccgggaggggagtagaccagaaagtggaggtgactcagcaaactggtaagaatgcaattctaaccactctccatctgactgcagaaggagtattcagtgtacatacacattgatatgccatgagggcaactagggtagcaactgtgtcttctggggtctttgtaacctttgccagagctacacatttatggcccaattgcaaaatccagtagactttttccctttatctgaacttggttgcagcatttgataaggttgaccaccccttcttctggaaacttggcttccaggacccctccaagtcctgggtgtcttcccatctctctggcagctctttcttatctgacttatccggcccatctgggtcgtctgatactgccagcccctacatgttgctcttcccctgggctccttccttagctttctttttaccctcccctttagcttgcttctcatcctccaaaccctccctaggtggcctcatctatgctagtggcttaagcaagcgtcagtgtattctgtgacccttattctctacctctttagtaacaatggccaacttttggggggaagtacttaccatgttctgggtactgggccaaatgcattgcatgcgctttctcatgaggccttattttacagatgaggagatagatgcttcaggaagctaagtgacttgcccaagtccacatagatagaaagcaggagaaactagcaatagaactccagagccctctgttagcccctgactgacaccaattcccaatggtagtatgagtccctgctgttggacaccttcacctccatgctccctaggcacatcaaattcaagattaaccctgatgtcctcgttggtctcaaactagctcttcctcctgtgttccctaatgaatgagactaccttcctttcaccccgtggcccaagccagaaaaaaaagcctagggatcacttcaacttctcctctcactccacccccacttgaatcaccaagtcccgtcgatttgactcatcctctttcccacaggtccttacaactcagactctcagggtctcccacagactctggctcctacctgcttccactcttggtatctcctgccccagtcttccccgtgcactgctgcccggctgaggtgatctctccacgtgcaatttcatcgtttcacggccctcatttcactgctctccttaaaaagtattcagcgactcctgagctacaggagaaagcccaaattccttaggacattctagatccttcagacctggcccctgccagtttgtcctacctcatctcctgccatacctccacctgcattcatgctccagcccttcagaaaaacttggatttcctggaaataccactccctttatacatgctattccctttgcctttccactctgtcaaagtctgatgaactcctatttattcctcaagacccagttcaaaagttctctctttcatcaagtccctcctgactcccccaggcaaaattaatccctttgatccttgtgtacctaatgcatttcatatagcccccctgttgtggcacacatcaggggtgttatactgactttgccctggctgtctgttctcctcgatgatgagcatctccagaaattagcccgctcctctttcgattcccagcacctgacatagggcctggcacataacctaagctttccagacattttctgaatgaaggtaaatggaaggttggtgagccaattaaataaacattacatttttctaaagataagcaatttcacttgtattatcccctattttaaatttcattttgagggagaaatttagtccctctgtaaactaaagatggctcctaaaggttctggaagtttgtgaaagtgccacctactatattacttactcaccatctcagttcttagaaaggtgaggaagccacacagtgtagggtgcccactgggccatgatatgaccatgtcattcccaaaggtgaagtcaggtgacctccctcaccatcgagagtctctcactttccagttttcataaaatgtttccttctcagctagagatcagtccctcctgtcctccaaaacataatgaggtgctgcccactggctttttttacttgagtgattttttccccgaacattaaaaaaaagcttcaaacatctagaaaaattaaaagaaatctagagtatacatccatggaccatctagatgctacaattaacattttgctattcatccctccagccattcatcagtccatttttattttatttatttatttatttatttatttatttatttattttttgagacagaatcttgctctgtcacccaggctggagtgcagtggtgcaatctcggctcactgcaacgtctgcctcccaggttcaagcgattctcgtgcctcagcctcccaagtagctgagattacaggcacgcacctccacgcccagttactttttgtatttttagtagagatggagtttccgttttagtagagatggagtttagtagagacgaggtcaggctggtctcgaacccctgacttcaagtgatccgcccacctcggcctcccaaagtgctgggattacaggcgtgagttactgtactcagccagcccaccttttttttttttttaatgatttcagtgtaacttgcaaatatcaatacacttcacccctaaacccttcaacatgtgtgtcattaactagagttcaatatttgtgtatggttcttttttttgagatggagtttctctcttgtcacccatgctggggtgccgtggtgcgatctcagctcactgcaacctctgcctcctgggttcaagtgattcttctgtctcagtctcccaagtagctgggattacaggtgcccaacgccacacccagttactttttgtatttttagtagagatggggtttcaccatgttggccaggctggtctcaaactcctgacctcaggtgatcctcccgccttggcctcccaaagtgctgggattacaggcatgagccaccacgcccagccgtatggttgttttttaaagtacaatttacatccagtaaagtggacaaacctttagtgaaccatttgatgcattttgacaaatgacacaacccctaccaaaatatagcacattatcgcactcaagaaagttccctcatgctccttgggttggagggattttagcaaccccagagcccctcctgttttctttccccggaatccccccaggaatttatgttctcaagccagtgttttcccaagacagcagcagcttctccctggccttgttttgcaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggtgaggagttatcagagtggggtagggggtggaatgctttgtagtgtttgtggtcgggtaataacagcaaagaacactgaccccaagtgatgccaggtttccaaggagcttctgactgctcataaatactgtgcaaacccccactctgtggcatttctgctgctaacctcagagctgttggcttgagccccggctgcctcctcattcccatcctctgttttttggtcttttaagaagcctccaggctaggggcggtgattcacgcctgtaatcccagcactttgggagggcggaggcgggtggatcacttgaggtcaggagtccaagaccagcctggccaacatggtgaaaccccgcctctactaaacaaacaaaaattagctgggcgtggtggcaggcgcctgtaatcccagccactcagaaggctgaggcaggaggatcacttgaacttgagaggcagaggttgcagtgagctgagatcgcgccattgcactccagcctgggtgacacagaaagactatgtctcaaaaaaaagaaagaaaaataagaaagaaagaaaaaaaagaagcctccagatgaggcttctcttttctttcctgacttcctgattatatcacttgtggctctccttcctccaagaccagcagagagtagaatatgaaatgcagcctgctaatgctccctgtccttgctgcctccacagcaaggatgccactcttggtttcctcactgtgccttacctcagtgaagcagactggataggaccaacataagctaggaactgtagctaacaagggtccagcatccctgactccctcgctgaggaaggaactgcatttaaaatgtggcagcatcaggccgggcacggtggctcatgcctgtaatcccagcactttgggaggccgaggtgggcggatcccctgaggtcgggagttcgagaccagcctgaccaacatggagaaaccctgtctctactaaaaatacaaaattagctggttgtggtggcacatgcctgtaatcccagctactcgagaggctaaggcaggagaatcacttgaacccgggaggcagaggttgcagtgagccaagattgcaccattgcactccagcctgggcaacaagagcaaaactctgtctcaaaaaaaaaaaaaaaaaatgaggcggcatcttagtgagaccactgaggcaaaatcctagaatcagaagttccaaagtgagtaattgtcttagcctagaataagccaattttgatcaaagaaaaatcagactagttcaaataaggttgggtgggtaacagttatatctgtacagtgggggcaggcccagaatcctagcagggctgaggtgctgtatcttctcttagccctgctcaggcccttaaaattcaaaaatagctaatgcatgctggacttaatacccaggtgatgggttgataggtgcagcaaaccaccatggcacatgttcacctacgtaacaaacctgcacatcctgcacgtgtaccacagaactaaaaataaaaatttttaaaaaaattccacttccataggctaggctgtctccatggcctcttctgggcaaaccctgatttatacaagcaatatattcctgaagaactctatagaaattaatttggggtcagctgaatccaagtttaaatgagcagtcccagccaagtttggttttcccctgtgactctaacttgtcctcgcttgctcaatgtccctccccgctcccgctttccctctgtagtagtcccggctgccctgggccatcgcttacctcagcactaaacagcctgaaggtgcttatcaaagctgccactccactccctgaaacttcatctgtctgggttgcattcctttcctgtccttgtccaaacagataattgtcgcatcattgtaatggtagtataggtgcaaaatttttctattcgttggtaagaagtctttatatattaaagatattaaccctttgtcatacatttcacacaatttttccagtttgacatttggtgttttttttttttttgagagacagagtctcactctgacacccaggctggagtgcagtggcacaatctcagctcactgcaacctcctcctcctgggtttaagcgattcttctgcctcagcttcccaagagctgggactacaggcatgtgccactacacccagctaatttttgtatttttggtagagatggggtttcactatatgttgaccaggctggtctcgaactcctgagctcaagagatccacccgcctcagcctcccaaagtgctgggattataggcatgagccactgggcccagccaacatttggcttctagtgctatttatgtgttgttggtggtggtgctttgttgtacatatttgtagaattttatctaattatatctattacttttttgtttgtttgtttctgactttgcttttctgcttaaatgtaaagtctgcttagtgcatgcttatcttttttttttaagtatttctaattttaaaaataatgcacatttggaaggccaagatgggaggatcacttgagcccagtagtttgagaccagccttagcaacatagcgagaccttgtctctactaaaaataaaaaattacctgggcatggtggtgtgtacctgtggtcccagctacttgggagactgaagcaggaggattacttgggcccaagaggtcgaggtcacagtgagctataatcctgccaccgcattccagcctgggtgacagagagagaccctgtctcaaagaaaaaaaaaagtaatgcacatatactttaaaatggttaaaatggttcattttatgtatatttgaccacaatgaaaaaaaagtaatacacataagttgtagaaaatttgggacatacagaaaagtgcaaaaaggaaaataaattacccatagcccaacacccatggattataatgattaatagttttccttctatggaccttcatatatatacataaacacactcacacacatataaagatatataaggttatttcttttacaaaattgtgttcacactgtatataaaaattagtatccttaggccgggcgcggtggctcacggctgtaatcccagcactttggggggccgaggcgggtggatcacctgaggtcaggagtttgagaccagcccggccaacatggcgaaaccccgtctctactaaaaaatacaaaaattagctggtcatggtggcacatgcctgtaatcccagctacttgggaggctgaggtaagagaatcccctgaacctgggagatggaggttgcggtgagccgagattgcaccactgcactccagcctgggcgacagagcgagactccatctcaaaaaaaaaaaaaaaaaattagtatccttttttcacttattatataatgggtatttccctgggccattaagtatttaattatcaaataatattccaccatatggatgtgccaaaaatatgtaacaatttctcctttttttaatatttaggctttttctaattcttgagttatactaacattgtaatgaaaacctttgcattttttcatatctgtgatgatatccttaggctatattcctagaaattgacttataggtcacaaaatatgaacaattctaagactcttcatgaaatgtgcactccagaaaggttgtaagtttgtaattccaccagcactaaagcagtggctcagcttctaaactctcaatattcattgatattaattatcaatattaattgtcactttttaaatcattatgaacctaatagctgaaaaatagtatcccatcattttaattttaatttgattgattataagcaaggttgcactggccctttgtatttctttgtaagttttgtatttatgtccttgccctatttttctagaatattcaactttttctattcattggtaagaagtctttatatattaaagatattaaccctttgtcatacatttcatatatttttcccagtttgacatttggcttctaatgctgtttatgtgttggtggtggtggtgggtttttgttttgttttgtttttttagacagggtctcgctatgtcgcccaggctggagtgcagtagcagttcaagcatttctcctgcctcagcctcccaagtagctgggattacaggcacctgccaccatgcctggctaatttttgtatttttgatagagacacggtttcagcatgttggccgggctggagtggtgatgttttgttgtacatatttttagaattttatctaattatatctattagtattatcttctgtttctgactttgcttttgtgcttaaaaggcctattctatcccatgatcctatgactattcacttatatgttatttaaatacttttttagttgtgatttttacacttggcttcttttttttttgagacagggtctcactactgcccaggctggagtgcagtggtgcgatctcagctcactgtagcctcgacttcccaggctcaggtgattctctcacctcagcctcctgagtagctgggactacaggcatgcaccaccacacccagctaattttttttttttttttttttttttgagacggagtcaggctctgttgccaggctgaagtgcagttgcaccatctcggctcactgcaacctccatctccctggttcaagcaattctcttgcctcagcctcctgagtagctgggactacaggcacgtgccaccacacccagctaaatttttttttgtatttttagcagagacggggtttcaccaagttggccaggatggtctcaatctcttgacctcgtgatccgcctgccttggcctcccaaagtgctgggattacaggggtgagccgccgtgcctggccatcatacccagctaatttttgtattttttgtagagacagagacttgccatgttgcccaggctggtatcaaactcctggactcaagcaatcctacccatctcaaactcccaaagtgctgggattacaggcatgagccactgtgcccagccttacacttaacattttaatacatttagaatttacctggtgtggcagggtgcagtggcttgtacctgtaatcccagcactttgggaggccaaggtgggcggatcacctgaggtcaggagttcgagaccagccgggccaacgtggtgaaaccctgtctctactaaaaatgcaaaaattagccgggtgtggtggtgcgtgcctgtagtcccagctactcaggaggctgaggcaagagaatcacttgaactcaggagatggaggttgcagtgagctgagatcatcccattgcactccagcctgggcaacagagcaagactcagtctcaaaaaaaaaaaaaaatttacctggtgcacaggtgccgtgactcctgcctgtaatcccagcactttgggagtttgagataggtaggatcacttgaggctaggagttcgagaccagctggccaacatggtgagacccgtctccataaaaaatacaaaaattaactgggcacacctgtaactggtgcacacctgtagtcccagctacttgggagactgaggagggaggatcacttgagccctggaggtagaggctgcggtgagccgtatttgtgccaccacactccagcctgggtgacagagcaagaccctatctcaaaaaaaaaaaaaaaaaaaagaattttcctggtgcatgatatgaaacagtcatctaagttttttttttaatagtttaccaattgtttaagcaccattttttgaataattcttttctccactactttgtgctgcagctttcaccacatactaaatgtttatatctattctagggtctctatcttaatgaccataactttagaaaaatgccttttttttttttaatttttttgaaatggagtctcgctctgtcgcccatgctggagtgcagtggcgtgatctcagctcactgtaacctccgcctcccaggttaaagcgattctcctgcctcagcctcccgagtagctaggactgcaggcatgtgccaccacgcccggctaagtttttgtatttttagtagagacaaggtttcaccatgttagccaggctggtctcgaactcctggcctcatgatctgcccgctttggcctcccaaagtgctgggattacaggcgtgagccaccgtccccggccaaaaaacaccttttaatgtctagtggaatatagccctcctcattgtttttcttttcaacatttccttgattattttcgggcatttgttcttcctgataactttagaattaccttgtgattatgattggaattatgtaaaacccatacacttggagtaatttatgtaaaatatttcatcttttattcagagacacagtatgtctctcctttactttcaatcttctttctttagcttgaaccagatgaaattaccaatattcaactttgttgacatcattcaaacagcaatttcatctggttcaaaccttagaaaagttgttttcttcaaagggaaattatgctctctctaaacaaacaaaaaaatagtttctcttaaaaaatctggggagaagtagggtaggaaagaagtatgatatactgtaagtgttttattcattttttaaaaatcctggtcctaagaatttctcactgccaggggcatctctccagcactttcagccacttcatgcctagttcaaggcttcgccagcttagcttcctccccatagtgggccagtccaaaacaaccagggccttgagcctcaaggggtagggctagtccgtgaaaaagggtttcaggccaggtgcggtggctcacatctgtaatcccagcactttgggaagccgaggcgggtggatcacctgaggtcaggagttcaagaccaacctgaccaacatgatgaaaccccatctctactgaaaatacaaaaaaaaaaaaattacccaggtgtgttggcacgtgcctgtagtcccagctactcaggaggctgagagaggagaatcacttaaacctgggaggcggaggttgcagtgagctgagattgtgccaccacactccagcctgggtgacagagcgagactctgtctcaaaaaaaagagaaaagaaaagaaaaaggtttcagatgaagttcaatgacatctaaatgggacgggtaagggtcccagtcttccccataaaccttagttttgctttctcttcctgagagctagaacagtgacctcatctgggagaatccagccaacaccgcattctacaccatctgcattctatacccctaccacaacaacccactataaactggggtaagatacactagaagtgggtatttgggggtaatcctgatcatctttttcctcgtatgggagccttccaaataatgcatatatagagcataagaagaagtttcaaatagatgcaaagtcatgatggttgtaaaaaaaaaaaaaaaatccaaagaggtaattgcactgttttcacaaaataggatcaacatgtaattatgaataacaatataaatgtcatccaaagatataggaagtgaacttttagggtttcagtgaaagtgttattttgcaggggttaataaacatactaatactttgtccaccctatgttaaaaaaaaaattcacccccaagacagaactgcaggctgcttttaaatgcaaacatggcattgggcttctctggccattagatgtcactgcagtaaatggagagtagctgagcatcacctgattggagcctgaagttcggtgatctctgtccagttaacaacttcataatccctgcttgaaatccatctttggtttggagaataagaggcctagaaaccacaggctaatgctaaacttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcaggcctgtgcacacatggaatgaggtgcccccaacttggtgtgctttcacggaccccaaccaccctgcctgaaatccccttctccacgcttcagtgcatcttagctcaagcccttccaggtatagcctggcctttttgtctatctcccacacctagcccagggcctgggccagaagagatggcagaacttagtgtattgagagaacaagtaggaagggtaaaatattgacagagatgaattcatctgattaatctgtgcaccccgaataagaaccagggagtcctgagaaaatggctctctgcacaggtgcatgtgaagaagagagggagataggctggggaatactgccctgaaaatccagggagcagctgagaatgtaggagccttggaatctggcaggccttctgaaaggatcaggagggaggtaccagacacatgctcggtccccccacaactctgcctgacaccctcccctattgcccatattaggtgtctccatttcatcaaatataaaaccaagtgtgagcctgttgctttataccccagtggactttgaccccatcacagctcacaaggtaagcaggattgggccaggtcagcatttgaactgaaagcacataagatgaaggacaaaggtggtatccgagtggtacagctgactgagcagaatatacatggtcagtgaataaacagaggccccagcctactcaaatagagatgctcgacacctcgggttacctttgttgaattggacacagtcacttcattcattccctctcagggtgctcatcccctcttgtagtttttcatgttcatatctacatcttcaatcctgacctcccttctgagccatggtcccacatttcccacagcctgctcgacatcactatttggctatcatatccccactgtcacctctaacttaatgtgcatcaagctgacctcttcttttcctaacactgttattccagagttttccatttcaattccatcattgccccagtgactcaggctggaaatccacaacttgtgtttgactcttccccttcccctcacccggttaaccttgagccctgttgcttcttcattcctaacattcccatgctggtctttctttttgtcactgcctcttgccctaatcttggaccttatcagctcatacctaggctattacagtaatctcctcattggtctccaggattaattctaaaaatgatcttaagcattgaatattaatatgtactaggcactgtgctaagtgctttatgttcattatctcatttaatccttacaacagccctacaaggtgggcactgttattattaagtccattttacagatgagaaaactgaggcaccgaaaggttttgtagcctgcaagttcacccatccagtaattgagctgggatataagcccagggagcttgtctccagagtcagtgctcatttcaatcctctccagcccagcccatatgggattctgtcagatgaatctttctcagatctgtctgcgttagatccttttttttttttttttttctttttgtgagacagggtcttgctctctctcccaggctggagtgcagtggcacaatcacagctcattgtagcctcaacctcccgggcccaagcaatccttccacctcagcctcccaagtagctgggaccacaggcatgcgccacctatgcctgactaatattttaaatgttttgtagagatgaggtctcctggtctccttatgttgcctaggctggtctcaaactcctgggctcaagccatcctcccgctttgacctcccaaagtggtgggattacaggcatgagccactgtactcagcctgttgttgtgtccttcttgatggtccccagagaaaaaaggctgagccccttggcttggcatgtttcccttaccaactgtgcgatccttgttgcacagaggccctttatataagaagttacaaaaacaaatgcctgcagaaacttggaagtaacatgaaaaagagaatgtagggaaacccagataacatacactcaccctgtaaagaataagccttcaggctgggcctggtggcccacgtctgtaatcccaccactttgggaagccaaggtgggtggatcacttgaggtcaggagttcaagaccagcctggtcaacataatgaaaccccgtctctactaaaacacacacaaaaaaattagctgggcatcatggcaggtgcctgtagtcccagctactcaggaggctgaggcgggaggatcgcttgaacctaggaggtggaggttgcagtgagttgagattgtgccactgcactccagcctcggtgacagagcgaaacttcatctcaaaaaaaaaaaaaaaaaaaaaaaaaaaaagccttcaaatgcattccgagccatcatggctttcaaaagcattctggagagctaaacttcactgtgctcacaaaatgtgatttgcatctaaatatggatgacagaaaggaagaaagagagccagtagaggctgtggccagttcctcctctccaaaggacggatgccatttagaaatgtaggcccagttttcaaaggagtctaaaatccagatttttatgtaaaatctcccagtttttcactgctggcaaatgaaaattgttaagtactggctgggctaaacaaaacacacattcgtatgacctctgctctattcaagcctccaagttcatcaaactaatcttcttagccccttctcccaagccctgaagactaagtgcatttcacattccagtcaccaggcctttgttcatgaggttacctctgtcttggaacatctgcccaattttcttaaaggctcaactgaggtttgtctcagtgatggctgtcttttctgacctactgtagcacatacctgttgtttaagaaatgagttggcttttcccatccccaaaacagctgtcctatcttgatggatcaaggtagatgttttgcctttgtagaaccacaatggaggtgctccagcccacttcagaggggattctggggcaagagaagctgagttaactaacaatctactcagttaataactgcagatgccgtattttcactgtcccccacccaacccccaagggcatagttattttgttctaagagctttgtgggtgaataccacccaccccctttttatttttgagacaagagtctcgctctgtcacccaggctggagtgcagtggtgcaatctcggctcactgcaacctccgcctcctgggttcaagtgattctcctgcctcagcctcccgagtagctgggactacaggcatgcactaccacacccagctaattttgtatttttagtagagatggggtttcaccatgttgcccaggctggtctcgaactcctgacctctggtgatccacccgcctcagcctcccaaactgctgggattacaggcatgagccaccgtgcccggccaaataaccccttttaaatgatgctgttagcctatacgtgccctctgatccagccagtttcttttccatggcatttctgtccatgccctacctcttcccatcttaacactattgccctgctgttccctcactatcaaagccgcctcctgaagtcttctcccatctccccaagcagtagtctcccgctcctgaatggctcactcttgctagagctgtcttatggcccatgccacatgcttccttttgttataatcttttgtgtcccttatttcctctagattgcaaactctttgcctgtgggaagtatgtcttacacatttgtatatcctcacaacacacagcctcatgtagcagacatctaatacttgtttaaaaatgaagtttagggacagcttaggagatctcgctgtctgctaggtgagtcccaagtccgtgtggttgtacctacccaagatgaaggtaagaacacccaagcctgcctcctgctcaacctgctgccctaagaaaacctctgcatgtcccctgtctaaaactgtctatgcacttcgctctgagaatgcactgtcttccatctcctaccctagcaatcaggttctatgcatctcagtgcaaacagccgttaacgtttcaggatagacaaatatgctaaaaggacaaaaggaaaaattcttgacaccattttgatttacacctcctcttcattccagcctcctggcgctttgtatggtggctggaagtgcttgacaaatcatagcaccatcaaatttatacagtcgtccctaggtgtctgcaggccattggttgcagaatccctctctgataccaaaatccactcatttctcagccctgaagtcggccctgtgaaacctgtggacacaaaaagttggccctccttatacacaagtcccgcatcccaaatttgattgtggatgcagaacccacagaaacagagggccgactgtatttattgaaaaaaatccacatataagtgaaccagcacaactcaaatccatgttgttcaaaggtcaactgtaggccgggcgcagtggcccacgcctgtaatcaccacactttgggaggctgaggcaggccgatcaacggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagtactcttagtactcctattttatagatgaggaaacaaggcacaaggtgtaagtcacttacccaaccatcacatagctagtaagtaagtggcgaagctgggacttgaacctatgtctctccttcctcaggccctttttttattcaccaagagtacaggagcctaatcctgtaggcaagggaactggatcattttgactttagttcccttgccccaggtgtgggactagaggatgagggagcgggaaagcaaaccttgatattgggagtccacagcctcagtgcaagagttgagaaaatcaatactttgcaagctcagaaactgagaggccatagccttgtcttaatccgttcaggctgcaataacaaaatatcataaactagatggcttataaacaaccaaaatgtatttctcaccgttctggagactgagaagtccaaggtcaaggcagatttgatacctggcgaaggccagcttcctagagccttcttgctttgccctcacatggtggaagggggagctagctttcttccatctcttttaaaaggacccgaatcccattcatgagagctttgccttcatggcctaatcacctcccaaaggccctgcctcctaaaaccatcaccctaggagtcaggatttcaacagatgaattttgggaggacacaaacactcagagcataacgagcctggctttggccagggaatggttaactcaagttagagagaggaaaaaaaaaaaatctttggaaaactgggctgtcctggggtctgctttagtccctggcagtctggcaatggaaagccctacttgttgctttgacttgagaagccgtaatgagcagtgagccacaggcatagaccattcagtagacacaggtctttggccagccttgaacgacaactgctcagagggactgggaagaaagcccgcctaccacagggggcagggctgggagcagaagcaaagccccaggatgggagagtaaattgttataactatccctgcgaggaggtgctaacaaagttccaggttttctgcctacttcaatatttcccggttggcatagcatctactcttagtaggaacagagttctatttgcctaacagagtcaaattacctgtccagaggtacaaacactgctaggttctaagccttcagggtagtggagaggagtggagccttacctttagtttgttgtattttcaactctctgctgtcatcttacttttaggtctggcccctttgtgaaccaaattcttctaactgagtagcattgcgttagcagtcagaaaaaaaaaaaaaaaagatgcttttcaaatataggtagatgtctggacatcccttaggcaaggtggctctgtatgagcgtcactattaaagtgaaaggaaaggaaaagtctccccacccttgtttttttttcaaaaggtatagagtgcccgaaatactttagggatggcagctgttgagcatggaaacaagacttgtccctagagggaaggcaaggaaggcatggggaagagccttcctaactccacttagtgtaaaatcactctgtcctcttcccctgacctgagctggcttattccttggaagagataaagatctgggagtcaaaatgaccaccctgtgctgagcaggcttctttgaactccagctaaacggtaacagcacctaagataggatgttcccaccctcactccccacctcaaagtggaggtgaagagggagataagggaaagggagagaaaggtcccaggaaaggtctgctgtcaagagggaggacccgcagctggctgggagcattcacaggaagtaccaattttcacctccttttttccacagagctgttgcttatttgcctacgacggctgtgttcctcttgaggctgtaatgggcagactagctcagtgggtaacagtgtgagctttggatcccagccttgccacttactcccgcgtgaacttgtgtacaccacataacccatctgagcctcatcttcctcatctgttttgagggtaagaatggtgcctacctcatctacttgcagcaaagactaaattcgtttagtgcaaatgcagagccaggcccataataagtactgtcaataatgctaagatgccatgtttattgttcttgaagcatcacttcagaatctgtgcacagcatggaaggcctgattagaaccataaaaaccagtccaaggccgggcgcggcgactcacgcctgtaatcccagcactttgggaggccgaggtgggtggatcacttgaggccaggagttccagaccagcctggccaacacgacgaaaccccgtctctaataaaaattaaaaaattagctgggcatggtggcgcgcgcccgtagtcccagctactcaataggctgaggcatgataatcacttgaaccaaggaggcagaggttacagtgagccgagattgcaccactccagcctgggcgacagagtgaaactctatttaaaaaaaaaaaaaagccagtccagatgtgtttccatgtttcctatgattactataaacacacaaatgagctgggctcacagaacctcaatagaccttggatatgtatagctaatgatgagcagcgacaggaatcgagagttcgtacagaattttttggtttggttagcgtaacaacaggctttacagacaggctccatgtgcaagcactgcacacctctgtatgttctcagccttctgagaactgtcactgccaaatcttttccttcaccctccccaccctatctcacccccaggcaaggtgacactttcaaagttggcacggcaggcagcacatgccaggcctgtgacccaggcctcagcagctctgctcacttgcatggcaattgctttctacagtcaggcccagctgcactttgggtctccccaacccccacccccaatcaccacacaggaactggctgtttctcttttcttcgtccaagctgaatactaacctactgtggtttgcttgcttcccccattgtgatcgcaggctttctgagcagctagtcaaccctctagcctgccactgaatcggaaggcattcacactggaggggatcaaggggagcttgtaggcttgccttgctggcgggcagctgcctacacccactcgtaccaatgtccccgctgcagagcccgggtgcttcccagctgtacaaggacaactatttgggtcccggctatgccaagagaaacatgggtcatgtggttcacaggacagaaaggttcatttactccaatatgactggcatttttttttgtttgattattggatatttgccaaaagactgaagcctcctgccacaaccacctcccccacatatatgtcctcagatggtttgggaattggacagcttagtcatcaggtcctgtcctccacatccacagaagatacaagttgtttccagataacatgcagaaggttctgagctccttcctgtgtgctccagctcgaagactcttttcttttccctatgaattttttttccttttctttctctggtctttcctttttaatgcccttttaaaattaagtattctatcttttgagtgggtaacacatacacatgatacaaaatccaaaaggtgcaacgagtatatgctgaaaagtaaacctctctaacctttgtccttagccattcagctctcctgtgagtcagtactgttgttagcagtttacctgtatctttccaaagatggtctatgcaaagatccacataaacttgtacatttatgttctgtttttaggtcagcagcagcacactacatacactcttctgtgccctgttttttttccacctgaaaatgtatctcggctgggcacggtggctcacgcctgcaatcccagcactttgggaggccgaggcaggtggatcacttgaggtcaggagttcaagaccagtctggccaacatggtgaaaccctgtctctactaaaaatatgaaaattagctgagcgtggtggtgggcacctgtaattctagctactcaggaggctgaggcggaggaatcacttgaacctgggaggcagaggttgcagtgagccgagatcacaccattgcactccagcctgggtgataagagtgaaactgtctcaaaaaaaaaaatgtatcttggaaatgataccacatcaatccagataaagctgccacatatttttcatttatgacatagtattcaacggtatgatatactatttatttaactagtccctgattggtggacatttagattatttccagtcttctgctagtactaacaatgctgtaacaaatctccttgttacatacatttttcacgcacatgcaaatagatctgtaggataaaaaggggtccccaacccctggtccgtggcctgttaggaacctggctgggccacacagcgtgaagtgagtggccagcgagtgagcattatggcctgagccccgcctcctgtcagatcagcggcggcattagattctcatagcagtgcaaaccctattgtgagctgtgcgtgcaagggacctgggttgcacactccttatgagaatctaatgcctgatgatctgagatggaacagtttcatcccaaaaccattccccccaaccccttgtccgtggaaaaatggtcctcggcaaaaccagtccctggtgccaaaaaggttagggactgctgggctaaattcctagaatttttgctttggtcaaagggcatatgtgtcttacatcttttttttttttttttgagatggagtcgccaggctgaagtgcagtggcgcaatttcagctcactgcaacctccacctcctaggttcaagcgattctcctgcctcaccctcccgagtagctgggagtacaggcacacgccaccatgcccagctaatttttgtattttcagtagagacagggtttcaccatgttggccaggatggtctccatctcctgacctcatgatccgcctgcctcggcctcccaaagtgctgggattacaggcgtgagctgccgtgcccagctgtgttttacatctttataaatattgttcagttatttcagtactcatggaaagactgaacaaccaaaacgttgcctctgttggaagacctctgaggaatttatcacaggaataatcaagtgctttgcttttaagtctttgttctttatttgtatctactgcaagtttgttatttctttccttcaatatgtattaaacacctcgacctctaccatgcaccaggtaagctttgaggccaaaaccataaacacaacaaatgtggttgctgcccccacagtatttacagtctaggagatggagcagttgggggcaggagtacacatgaacgaaataattatacactgagtcattacaaactgtgttaagtgccatgaaggagaagcacagggtgactgaaagtgttcagtaggctcctgacttcgtgtggaggtctcagaagatttccctggggaaatgatgtttattctgatcaataagacagacttagtgaggccgaggaaatggcaggtttgaagtcctagaggaaggcaggagcaaggattctggccagcagcatggattacaggatctggaaagggtcttcaaggacattttgtttcagtctcctcatttgacatgtgagaaaactaaagtttagggagctaaatgacttgaccagggttatacagatagtaacaaagtcaggctgcagaatccagtgtgctcatcctgggagctgtgggtctgaactagacagctatgggatagttgcctgggtttgtgtagaaggacttaagttcaggttcttgtgacaagctgcgtgacatgtttcatttctctttactagtaagatacagtttggatgaatggccattccaatctagcgggttggtttgttcttcagcatacttgtctttcttacaagtttaaataataataacaatggtggttaattctttagcgcttgctctatgtcaaatacagttctaagcaacttacatgtattaaatcatttcattttgacagcagttcttaaagttggtgttattattattaccccattttacagatgaggaaattgaagctccagaaggtaaaggcacttgccaaccatcacagagctagtgagtggcaaagcagggggaccgagtccaaacagtctggcttcagggcccatgtgctttgtctcccaggcactctcagtgtcagcagcaggctgatggactcaggtttgagcccagagctgccttgtgccatggaaggtccaatcagtggctctcaaccctggctgcacatcagaatcagctggggagcttgtaaaaagtgctaatgtccaggcctcgcccccgttcagttaaattgcaatctctaggggtggatcccagtcactgagggtttttaaaagcttccgtggtcagcctaatgcagctaacggttgagatgtactgggatctaggcttgccattgctttgccctttgggagcaaccagcaccccatacttgcctttgtgttctggacacccacttagtaggacacttgtagaggcacttattcataccacagcacaggctcctgtctcagcctaaagaactcattcagtgtacatgctttggcagccacatccaccagtgatgtgcggtaacaagtctgtaaagggctaagagaatattttcagtcctgagcgtcagaagacagtggagcttagtggagtggagcttggctctgagtcaaacagacccagattcaagttgatgctttgtgtcatggtctgtgattttagagactggcgtttatcctctcaccaactccattttgtcatccatataatcaagctaatacgataatactacctctttcatgaggcttttgtgaggattaaatgagatagtatatagaaagcaatcagtgggccaggcgcagtggctcatgcctgtaatcccagcactttgggaggccgaggtaggcagatcacctgtggtcaggagtccaagaccagcctggccaacatggtgaaaccccatctctactaagaaaaattagccaggcttggtggcagtcacctgtaatcccagctactcaagaggctgaggcaggagaatcgcttgaacctgggaggtggaggttgcagtaagccaagatcgtgccactgcacttcagcccggaagacagtgagactgtgtctccaacagaaaaaaaaaaaagaaaagaaaagaaagaggaaaaaaaagaaagaaagaagaaaaagaaagcactcagtgctaggccatgtctttatttcatgactatccacgtagcttatgtgagtaaacagctatatttgggaaaagctactagtgacactgatattgacaggaatttgatttgacatttaataagtgcctggtatgtacaatgaagagtgaaagatcctgaagagcttggatgactaggaaggccccgtgcctgctgactggcttgctggctgggagggagcataaagacacccagataactcatataaggtagagtgtgccgcagcagaggtctaaacgagaagctaagggaggccaggggcggtggctcatgcttgtaattccagcgctttgggaggctgaggcaggtggatcacttgaggttaggagttcgagaccagcctggccaacatggtgaaatcccatctctactaaaaatacaaaacagctggacatggtggcaggcacctatagtcccagctacttgggaggctgaggcaggagaatcacttgaacccgggaatggggaggttgtagtgagccgagatcgctccaaaaaaaaaaaaagctaagggagcacaagatatggagagagaaagccccaattcaaacagaagctggaaaacaattataaaataaccaaggaaatatgaatactaactgaactcaatatgtgatgatattaaggaattataaatttttaggtgtgataacggtattatacatatatttttgaggagcaattatagtttagataaacataattctaattaataatatgtaagtcagatgaattgaaatgatgtctcgtgggggtagagatgaaagaagattggccacgtatagctaattgttgaagttgggtgatggaactttgtgttcattttactggcctctctacttttatatatggttgagatttttcacaataaaaagttttaaaaagagggccgggcacagtggctcatgcctataatgccagcactttgggaggccaaggcaggcagatcacttgaggccaggatttcgagaccagcctggccaacatcgtgaaaccctgtctctactaaaaatacaaaaattagctgggcgtggtggcacacacctctaatcccagctacttggaggctggggcaggagaatcacttgaacctgggagacagaggttgcagtaagccaagatcgtgccactgcactccagcctcagtgacagagcgagattccataaaaaaaaaaaaaaaaaaaaactttttaaaagaggtaaagttgtggccaggtacagtggctcacgcctgtaatcccagcactttgggaggctgaggcaggtggatcacaaggtcaagagttcaaaaccagcctggccaagatggtgaatccccatctctactaaaaatacaaaaaaaatagccggttgtctgtaatcccagctactcgggaggctgaggcagagaattgtttgaacccgggaggcagaggttgcagtgagccgagattgcaccactgcactccagcctgggcaacagagcgaaactccgtctcaaaaaataaaaataaaagagagaggtaaagttgaagaaaaggaaggaaacaagcagtacacaattgtggaatctggaaaattttcaggatgaggtggcatctgacttgggcatgggtgactagggagagttgatgtcgcagtttaaatctgaagggagtctgctggcagaatctcctcttccttgaggggcttcagtcttttttcttttaaggccctcactgattggaggaggcccactcacattatggacaggaatttgttttactcaaagtctactgatttaaatgtcaaactcatcttaaacatgcctttacagcaacatctagactagtgtttttcccaaatagctgggtactgtggcctaaccaagttgacatatgaaattaatcatcacagggtggcagtgggaaatgatactaggaaaaccggtaggggccaaattgtaaagggttttgaattctgttaaaattgtctttagtaaacttctttggaaaatttttcttctcaaaatgttttcgttagaaaattgggaattgttgaaggcttctgagcaaagcaatggtaacatctgatgagtttggaagggtacttggctgcaatgtggaggatgagttggagagggcagagactgaaggtcaaatgatgggtaaggaaactgacccttgcttaagagagatgatgtgaggtactgggagtagagctgaaaagtatccaaagcatagaatataatgcaggtagcagcaagagatcaggctgagcagtaggcagaggccaggtcatggagcacctggtaagccagattaaagagcctggagtttatcctgatgataatgggggacccactgaagagttgaagtcaagggagtaacctgattaaatcgctctgactgctagatggggaataagggcaggtagaccagctagtaacagttgtagtagtgtgggcaaaagatgatggtggcttggactagggtgagagtggaaagaaagaaaagtaaacaaatttgggacatgtttggagccactggaacttggttagtgatggattagatcagagaaaggtgagagacagagaaaacttaaaggtgactcaggttttgggcctgagcaagtaggttgatgacagtgccatttgctgacatgaggaaaactagaggacagtcaggattggagtggagcaaaatcaagagttctgattaggacatataaagtttcagatgttcagtagacttctgagtagcaatgtcaagtagctagttgattacatgatcctgtggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgttaaaaaaaaaaaaaaattttgagacagagtccgctgcgacgtccaggttggagtggaatggcgtgatctcggctcacttcttcctgggttcaagccatctctgcttcctgggttcaagccattctcgtgcttcagcctcccgagtagctgggactacaggcatgcgccaccacgcctggctaatttttgtatttttagtagaaatggggtttcaccatattggccaggctggtctcaaactcccaacctcaagttatctgcccacctcggcctcccaaaatgctgggattacaggcgtgagccactgcacccaacttaaaaaatatttttttaaaaaaagaaaaaaatcggtgggcagagcagatcatataggaccttgtagcctacgagcatgctggaaccacttcctactggctcaggagaactgactgttaaatttcaggaaatttgggagctggtcgacttcgcatttggcagcctgaaatcagccatagtgggagtactgatgctgttgaaattggtaaatgctacaattcagcccttttttattttcccccagagaaccagttgttaaactttgccaccatattagtactatggcttgtaggctccagtaagaaatttagattttattcttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcataattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagcatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccacatttcttggaggctttgctcatttctttttattcttttttctctaaacttcccttctcgcttcatttcattcatttcatcttccattggtgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagactgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtcgtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccgctttgttttctttttcatctcagtttttgaggataagaatgctttgttttaaaagggatcatctgtgtctttttaaaagcttactgaattttcctggtgtgaattatttgcacgtactcatttttgtggttgatttggattttacagtgattaagattttacagtacctgctccaccgggcccagatcctgcttcccagatcttcctgggaagcaccaagaaatttagattttattctaagtgtgatgtaaagtcattaaaatgttttaagcaggtgagtaaaaggatctgatttttaaaaatcactgtacgtggccaggcgcagtggctcacgcctgtaatcccagcactttgggaggccgaggcaggtggatcacatgaagtcaggagttcaagaccagctgggcaacatggtgaaaccccgtctgtactaacatacaaaaaaattagccaggcctggtggtgcacacctgtaatcccagctactcaggaagctgaggcaggagaatcgcttgaacccgggagacggaggttgcaatgagccgagattgcgccgctgcactccagcctgggtgacagagcgagactccatctcaaaaaataataataataatacatcactgtacaagaatggactcccagtgggagaaggcaagatcgctaaggaaactgctgcaacaatccacatgcgcagtggtgccttggcagtgcaggtaagagttcagtcaagaaatttggaagattgttaacatcctaagactggatatagatggaccttgatttatcacaagttgattataattgacctgttatgtaattcgtgttacttagtgtctttttgttttagttgtggggagcaccagattacagaatgattaccttgactcatgacccagggctctttacaattcttaccagaaactggcagatgataaatcagtcatcttatttggtagcaaaataaggaggttactttcctgcatgaacataaatttcctcttttcaatatttcagtcttacattagcaggaggaacttgaagtcttgtgattaggcagattctttgtaagggaaaaggcagcttactatccttttggtaacagttctttactgatagggtaagaaggaaaggaggttgagtccgaacaatgctaaaggaaacactttaaagtaagacatccactgaagacccctagccattttgcctactgtaaaatagaaccatctacaatgtcttgtgaagagagaaatgaaatgaattttgatatttgttttctgcaaagattctacattacattgtgtaagtcttgacccacgatttttataactcatgcataaaattatgtgcaaatgctttaaaaattccagcccactcttatactgagcattttatgtactcattcagcaaaccattcattgagcaccagtcatgtgtcagctgctgcttaaggcactagagatacgaaaattaaaaagacccagtcctcacagagttcacagaacactaggaaaaatagacatgtaaattggacatgattacagtacaattgtgaaagaggtctctttgaaagagttgtctgtatttatttaccatctccagtctttcttttcccattctctctctttttttttttttttttttttgagacagaatctcactctgtcacccaggctggagtgcagtggcacaatcttggctcactgcaacctccacctcccaggttcaagcgattctcatgcctcagcctcccgagtggccgggattacaggcatctgccaccatgcccggctaatttttgtatttttagcagagacagggttttgccatgttggcaaggctggtttcgaactcctgacctcaggtgatctacttcccttggcttcccaaagtgctagaattaacaggtgtgagccaccgcgcccagcccccattctctattctctctctctctctcttttttttttttttttttgagacagagtcttactctgttgcccaggctggagtgcagtggcacaatctcagctcactgcaacctccgcctcccgggttcaagcaattctcctgcctcagcctcccaagtagctgggattacaaccaggctgggagattcagcttgtccatttcatgttctgtttctcacaatcatctgtgtttgcttgtcactgcactttaaagagaaggcataactcaaaagtttcacccttcaacttgatggagaattattttttatttatttatttatttatttatttatttttatttttttgaaacagggtttttctctgttgcccaggctggattgccgtggtgcaatctcggctcactgcagcctcaacttcctgggctcggtcgatcctcctgcctcaggatctactccctcctgagtagctgggactacaggtacatgccatcatgcccggctaatttttttttcttttgtagagatgaggtttcgtcatgttgcccaggctggtcttggactcctgggatcaagcgatctgccagcctcagcctcccaaagtgctggaattacaggcatgagccactgcacccagccattctatatttttaaagcatagaatattgattctttgagctggattaatgaggaaagatataacaatcattaatataaaataaagaattgtgaaacctcattaatttgcatgccactaacctaaaattgtaataacccagggcttagtaagcaaattagtcatataaacagcataactatagggatatttaaactgtttaccaaaagaagctgcttttaaagcctgctgaagtacttatttattactaataatgtctaatattattgacacttataatgttgctggcactcttcattgtcttatttaatttccatagcaactctaagagctaggtattatcactcccatttttgaaataaagaaattgaggccaggcgcagtggctcatgcctgtaatcccagcactttgggaggccgaggtgggtggatcacgaggtcgagagatcgagatcaccctgaccaacatggtgaaaccccatctctactaaaaatacaaaaaaagccaggcatggtggcaggcacctgtaatcccagctacttgggaggctgaggcaggagaatcacttgaacccaggaggcggaagttgcagtgagccaagatcgtggcattgcactccagcctgggcaaaaagagtgaaactgtgtctcaaaaaaaaaaaaaaaagaagaaattgaagctcagagaagttaaggaactcactgggtgcagtggctcacgcctgtaatcccagcactttggcaggccgaggtgggtggctcacttgaggtcaggagtttgagaccagcctggccaacatggcaaaaccctgtctctacgaaaaatacaaaaattagccaggcgatgtggcacgtgcctgtaatcccagctactcaggaggttgaggcacaagaatcgcttgaaactgggaggcagaggttgcagtgagccaagatcatgccactgcactgcagcagcctgggtgacagagtaagaccctgtctccaaaaaaaaaaaaaaaaaaaaaaaaaaaggaacttgcttaagatcaaaaatagctaatgagtagaagagacaagggttccaatccaggtctgtgtgatgctgaagcccacaggcagaagattcgcactctacctaggcttccacagatcactcaaccatgcatgaaagtaaggcctgaaaagtgtctctactaggttgcccttcattaatctagttccagtcatgtataataaaatggagtgtctttccaaaatttcataatttagatttcactcatttaggccgacttcccccctatacatacccactagttggaattagttgccttttactatatgctgtattgaatgtccttatagttgggggtcatgagaaaagctaaagtctaacttggacaagatgacgactggcattgccagggttgtgcagcaacagtagtggggtggggtgtcctgcaaggacatgagttaggtggctgttaggggcagcataagttgtagtgtaaagccttggagcctagatgccaaggtcgcagagtcaccaggaggcaggatcctggagtacagattgcagtggcccagtaggcacagcatctggcctctaggtctgcctctgctatgcaccagctgggggctttggttaagttgctctgcttctccaggtcataggtttttgtttgtgaaacgaataattggaagggaagatcttagggtccatttcagattggggtctctggtttagggatctgcgttatcagagtctaaagtaatcaagtccttggagatctagtaatcagaaggagagcaagaaagagccagctttcattgtcaggggcaacaaagaggtggctcatgcccataatcccagcactttgggaggccgaggcaggaggatcacctgaggtcaagagtttgaggccagcctggccaacatggtgaaaccccacctctactaaaagtacaaaaattagctgggtgtggtggcatgcacctgcaatcccagctactcgggaggctgaggcaggagaattgcttgaatctgggaggcagaggttgcagtgagccgagatcaaccactgctctctagcctgagtgacagagtgggactccatctcaaaaaaaaaaaaaaaaaaaaaaaaaaagaaagtccagaaagcctggtttgaatcagtaaaatcgagttttcacactgcttcactgattgtaattcattcttctacagatttttaaggagggtggaagagagaaaagctaagtaaaatgtggtcctagccatcacaggtctcatagtatcctgagggaaagagacaggaaacaactaactggaatataaaacagaataaaatgtgttcattacctgctgtatgaccttggtcaaatcacttaacctgtccctgagcctcagtttcctcaactttaacagacacataagcagtcaataaatgtcagcagctatgcatcagtagtggcaatagtaatatggactacatgtgtaatattttgtactatgccattacatcttagtaaaatagaaccatctacaatgtcttgtgaagagagaaatgaaatgaattttgatatttgttttctgcaaagattctacattacattgtataagtcttgacctaccgtttttataactcatgcataaaattatgtgaaaatgctttaaaaattccagcccactcttatactgggcattttatgtactcattcagcaagccattcattgagcaccagtcatgtgtcagctgctgcttaaggcactagagatacagaaattaaaaagacccagtcctcagagttcacagaacactaggaaaaacagacatgtaaattggacatgattacagtacaattgtgaaagaggcctctttgaaagagttgtctatattcaccatctccaatctttctcttcccattctctttttttttgagacagagtctcactctgttgcccaggctggagtgcagtggcgtgatctcagctcactgcaacctccacctcccgggttcaagtgattctcatgactcagcttcctgagtagctgggattacaggcacccaccaccatgcccagctcatttttgtatttttagcagagacagggttttgccatgttggccaggctggtctctaactcctgacctcaggtgatccacttgccttggcctcccaaagtgctagaattacaggcgtgagccaccatgcccagcccgattctctcttgagtccattccagtcagacttttgctccaccatccaataaacttctcttttattttttgagacatggactcactctatcgcccaggctggagtacagtggcacaatcatggttcactgcagcctcaacctcatgggctcaagcaaccctcccacctcagcccccccaagtaactgggactacaggtgtgcaccaccacacccagctaatttttatattttttgcagagataggggtcccactgtgttgcccaggctggtcttgaactcctgggctcaagcaatcctccccctatggcctcccaaagtgctgggattgcacatgtgagccactgcacccagccaaaacttctctttttatgataaccagtgacctccatgtgtttagatccaatggtcacttctcagtcttcatcttactgggccctcagcagctcaccactcctccttgacataccaccttcacttggcttcctggacaccacactttccttttccttcttcaccaactgctccttctcagtcttctttgtggggtctaatgtggaagtatccccaggctcaagccctaagtgatctcatctggtctcctggctttaaataccacccatgtactgatcactccctaattatgtctccggccctgacctctcccctgaactccagactcatgtagccaactctccatctccatttgaatggctaacaagcattgcgcagttgaactcctgatgttttcacccaccctcaaaaaacaaaaacaaaaagccaacctgcttctcccatagcgtcctccatctcagttcatggcacttctgtctatcccgtcacttaggccagaaactttagagccatccttgactctcctctcacaccctcatccagtccatcagccaatcctgttgactctaccttcagaatatatcgagtctgatcactgctcaccactccaccactagcatcccagtccaagctaccgtcatctcttgcctaaattactctagtaatctcctaaccagtctccatcctacttttccctccattcttgagtctttttcaacacagcagccagtgatcatgtgaaaatataaattaggtcatgccattcttctattcataaccccccccagtgaccagtcttctcagtaaaagccaaaattcttactgtgtgccctaccagccttatacaacctagccaccatttacttttgtgaagtcatatcccattactctctattttgttcattccattaccaccacattggcctcctcattgcctctgtaacaccccggacatgctcctgtcccagggcctttgaagatatctgtacaacttgcttcctcacttccttcagatctccaaaaagccatcttcttggtgaggtcttctctgattaccctaataaaaacttcagcatcctccagacactccttatgttccccctgcttttattttatccagagcactcacctcctcttagtatttggtgtaatttacttatttattttctttctttgtcttgtcttcccctgcaattagactttcagctttataggaacagggacttttgtctgtttggttcactaatgtatcctgagtgtcgggcatatagtaagtatcaataaatatgcaaataaatgaatagtctttagaggagataatgggagtataaaaaagagctaaggagtgcagtcagtatgattggggtgagtgatgcttttcatgttggaaaagttgtcatgaagggccttacatgtcattctaaggagcttagattttatcctataggcggtaaaatgtcagtaaagtagtcagtggtctgaattggaattttagaaatgcgttctggctgtagtataaagaatgaggccgggcacggtggctcatacctgtaatctcagcactttgggaggccgaggcaggtggatcacctgaggtcaggagttcaagaccagcctgcccaacacagggaaaccccatctctactaaaaatacaaaaattaggcaggtgcgatggcatgcacctgtaatcccagctacttgggaggctgaggcaggagaattgcttgaacccaggaggcagaggttgcagtgagccgagatcgtgtgactgcactccaacctgagcaacagagcgagactctgtctcaaaaaaaaaaaaaaaagaagaagaatgaattggaggctgggtgtaatggcttatacctgtaatcctagcactatgggaggccaaggtgggaggatcacgtgagcccagaaattcaagaccagcctgggcaacatagggaaaccctgtctctacaaaaaatacaaaaattagcagggcatggtggcacatgccagtagtcccagctaccagggaggctaaggtgggaggatcacctgagcccaggaggttgaggctgcagtgagccgttattgcaccattgcactccagcctgggtaacagagcgagactctgtctcaaaaaaagaaagaaaagaaaagaaaagaaaagaattgaaaaggacaagagtgggtccaagaggccagtaacagactgctacagtaatgcacacatgagatggtggtagcctgaattatgggagtgccagtggggatggaaaggaggattgcttggatagggcagtaagggtgggcgaaatgaaggaattccaggtttctggcttggggtagcttgttaaagacttgggccattcatcactgagataagaaatacagaagaaagaataaatctgacactgtcaagaagaaaggcaacgatagattctaggtgtgtcgagttttgagtacttgtgtactatccaggtagagctgcccagtaggcagttaggtgcttggttttggaggtcagtgggaggtcagagccaaagataaagatttgggagccatctgcctgtaggaggtgtttaaagcaaaagctatggtagaatttcctagaaaaggtatataaattgaggaggaccaaaagagttcctggttatcagtgccaaatattgccccctaagaaatccagtaataatatagccaaaaagagccactggatttggaaaccaggaggtcgacaatggaatacatttcatttattcaaatgtttattaaatatctactatgtgttaagaatactaaggatacagaagtcaataaaacagatcaaaaaatccctccttacatgtagctgaaattctagttgcagagaaggagcagataaataaaggaaataaataagtaaattattccaaatattaaaaggcagtgaatgctctgaaggttagataagctgcctagggtcacagggccaagtaagtgaagaaactaggactagaaacgaacctgctcaactccagagttgtgctcttcttactgttgtaccacacctcctctcccacatcgataatcttggttccattgccacagaatgccatatagccccaactaaacatttcagaaacaaaccaaagtatgtgtatagcttaatctaaactcaacaccatttctgaaagccagctctgaggggacatccccttcacagtggacaggtagtaccagttttatatgtagatggtatattgaaaagtcatttcatctgatcgtaaaattatttttctaagaggatggctgggtgcagtggctcacgcctgtaatcctagcactttgggaggccaaggcaggtggatcacttgaggccaggagtttcagaccagcctggccaacatcgtgaaaccccatctctactaaaaatataaaaattagccaggtgtggtggtgtgcacctgtagtcctagatactcaggaggctgtgacaggagaatcgcttgaacccgggaggtggaggctgcagtgagccgagatcatgccactgcacaccagcctgggcaacagagtgtgagactctgtcgcaaaaaaaataataatattaaaggagaaaacgttcctttcagagatggagcattttggtaataatagggttccgtcaggatggctctgaaggtggtgatgatgtccacggggtggccaaaatggtataaaggtgaggatcactgaagccgaaggccagaaactggtcatgggctgggtcgtctttatagatgccaaagttacctaagatgacggcgaggctaggagagggtgagccaccaggtatcacagtcttcaatgaacgtggaagagtggccagattagtagataatagcaggccaaggagtatggttcagtgacatcagccccagctaagtgcttctgtcgtgagagtgaaggaggaagggtttgggaacagcaacagagagcgagaagaatgccaccatcacaatgctccctaccctgtcacatctgtgaggtggagaaatgaacagcctccgcttgggagcttcacaggggaaggaccagtaaagacaaggaaacagaatactttaaaaaggctaagggcatgggattatgtttatcatgtccagaaggcacaggttgggagggaatgtaagtatgaaattgaatctgtcccaaatgtctgcttccttccaggcaaaataaacgacaaatatatggacagggtatcatgattgtattgcacgttaatatctgttctaagcccacagaacaagaagaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtcatgcccttcaatcactgtcattcctctcccaacccacactgagccagctttccttttgccatctttcctgattccaaaaagagttaccatttgtattgccaccgccattatctcactttacaagataatttaccctgatccaagttgactgcagacacattgatgttttctttttaagaacttaacttgattttcatttttggttttaacagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctcc

SEQ ID NO: 4968 - DNA, 53773 bp, human
acgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaagtaagagccgggcggggccggggaaccgggagaccggacgggggtggggtgggggagccgcggcccgacgccgccctgctgcctggactcggggccctggagtagggacggcccccttgtcgatcacctggggacccctcggggcggtgggccacctctatggcccccagagtgcagccccaatgcttttcacgttctcttggggttaccgccctgcaagatgcagttttgtggtccgcagccctggtccgagaggctttccggattggaccgggcgaggaggtggaatgcagcaaaggatttggaggaaaggaatgaaaagctctccagagagatgagtcctaaccatttccaccgtcctccaatttggaaacttttgcttaggctggcttaggaagagagagacccttttaaaggtgtttttgtctgtgtgacccaagccccgagaagaaagtgcttggtgtggggaaaggacccgatccatcgatacgaaaaggccgcagatttttgcccacacatctccccaacttaaatgaagcttgacttcaggctccgacagaggctgcagcttcccctccccaagctgagaacggccccctcagcctaccgcttcaccccactggcctcatttatttgggccttttccaccttctcccacatcaacagctgctccttaggaaaagatctaaaggtgtaaatgcagccttaaagcttccaccgagctcagaggtacctgcatttgaactggaaaccaagcctgaaagaatgaattggtagtgatggcatttcaggaagcagagatgtttctgtattggggggacggtccctgtgttcctcattcagtgggcacagtggcatctttgatatcgccttggctctgaattagacaaacagcccacatttgggagagtcggtcttgaccgcatagtttagtcttggcggctaatagtcaaaggattttgccttgacactgtcactcacctgggaggccagaggtggaaggctcacctggcagccgacaagccgaacggaatcatccttattacctaggcctctaggccagtactcattttgcctctgcctggaaatagagttcccttctcttcctctgcagagggactcatgggtgggaccatgacatttagttaaggccctttttcctccccacctctgcttgccctcatcaacatctggcctgcagtctgtaaacagttctcctctgagtcttaatgactcagtttctcccccacttcaccctcttctctacaaagtagtgtggaaatcttcctttggatgggataaaatatgtccagaggggtggggggcagaacttcaaaggctggtttaagtattgtggctcttctgctaagcacctagtatatgcacattagattttttaagctcctgcctcctgccctgtaaggtccataggacaggaagcattgtgcctgttttacagatgcagaattgggctcagagtgatgacacctcttgtcagtgaccgagctgagctccactacctggccttctgactccaaatctcatagtctttctgttacatcatgctgcctccctgcatccatttgacactaatttagtcaggctacattaagtccccactgtgtgcacgatgctgaggacaatgccaggatggaaggggcatggtccctgtgccccaggagcttacagagtaatagaagagtaagactaatatgtccatgaccataacacacaaggtagcatgtgattgtcatggataatgtgctctagaaatgtacccttctgatgagcgatgaggaggagaaaatgtgaagacttcatagaggagaaaaaaatttgagtttggcattgggagaatgaggagtctgctgggcagagatggagagaaagatactgcagttgatgtcagcaaatgcacagaggtgggaaggcaagcagcacaacaggaagtccaaccagaaaagcaggttggaatgagatattagagggttggattaagggatttggacttgacttggtatccaagggtagctgtgggaggtttttgtggggggtggggggaggtgtgttgtgattaaagcaattcaatggaaatgatcgtcacatcgtggcagagtaagatgactagagaggaggaagagtggagacagcagggccagttaggaacctgttgcactagtccacatagcagctgagggcaccggcaataggtgaccatgggagcagagaggaggagatgtctgggagaacgagaacagagacttacctgggctaggtttgctaggaattttttttcccctacaggattattttctttctgaaaactaaaaggaagtattttggtgaatggcaaggcatagttggaaagcaaagtgtttgattaatcgcgatgccatccttcctacatcaacatgatactcttgattcatcattatactgattcatttctactcttttctgaccatgaatttgcaaaacagttggctgggggcctgtgatcatgggtttgaacaaaacataaacatccagaatgttcagggaatggggtagttaagtgacttgtccacaaatgcaattaatggaagagctggaacttgaagccaagtcttctggctccttagttcaggtctctgtctaccattgcacagcagaaatatctgcttagttggattgacgatcaagagtccactcagtagtctgttgggagctaggttattgtaatgggtggctttcagatgtatcaaatagaagacccccccgccctggaacttcacaaccgcttgtctatcttatctaataaacgttagtttgggtccctgcagctctgaaattgttcataaccaacactatttctttattgaataagcacttcatgagcttatgtttggctgcactggctgccaacctgttaggttgaagtattggcagttataattacacatatccagggtgtgtgttgtatctgtgctggctgaaaggaaggggttgctgcaattcaccagtgtatccagtctcactggaaaaagcttctgtgcatgtatgtgtgggggtgggaggaagaacagaaaagggaacagtgccgccctagcaaatcaaaagtttaagatgcatggactgagatgacatcattggcggattatcagggttgcctgccctgactctgagattctaaggggaacaattgataggacttatctctgtatcagatgggagaagtctgcgaaaaaaggacttcctatggttcttctttttaattgtgtatatttgatattgagactctataaaagaaactgatataaaatacggctcctcttcctagttcatcaagtcattcagtgaattaagggcctgtttcctctccgcttgcccctaccagtcatttccttgtcagaagtgttgaactcccttaggctctatgctgaggactaacacagggtctgatacattgtagaccttcaataaatgagtagtgaattaactatgccctagaagtgaccaagtgggatggggaataagagtgggacaaggagaatgaatggtatttctttgggcatttcaaactccaccttctaggtggttccagcttgctgcagaccgcccctccagtcaaaaatttctttttttttttttggaagaagtattgctctgtcgcccaagttggagtgcagtgacgcaatctcggctcactgcaacctccacctcccgggttcaagcgattctcctgcctcagccttccgagtagctgggattacaggtgcacgccaccatgcctggctaatttttgtattttcagtagagacggggtttcactatgttgaccaggctggtctcgaattcctgacctcgtgatccacctgccttggccttccaaagtgctgggattacaggcgtgagccaccacgcccagccccagtcaaaaatttctacttcctctgtttcccctgtcctttctgaggtccccctccaacttgactggccagggtatagaagagggaggaacgaggaagtgggcaggcaggcagtacaactgaggcagatagtctgttggtgaatgccacctgtttgagaaaaacctctgtcaaacttggtttttcctctgctctcacaccacaacaacaaccctcaacacagaagacttctgtgaccaaatgagtgtggggaaccccacactctgataaatggacaccaactaggtgtcctctgattcagttctgacactgtctacctggacataatgtcagaccaagccacaggttaagggcttggtccccaagaatggcccccaaccagacactagtcacaagtccaggcctccagaacttttttttttttttttttaagactgagtctcgctctgtgacccgggctggagtgcagtgcgtgatctcggctcactgcaacctctgcttcccggattcaaactattctgctgcctcagcctcctgagtaactgggattacaggcgcccgccaccatgcccagctaatttttgtaatttttttactaaagagaaggttttgccatgttggccaggctggtctcgaactcctgacctcaagtgatctgcctgcctcggcctcccaaagtgctgggattacaggcatgagacgccatgcctagccaggcctccagaacttctgaccaaccagcttcaagttggggttcccacgaccccctctttgggttcgattaatttgctagtgcggctcacagaactcagggaaatagttaatgtttaccagttaactacagaggataccacaaaggatacagagaagagatgggcagggtgaggtaaggggcagggggtgtggagcttccatgccctccctgggcacgccacccttcaggaacctccacatgttcagccatccagaaggttcccaaaccctgtcctctcgggtttttatggaagatttgttacagaggcatgattgacaaccatgtagaaatgtgactggatgaaaagcacatgatctaaacccagcaaggcctgtctgttcagacttttcttggcctctatgcagcgttcctttctctagggcagaggtgtccaatcttttggtttccctgggtcacactggaagaagaattgtcgggccacacataaaatacaataacactaacgatagctgatgagctaaaaaaaaaaaaattgcaaaaaaatctcataatgttttaagaaagtttgcaaattggtgttgggccacattcaaagccatcccgggccacatgcggcctgtgggctgtgggttggacaagtttgctctagggtatggggcaggaccctctctgggatgaggatcttttaacccacaatcagattagagtcctaccttgggcaggtaaaaggagggcaggagaaggtcaaagagagaaagattctgtttcctgagacctaaagtgccccaacattataacaaggactagggaagttaggagccaggaaccatgggtgaaaaccaatgtatgtatcatagcaccacatcacctttacttccctgtatgtttaaaagcagctgattaactcaaatgactgtttcagttaatgcggctaaggtaggttgacaaaatgaagtcaagactcctacagcttgaagatgtttttaatcagtgagtgtttacttgaaagcaaaagagctagcctagaaccccttaaatgctttcacctgaatgcccactcttatttctcatgcagcagcccctggcctatgggcaactgaaagaacaggaaatgcacctcctcactggaggtttgaaggctaaggaactggggatgctctcattttaaaaagataggccgggcacagtggctcacacctgtaatcccggcactttgagaggctgaggcgggcagatcacttgagcccaggagtttgagaccaggctagccaacatggcgaaaccctatctctacaaaaaaaaaaaaaaaaaaaaaaaaaatagccaggcatggtggcgcacatctgtagtttcagctactcaggaggctgaggtgggaggatctcttgagcctgggaggtggatgttgcagtgagcccagatcatgccactgtacttctgcgtgggcgatagagtggccaccgcacccggcccagaactgggcactttgggaggccgagcggggtggatcacctgaggtcaggagttcgagaccagtctggccaacatggtgaaactccgtctctactaaaactacaaaaattagctgggcatggtggcgtgcgcctgttgtcccggctacttgtgaggctgaggcatgagaattgcttgaacctggggaacggaagttgaagtgagccgagatcgtgccactgcactccagcctggccaacaaagtgagactctgcctcaaaaaaaaaaaaacgtaattactgagatgctcgaagttatcatttgaagaaattttgttcctttttaagtttcaacagaactgaaagactgcactccagttggtatttaccaggtacttctgtgcatttacaccccacaggcaagccagtgttgacaattatgtagataaaagtagaaaatgctttaagtgggaaggacttgggatagatgtaaattaagaaagttaggcatctcttatagccaactagcatcatataaatatagaaaaatgtaaatgtattattcatgaatgcttatatagtactatagtaacttttcactttgtaaagtactttgaaatgctggaaaatatttcaagaactagtggagagaactctagcacaatccatagttgatttctctggcctttccccctattttctcccagatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtaagatggaccttttcaccttgtccaagaaaaggctatgttctctgaaattacaaatgtattgtatacctttgtgagccactaaatcagttttactgagatcaaggttatatggattcaacctacatagaggcaattagcttcattctattccatagccatacactccactcctaaactttggccagttacatccccgggaggggagtagaccagaaagtggaggtgactcagcaaactggtaagaatgcaattctaaccactctccatctgactgcagaaggagtattcagtgtacatacacattgatatgccatgagggcaactagggtagcaactgtgtcttctggggtctttgtaacctttgccagagctacacatttatggcccaattgcaaaatccagtagactttttccctttatctgaacttggttgcagcatttgataaggttgaccaccccttcttctggaaacttggcttccaggacccctccaagtcctgggtgtcttcccatctctctggcagctctttcttatctgacttatccggcccatctgggtcgtctgatactgccagcccctacatgttgctcttcccctgggctccttccttagctttctttttaccctcccctttagcttgcttctcatcctccaaaccctccctaggtggcctcatctatgctagtggcttaagcaagcgtcagtgtattctgtgacccttattctctacctctttagtaacaatggccaacttttggggggaagtacttaccatgttctgggtactgggccaaatgcattgcatgcgctttctcatgaggccttattttacagatgaggagatagatgcttcaggaagctaagtgacttgcccaagtccacatagatagaaagcaggagaaactagcaatagaactccagagccctctgttagcccctgactgacaccaattcccaatggtagtatgagtccctgctgttggacaccttcacctccatgctccctaggcacatcaaattcaagattaaccctgatgtcctcgttggtctcaaactagctcttcctcctgtgttccctaatgaatgagactaccttcctttcaccccgtggcccaagccagaaaaaaaagcctagggatcacttcaacttctcctctcactccacccccacttgaatcaccaagtcccgtcgatttgactcatcctctttcccacaggtccttacaactcagactctcagggtctcccacagactctggctcctacctgcttccactcttggtatctcctgccccagtcttccccgtgcactgctgcccggctgaggtgatctctccacgtgcaatttcatcgtttcacggccctcatttcactgctctccttaaaaagtattcagcgactcctgagctacaggagaaagcccaaattccttaggacattctagatccttcagacctggcccctgccagtttgtcctacctcatctcctgccatacctccacctgcattcatgctccagcccttcagaaaaacttggatttcctggaaataccactccctttatacatgctattccctttgcctttccactctgtcaaagtctgatgaactcctatttattcctcaagacccagttcaaaagttctctctttcatcaagtccctcctgactcccccaggcaaaattaatccctttgatccttgtgtacctaatgcatttcatatagcccccctgttgtggcacacatcaggggtgttatactgactttgccctggctgtctgttctcctcgatgatgagcatctccagaaattagcccgctcctctttcgattcccagcacctgacatagggcctggcacataacctaagctttccagacattttctgaatgaaggtaaatggaaggttggtgagccaattaaataaacattacatttttctaaagataagcaatttcacttgtattatcccctattttaaatttcattttgagggagaaatttagtccctctgtaaactaaagatggctcctaaaggttctggaagtttgtgaaagtgccacctactatattacttactcaccatctcagttcttagaaaggtgaggaagccacacagtgtagggtgcccactgggccatgatatgaccatgtcattcccaaaggtgaagtcaggtgacctccctcaccatcgagagtctctcactttccagttttcataaaatgtttccttctcagctagagatcagtccctcctgtcctccaaaacataatgaggtgctgcccactggctttttttacttgagtgattttttccccgaacattaaaaaaaagcttcaaacatctagaaaaattaaaagaaatctagagtatacatccatggaccatctagatgctacaattaacattttgctattcatccctccagccattcatcagtccatttttattttatttatttatttatttatttatttatttatttattttttgagacagaatcttgctctgtcacccaggctggagtgcagtggtgcaatctcggctcactgcaacgtctgcctcccaggttcaagcgattctcgtgcctcagcctcccaagtagctgagattacaggcacgcacctccacgcccagttactttttgtatttttagtagagatggagtttccgttttagtagagatggagtttagtagagacgaggtcaggctggtctcgaacccctgacttcaagtgatccgcccacctcggcctcccaaagtgctgggattacaggcgtgagttactgtactcagccagcccaccttttttttttttttaatgatttcagtgtaacttgcaaatatcaatacacttcacccctaaacccttcaacatgtgtgtcattaactagagttcaatatttgtgtatggttcttttttttgagatggagtttctctcttgtcacccatgctggggtgccgtggtgcgatctcagctcactgcaacctctgcctcctgggttcaagtgattcttctgtctcagtctcccaagtagctgggattacaggtgcccaacgccacacccagttactttttgtatttttagtagagatggggtttcaccatgttggccaggctggtctcaaactcctgacctcaggtgatcctcccgccttggcctcccaaagtgctgggattacaggcatgagccaccacgcccagccgtatggttgttttttaaagtacaatttacatccagtaaagtggacaaacctttagtgaaccatttgatgcattttgacaaatgacacaacccctaccaaaatatagcacattatcgcactcaagaaagttccctcatgctccttgggttggagggattttagcaaccccagagcccctcctgttttctttccccggaatccccccaggaatttatgttctcaagccagtgttttcccaagacagcagcagcttctccctggccttgttttgcaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggtgaggagttatcagagtggggtagggggtggaatgctttgtagtgtttgtggtcgggtaataacagcaaagaacactgaccccaagtgatgccaggtttccaaggagcttctgactgctcataaatactgtgcaaacccccactctgtggcatttctgctgctaacctcagagctgttggcttgagccccggctgcctcctcattcccatcctctgttttttggtcttttaagaagcctccaggctaggggcggtgattcacgcctgtaatcccagcactttgggagggcggaggcgggtggatcacttgaggtcaggagtccaagaccagcctggccaacatggtgaaaccccgcctctactaaacaaacaaaaattagctgggcgtggtggcaggcgcctgtaatcccagccactcagaaggctgaggcaggaggatcacttgaacttgagaggcagaggttgcagtgagctgagatcgcgccattgcactccagcctgggtgacacagaaagactatgtctcaaaaaaaagaaagaaaaataagaaagaaagaaaaaaaagaagcctccagatgaggcttctcttttctttcctgacttcctgattatatcacttgtggctctccttcctccaagaccagcagagagtagaatatgaaatgcagcctgctaatgctccctgtccttgctgcctccacagcaaggatgccactcttggtttcctcactgtgccttacctcagtgaagcagactggataggaccaacataagctaggaactgtagctaacaagggtccagcatccctgactccctcgctgaggaaggaactgcatttaaaatgtggcagcatcaggccgggcacggtggctcatgcctgtaatcccagcactttgggaggccgaggtgggcggatcccctgaggtcgggagttcgagaccagcctgaccaacatggagaaaccctgtctctactaaaaatacaaaattagctggttgtggtggcacatgcctgtaatcccagctactcgagaggctaaggcaggagaatcacttgaacccgggaggcagaggttgcagtgagccaagattgcaccattgcactccagcctgggcaacaagagcaaaactctgtctcaaaaaaaaaaaaaaaaaatgaggcggcatcttagtgagaccactgaggcaaaatcctagaatcagaagttccaaagtgagtaattgtcttagcctagaataagccaattttgatcaaagaaaaatcagactagttcaaataaggttgggtgggtaacagttatatctgtacagtgggggcaggcccagaatcctagcagggctgaggtgctgtatcttctcttagccctgctcaggcccttaaaattcaaaaatagctaatgcatgctggacttaatacccaggtgatgggttgataggtgcagcaaaccaccatggcacatgttcacctacgtaacaaacctgcacatcctgcacgtgtaccacagaactaaaaataaaaatttttaaaaaaattccacttccataggctaggctgtctccatggcctcttctgggcaaaccctgatttatacaagcaatatattcctgaagaactctatagaaattaatttggggtcagctgaatccaagtttaaatgagcagtcccagccaagtttggttttcccctgtgactctaacttgtcctcgcttgctcaatgtccctccccgctcccgctttccctctgtagtagtcccggctgccctgggccatcgcttacctcagcactaaacagcctgaaggtgcttatcaaagctgccactccactccctgaaacttcatctgtctgggttgcattcctttcctgtccttgtccaaacagataattgtcgcatcattgtaatggtagtataggtgcaaaatttttctattcgttggtaagaagtctttatatattaaagatattaaccctttgtcatacatttcacacaatttttccagtttgacatttggtgttttttttttttttgagagacagagtctcactctgacacccaggctggagtgcagtggcacaatctcagctcactgcaacctcctcctcctgggtttaagcgattcttctgcctcagcttcccaagagctgggactacaggcatgtgccactacacccagctaatttttgtatttttggtagagatggggtttcactatatgttgaccaggctggtctcgaactcctgagctcaagagatccacccgcctcagcctcccaaagtgctgggattataggcatgagccactgggcccagccaacatttggcttctagtgctatttatgtgttgttggtggtggtgctttgttgtacatatttgtagaattttatctaattatatctattacttttttgtttgtttgtttctgactttgcttttctgcttaaatgtaaagtctgcttagtgcatgcttatcttttttttttaagtatttctaattttaaaaataatgcacatttggaaggccaagatgggaggatcacttgagcccagtagtttgagaccagccttagcaacatagcgagaccttgtctctactaaaaataaaaaattacctgggcatggtggtgtgtacctgtggtcccagctacttgggagactgaagcaggaggattacttgggcccaagaggtcgaggtcacagtgagctataatcctgccaccgcattccagcctgggtgacagagagagaccctgtctcaaagaaaaaaaaaagtaatgcacatatactttaaaatggttaaaatggttcattttatgtatatttgaccacaatgaaaaaaaagtaatacacataagttgtagaaaatttgggacatacagaaaagtgcaaaaaggaaaataaattacccatagcccaacacccatggattataatgattaatagttttccttctatggaccttcatatatatacataaacacactcacacacatataaagatatataaggttatttcttttacaaaattgtgttcacactgtatataaaaattagtatccttaggccgggcgcggtggctcacggctgtaatcccagcactttggggggccgaggcgggtggatcacctgaggtcaggagtttgagaccagcccggccaacatggcgaaaccccgtctctactaaaaaatacaaaaattagctggtcatggtggcacatgcctgtaatcccagctacttgggaggctgaggtaagagaatcccctgaacctgggagatggaggttgcggtgagccgagattgcaccactgcactccagcctgggcgacagagcgagactccatctcaaaaaaaaaaaaaaaaaattagtatccttttttcacttattatataatgggtatttccctgggccattaagtatttaattatcaaataatattccaccatatggatgtgccaaaaatatgtaacaatttctcctttttttaatatttaggctttttctaattcttgagttatactaacattgtaatgaaaacctttgcattttttcatatctgtgatgatatccttaggctatattcctagaaattgacttataggtcacaaaatatgaacaattctaagactcttcatgaaatgtgcactccagaaaggttgtaagtttgtaattccaccagcactaaagcagtggctcagcttctaaactctcaatattcattgatattaattatcaatattaattgtcactttttaaatcattatgaacctaatagctgaaaaatagtatcccatcattttaattttaatttgattgattataagcaaggttgcactggccctttgtatttctttgtaagttttgtatttatgtccttgccctatttttctagaatattcaactttttctattcattggtaagaagtctttatatattaaagatattaaccctttgtcatacatttcatatatttttcccagtttgacatttggcttctaatgctgtttatgtgttggtggtggtggtgggtttttgttttgttttgtttttttagacagggtctcgctatgtcgcccaggctggagtgcagtagcagttcaagcatttctcctgcctcagcctcccaagtagctgggattacaggcacctgccaccatgcctggctaatttttgtatttttgatagagacacggtttcagcatgttggccgggctggagtggtgatgttttgttgtacatatttttagaattttatctaattatatctattagtattatcttctgtttctgactttgcttttgtgcttaaaaggcctattctatcccatgatcctatgactattcacttatatgttatttaaatacttttttagttgtgatttttacacttggcttcttttttttttgagacagggtctcactactgcccaggctggagtgcagtggtgcgatctcagctcactgtagcctcgacttcccaggctcaggtgattctctcacctcagcctcctgagtagctgggactacaggcatgcaccaccacacccagctaattttttttttttttttttttttttgagacggagtcaggctctgttgccaggctgaagtgcagttgcaccatctcggctcactgcaacctccatctccctggttcaagcaattctcttgcctcagcctcctgagtagctgggactacaggcacgtgccaccacacccagctaaatttttttttgtatttttagcagagacggggtttcaccaagttggccaggatggtctcaatctcttgacctcgtgatccgcctgccttggcctcccaaagtgctgggattacaggggtgagccgccgtgcctggccatcatacccagctaatttttgtattttttgtagagacagagacttgccatgttgcccaggctggtatcaaactcctggactcaagcaatcctacccatctcaaactcccaaagtgctgggattacaggcatgagccactgtgcccagccttacacttaacattttaatacatttagaatttacctggtgtggcagggtgcagtggcttgtacctgtaatcccagcactttgggaggccaaggtgggcggatcacctgaggtcaggagttcgagaccagccgggccaacgtggtgaaaccctgtctctactaaaaatgcaaaaattagccgggtgtggtggtgcgtgcctgtagtcccagctactcaggaggctgaggcaagagaatcacttgaactcaggagatggaggttgcagtgagctgagatcatcccattgcactccagcctgggcaacagagcaagactcagtctcaaaaaaaaaaaaaaatttacctggtgcacaggtgccgtgactcctgcctgtaatcccagcactttgggagtttgagataggtaggatcacttgaggctaggagttcgagaccagctggccaacatggtgagacccgtctccataaaaaatacaaaaattaactgggcacacctgtaactggtgcacacctgtagtcccagctacttgggagactgaggagggaggatcacttgagccctggaggtagaggctgcggtgagccgtatttgtgccaccacactccagcctgggtgacagagcaagaccctatctcaaaaaaaaaaaaaaaaaaaagaattttcctggtgcatgatatgaaacagtcatctaagttttttttttaatagtttaccaattgtttaagcaccattttttgaataattcttttctccactactttgtgctgcagctttcaccacatactaaatgtttatatctattctagggtctctatcttaatgaccataactttagaaaaatgccttttttttttttaatttttttgaaatggagtctcgctctgtcgcccatgctggagtgcagtggcgtgatctcagctcactgtaacctccgcctcccaggttaaagcgattctcctgcctcagcctcccgagtagctaggactgcaggcatgtgccaccacgcccggctaagtttttgtatttttagtagagacaaggtttcaccatgttagccaggctggtctcgaactcctggcctcatgatctgcccgctttggcctcccaaagtgctgggattacaggcgtgagccaccgtccccggccaaaaaacaccttttaatgtctagtggaatatagccctcctcattgtttttcttttcaacatttccttgattattttcgggcatttgttcttcctgataactttagaattaccttgtgattatgattggaattatgtaaaacccatacacttggagtaatttatgtaaaatatttcatcttttattcagagacacagtatgtctctcctttactttcaatcttctttctttagcttgaaccagatgaaattaccaatattcaactttgttgacatcattcaaacagcaatttcatctggttcaaaccttagaaaagttgttttcttcaaagggaaattatgctctctctaaacaaacaaaaaaatagtttctcttaaaaaatctggggagaagtagggtaggaaagaagtatgatatactgtaagtgttttattcattttttaaaaatcctggtcctaagaatttctcactgccaggggcatctctccagcactttcagccacttcatgcctagttcaaggcttcgccagcttagcttcctccccatagtgggccagtccaaaacaaccagggccttgagcctcaaggggtagggctagtccgtgaaaaagggtttcaggccaggtgcggtggctcacatctgtaatcccagcactttgggaagccgaggcgggtggatcacctgaggtcaggagttcaagaccaacctgaccaacatgatgaaaccccatctctactgaaaatacaaaaaaaaaaaaattacccaggtgtgttggcacgtgcctgtagtcccagctactcaggaggctgagagaggagaatcacttaaacctgggaggcggaggttgcagtgagctgagattgtgccaccacactccagcctgggtgacagagcgagactctgtctcaaaaaaaagagaaaagaaaagaaaaaggtttcagatgaagttcaatgacatctaaatgggacgggtaagggtcccagtcttccccataaaccttagttttgctttctcttcctgagagctagaacagtgacctcatctgggagaatccagccaacaccgcattctacaccatctgcattctatacccctaccacaacaacccactataaactggggtaagatacactagaagtgggtatttgggggtaatcctgatcatctttttcctcgtatgggagccttccaaataatgcatatatagagcataagaagaagtttcaaatagatgcaaagtcatgatggttgtaaaaaaaaaaaaaaaatccaaagaggtaattgcactgttttcacaaaataggatcaacatgtaattatgaataacaatataaatgtcatccaaagatataggaagtgaacttttagggtttcagtgaaagtgttattttgcaggggttaataaacatactaatactttgtccaccctatgttaaaaaaaaaattcacccccaagacagaactgcaggctgcttttaaatgcaaacatggcattgggcttctctggccattagatgtcactgcagtaaatggagagtagctgagcatcacctgattggagcctgaagttcggtgatctctgtccagttaacaacttcataatccctgcttgaaatccatctttggtttggagaataagaggcctagaaaccacaggctaatgctaaacttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcaggcctgtgcacacatggaatgaggtgcccccaacttggtgtgctttcacggaccccaaccaccctgcctgaaatccccttctccacgcttcagtgcatcttagctcaagcccttccaggtatagcctggcctttttgtctatctcccacacctagcccagggcctgggccagaagagatggcagaacttagtgtattgagagaacaagtaggaagggtaaaatattgacagagatgaattcatctgattaatctgtgcaccccgaataagaaccagggagtcctgagaaaatggctctctgcacaggtgcatgtgaagaagagagggagataggctggggaatactgccctgaaaatccagggagcagctgagaatgtaggagccttggaatctggcaggccttctgaaaggatcaggagggaggtaccagacacatgctcggtccccccacaactctgcctgacaccctcccctattgcccatattaggtgtctccatttcatcaaatataaaaccaagtgtgagcctgttgctttataccccagtggactttgaccccatcacagctcacaaggtaagcaggattgggccaggtcagcatttgaactgaaagcacataagatgaaggacaaaggtggtatccgagtggtacagctgactgagcagaatatacatggtcagtgaataaacagaggccccagcctactcaaatagagatgctcgacacctcgggttacctttgttgaattggacacagtcacttcattcattccctctcagggtgctcatcccctcttgtagtttttcatgttcatatctacatcttcaatcctgacctcccttctgagccatggtcccacatttcccacagcctgctcgacatcactatttggctatcatatccccactgtcacctctaacttaatgtgcatcaagctgacctcttcttttcctaacactgttattccagagttttccatttcaattccatcattgccccagtgactcaggctggaaatccacaacttgtgtttgactcttccccttcccctcacccggttaaccttgagccctgttgcttcttcattcctaacattcccatgctggtctttctttttgtcactgcctcttgccctaatcttggaccttatcagctcatacctaggctattacagtaatctcctcattggtctccaggattaattctaaaaatgatcttaagcattgaatattaatatgtactaggcactgtgctaagtgctttatgttcattatctcatttaatccttacaacagccctacaaggtgggcactgttattattaagtccattttacagatgagaaaactgaggcaccgaaaggttttgtagcctgcaagttcacccatccagtaattgagctgggatataagcccagggagcttgtctccagagtcagtgctcatttcaatcctctccagcccagcccatatgggattctgtcagatgaatctttctcagatctgtctgcgttagatccttttttttttttttttttctttttgtgagacagggtcttgctctctctcccaggctggagtgcagtggcacaatcacagctcattgtagcctcaacctcccgggcccaagcaatccttccacctcagcctcccaagtagctgggaccacaggcatgcgccacctatgcctgactaatattttaaatgttttgtagagatgaggtctcctggtctccttatgttgcctaggctggtctcaaactcctgggctcaagccatcctcccgctttgacctcccaaagtggtgggattacaggcatgagccactgtactcagcctgttgttgtgtccttcttgatggtccccagagaaaaaaggctgagccccttggcttggcatgtttcccttaccaactgtgcgatccttgttgcacagaggccctttatataagaagttacaaaaacaaatgcctgcagaaacttggaagtaacatgaaaaagagaatgtagggaaacccagataacatacactcaccctgtaaagaataagccttcaggctgggcctggtggcccacgtctgtaatcccaccactttgggaagccaaggtgggtggatcacttgaggtcaggagttcaagaccagcctggtcaacataatgaaaccccgtctctactaaaacacacacaaaaaaattagctgggcatcatggcaggtgcctgtagtcccagctactcaggaggctgaggcgggaggatcgcttgaacctaggaggtggaggttgcagtgagttgagattgtgccactgcactccagcctcggtgacagagcgaaacttcatctcaaaaaaaaaaaaaaaaaaaaaaaaaaaaagccttcaaatgcattccgagccatcatggctttcaaaagcattctggagagctaaacttcactgtgctcacaaaatgtgatttgcatctaaatatggatgacagaaaggaagaaagagagccagtagaggctgtggccagttcctcctctccaaaggacggatgccatttagaaatgtaggcccagttttcaaaggagtctaaaatccagatttttatgtaaaatctcccagtttttcactgctggcaaatgaaaattgttaagtactggctgggctaaacaaaacacacattcgtatgacctctgctctattcaagcctccaagttcatcaaactaatcttcttagccccttctcccaagccctgaagactaagtgcatttcacattccagtcaccaggcctttgttcatgaggttacctctgtcttggaacatctgcccaattttcttaaaggctcaactgaggtttgtctcagtgatggctgtcttttctgacctactgtagcacatacctgttgtttaagaaatgagttggcttttcccatccccaaaacagctgtcctatcttgatggatcaaggtagatgttttgcctttgtagaaccacaatggaggtgctccagcccacttcagaggggattctggggcaagagaagctgagttaactaacaatctactcagttaataactgcagatgccgtattttcactgtcccccacccaacccccaagggcatagttattttgttctaagagctttgtgggtgaataccacccaccccctttttatttttgagacaagagtctcgctctgtcacccaggctggagtgcagtggtgcaatctcggctcactgcaacctccgcctcctgggttcaagtgattctcctgcctcagcctcccgagtagctgggactacaggcatgcactaccacacccagctaattttgtatttttagtagagatggggtttcaccatgttgcccaggctggtctcgaactcctgacctctggtgatccacccgcctcagcctcccaaactgctgggattacaggcatgagccaccgtgcccggccaaataaccccttttaaatgatgctgttagcctatacgtgccctctgatccagccagtttcttttccatggcatttctgtccatgccctacctcttcccatcttaacactattgccctgctgttccctcactatcaaagccgcctcctgaagtcttctcccatctccccaagcagtagtctcccgctcctgaatggctcactcttgctagagctgtcttatggcccatgccacatgcttccttttgttataatcttttgtgtcccttatttcctctagattgcaaactctttgcctgtgggaagtatgtcttacacatttgtatatcctcacaacacacagcctcatgtagcagacatctaatacttgtttaaaaatgaagtttagggacagcttaggagatctcgctgtctgctaggtgagtcccaagtccgtgtggttgtacctacccaagatgaaggtaagaacacccaagcctgcctcctgctcaacctgctgccctaagaaaacctctgcatgtcccctgtctaaaactgtctatgcacttcgctctgagaatgcactgtcttccatctcctaccctagcaatcaggttctatgcatctcagtgcaaacagccgttaacgtttcaggatagacaaatatgctaaaaggacaaaaggaaaaattcttgacaccattttgatttacacctcctcttcattccagcctcctggcgctttgtatggtggctggaagtgcttgacaaatcatagcaccatcaaatttatacagtcgtccctaggtgtctgcaggccattggttgcagaatccctctctgataccaaaatccactcatttctcagccctgaagtcggccctgtgaaacctgtggacacaaaaagttggccctccttatacacaagtcccgcatcccaaatttgattgtggatgcagaacccacagaaacagagggccgactgtatttattgaaaaaaatccacatataagtgaaccagcacaactcaaatccatgttgttcaaaggtcaactgtaggccgggcgcagtggcccacgcctgtaatcaccacactttgggaggctgaggcaggccgatcaacggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagtactcttagtactcctattttatagatgaggaaacaaggcacaaggtgtaagtcacttacccaaccatcacatagctagtaagtaagtggcgaagctgggacttgaacctatgtctctccttcctcaggccctttttttattcaccaagagtacaggagcctaatcctgtaggcaagggaactggatcattttgactttagttcccttgccccaggtgtgggactagaggatgagggagcgggaaagcaaaccttgatattgggagtccacagcctcagtgcaagagttgagaaaatcaatactttgcaagctcagaaactgagaggccatagccttgtcttaatccgttcaggctgcaataacaaaatatcataaactagatggcttataaacaaccaaaatgtatttctcaccgttctggagactgagaagtccaaggtcaaggcagatttgatacctggcgaaggccagcttcctagagccttcttgctttgccctcacatggtggaagggggagctagctttcttccatctcttttaaaaggacccgaatcccattcatgagagctttgccttcatggcctaatcacctcccaaaggccctgcctcctaaaaccatcaccctaggagtcaggatttcaacagatgaattttgggaggacacaaacactcagagcataacgagcctggctttggccagggaatggttaactcaagttagagagaggaaaaaaaaaaaatctttggaaaactgggctgtcctggggtctgctttagtccctggcagtctggcaatggaaagccctacttgttgctttgacttgagaagccgtaatgagcagtgagccacaggcatagaccattcagtagacacaggtctttggccagccttgaacgacaactgctcagagggactgggaagaaagcccgcctaccacagggggcagggctgggagcagaagcaaagccccaggatgggagagtaaattgttataactatccctgcgaggaggtgctaacaaagttccaggttttctgcctacttcaatatttcccggttggcatagcatctactcttagtaggaacagagttctatttgcctaacagagtcaaattacctgtccagaggtacaaacactgctaggttctaagccttcagggtagtggagaggagtggagccttacctttagtttgttgtattttcaactctctgctgtcatcttacttttaggtctggcccctttgtgaaccaaattcttctaactgagtagcattgcgttagcagtcagaaaaaaaaaaaaaaaagatgcttttcaaatataggtagatgtctggacatcccttaggcaaggtggctctgtatgagcgtcactattaaagtgaaaggaaaggaaaagtctccccacccttgtttttttttcaaaaggtatagagtgcccgaaatactttagggatggcagctgttgagcatggaaacaagacttgtccctagagggaaggcaaggaaggcatggggaagagccttcctaactccacttagtgtaaaatcactctgtcctcttcccctgacctgagctggcttattccttggaagagataaagatctgggagtcaaaatgaccaccctgtgctgagcaggcttctttgaactccagctaaacggtaacagcacctaagataggatgttcccaccctcactccccacctcaaagtggaggtgaagagggagataagggaaagggagagaaaggtcccaggaaaggtctgctgtcaagagggaggacccgcagctggctgggagcattcacaggaagtaccaattttcacctccttttttccacagagctgttgcttatttgcctacgacggctgtgttcctcttgaggctgtaatgggcagactagctcagtgggtaacagtgtgagctttggatcccagccttgccacttactcccgcgtgaacttgtgtacaccacataacccatctgagcctcatcttcctcatctgttttgagggtaagaatggtgcctacctcatctacttgcagcaaagactaaattcgtttagtgcaaatgcagagccaggcccataataagtactgtcaataatgctaagatgccatgtttattgttcttgaagcatcacttcagaatctgtgcacagcatggaaggcctgattagaaccataaaaaccagtccaaggccgggcgcggcgactcacgcctgtaatcccagcactttgggaggccgaggtgggtggatcacttgaggccaggagttccagaccagcctggccaacacgacgaaaccccgtctctaataaaaattaaaaaattagctgggcatggtggcgcgcgcccgtagtcccagctactcaataggctgaggcatgataatcacttgaaccaaggaggcagaggttacagtgagccgagattgcaccactccagcctgggcgacagagtgaaactctatttaaaaaaaaaaaaaagccagtccagatgtgtttccatgtttcctatgattactataaacacacaaatgagctgggctcacagaacctcaatagaccttggatatgtatagctaatgatgagcagcgacaggaatcgagagttcgtacagaattttttggtttggttagcgtaacaacaggctttacagacaggctccatgtgcaagcactgcacacctctgtatgttctcagccttctgagaactgtcactgccaaatcttttccttcaccctccccaccctatctcacccccaggcaaggtgacactttcaaagttggcacggcaggcagcacatgccaggcctgtgacccaggcctcagcagctctgctcacttgcatggcaattgctttctacagtcaggcccagctgcactttgggtctccccaacccccacccccaatcaccacacaggaactggctgtttctcttttcttcgtccaagctgaatactaacctactgtggtttgcttgcttcccccattgtgatcgcaggctttctgagcagctagtcaaccctctagcctgccactgaatcggaaggcattcacactggaggggatcaaggggagcttgtaggcttgccttgctggcgggcagctgcctacacccactcgtaccaatgtccccgctgcagagcccgggtgcttcccagctgtacaaggacaactatttgggtcccggctatgccaagagaaacatgggtcatgtggttcacaggacagaaaggttcatttactccaatatgactggcatttttttttgtttgattattggatatttgccaaaagactgaagcctcctgccacaaccacctcccccacatatatgtcctcagatggtttgggaattggacagcttagtcatcaggtcctgtcctccacatccacagaagatacaagttgtttccagataacatgcagaaggttctgagctccttcctgtgtgctccagctcgaagactcttttcttttccctatgaattttttttccttttctttctctggtctttcctttttaatgcccttttaaaattaagtattctatcttttgagtgggtaacacatacacatgatacaaaatccaaaaggtgcaacgagtatatgctgaaaagtaaacctctctaacctttgtccttagccattcagctctcctgtgagtcagtactgttgttagcagtttacctgtatctttccaaagatggtctatgcaaagatccacataaacttgtacatttatgttctgtttttaggtcagcagcagcacactacatacactcttctgtgccctgttttttttccacctgaaaatgtatctcggctgggcacggtggctcacgcctgcaatcccagcactttgggaggccgaggcaggtggatcacttgaggtcaggagttcaagaccagtctggccaacatggtgaaaccctgtctctactaaaaatatgaaaattagctgagcgtggtggtgggcacctgtaattctagctactcaggaggctgaggcggaggaatcacttgaacctgggaggcagaggttgcagtgagccgagatcacaccattgcactccagcctgggtgataagagtgaaactgtctcaaaaaaaaaaatgtatcttggaaatgataccacatcaatccagataaagctgccacatatttttcatttatgacatagtattcaacggtatgatatactatttatttaactagtccctgattggtggacatttagattatttccagtcttctgctagtactaacaatgctgtaacaaatctccttgttacatacatttttcacgcacatgcaaatagatctgtaggataaaaaggggtccccaacccctggtccgtggcctgttaggaacctggctgggccacacagcgtgaagtgagtggccagcgagtgagcattatggcctgagccccgcctcctgtcagatcagcggcggcattagattctcatagcagtgcaaaccctattgtgagctgtgcgtgcaagggacctgggttgcacactccttatgagaatctaatgcctgatgatctgagatggaacagtttcatcccaaaaccattccccccaaccccttgtccgtggaaaaatggtcctcggcaaaaccagtccctggtgccaaaaaggttagggactgctgggctaaattcctagaatttttgctttggtcaaagggcatatgtgtcttacatcttttttttttttttttgagatggagtcgccaggctgaagtgcagtggcgcaatttcagctcactgcaacctccacctcctaggttcaagcgattctcctgcctcaccctcccgagtagctgggagtacaggcacacgccaccatgcccagctaatttttgtattttcagtagagacagggtttcaccatgttggccaggatggtctccatctcctgacctcatgatccgcctgcctcggcctcccaaagtgctgggattacaggcgtgagctgccgtgcccagctgtgttttacatctttataaatattgttcagttatttcagtactcatggaaagactgaacaaccaaaacgttgcctctgttggaagacctctgaggaatttatcacaggaataatcaagtgctttgcttttaagtctttgttctttatttgtatctactgcaagtttgttatttctttccttcaatatgtattaaacacctcgacctctaccatgcaccaggtaagctttgaggccaaaaccataaacacaacaaatgtggttgctgcccccacagtatttacagtctaggagatggagcagttgggggcaggagtacacatgaacgaaataattatacactgagtcattacaaactgtgttaagtgccatgaaggagaagcacagggtgactgaaagtgttcagtaggctcctgacttcgtgtggaggtctcagaagatttccctggggaaatgatgtttattctgatcaataagacagacttagtgaggccgaggaaatggcaggtttgaagtcctagaggaaggcaggagcaaggattctggccagcagcatggattacaggatctggaaagggtcttcaaggacattttgtttcagtctcctcatttgacatgtgagaaaactaaagtttagggagctaaatgacttgaccagggttatacagatagtaacaaagtcaggctgcagaatccagtgtgctcatcctgggagctgtgggtctgaactagacagctatgggatagttgcctgggtttgtgtagaaggacttaagttcaggttcttgtgacaagctgcgtgacatgtttcatttctctttactagtaagatacagtttggatgaatggccattccaatctagcgggttggtttgttcttcagcatacttgtctttcttacaagtttaaataataataacaatggtggttaattctttagcgcttgctctatgtcaaatacagttctaagcaacttacatgtattaaatcatttcattttgacagcagttcttaaagttggtgttattattattaccccattttacagatgaggaaattgaagctccagaaggtaaaggcacttgccaaccatcacagagctagtgagtggcaaagcagggggaccgagtccaaacagtctggcttcagggcccatgtgctttgtctcccaggcactctcagtgtcagcagcaggctgatggactcaggtttgagcccagagctgccttgtgccatggaaggtccaatcagtggctctcaaccctggctgcacatcagaatcagctggggagcttgtaaaaagtgctaatgtccaggcctcgcccccgttcagttaaattgcaatctctaggggtggatcccagtcactgagggtttttaaaagcttccgtggtcagcctaatgcagctaacggttgagatgtactgggatctaggcttgccattgctttgccctttgggagcaaccagcaccccatacttgcctttgtgttctggacacccacttagtaggacacttgtagaggcacttattcataccacagcacaggctcctgtctcagcctaaagaactcattcagtgtacatgctttggcagccacatccaccagtgatgtgcggtaacaagtctgtaaagggctaagagaatattttcagtcctgagcgtcagaagacagtggagcttagtggagtggagcttggctctgagtcaaacagacccagattcaagttgatgctttgtgtcatggtctgtgattttagagactggcgtttatcctctcaccaactccattttgtcatccatataatcaagctaatacgataatactacctctttcatgaggcttttgtgaggattaaatgagatagtatatagaaagcaatcagtgggccaggcgcagtggctcatgcctgtaatcccagcactttgggaggccgaggtaggcagatcacctgtggtcaggagtccaagaccagcctggccaacatggtgaaaccccatctctactaagaaaaattagccaggcttggtggcagtcacctgtaatcccagctactcaagaggctgaggcaggagaatcgcttgaacctgggaggtggaggttgcagtaagccaagatcgtgccactgcacttcagcccggaagacagtgagactgtgtctccaacagaaaaaaaaaaaagaaaagaaaagaaagaggaaaaaaaagaaagaaagaagaaaaagaaagcactcagtgctaggccatgtctttatttcatgactatccacgtagcttatgtgagtaaacagctatatttgggaaaagctactagtgacactgatattgacaggaatttgatttgacatttaataagtgcctggtatgtacaatgaagagtgaaagatcctgaagagcttggatgactaggaaggccccgtgcctgctgactggcttgctggctgggagggagcataaagacacccagataactcatataaggtagagtgtgccgcagcagaggtctaaacgagaagctaagggaggccaggggcggtggctcatgcttgtaattccagcgctttgggaggctgaggcaggtggatcacttgaggttaggagttcgagaccagcctggccaacatggtgaaatcccatctctactaaaaatacaaaacagctggacatggtggcaggcacctatagtcccagctacttgggaggctgaggcaggagaatcacttgaacccgggaatggggaggttgtagtgagccgagatcgctccaaaaaaaaaaaaagctaagggagcacaagatatggagagagaaagccccaattcaaacagaagctggaaaacaattataaaataaccaaggaaatatgaatactaactgaactcaatatgtgatgatattaaggaattataaatttttaggtgtgataacggtattatacatatatttttgaggagcaattatagtttagataaacataattctaattaataatatgtaagtcagatgaattgaaatgatgtctcgtgggggtagagatgaaagaagattggccacgtatagctaattgttgaagttgggtgatggaactttgtgttcattttactggcctctctacttttatatatggttgagatttttcacaataaaaagttttaaaaagagggccgggcacagtggctcatgcctataatgccagcactttgggaggccaaggcaggcagatcacttgaggccaggatttcgagaccagcctggccaacatcgtgaaaccctgtctctactaaaaatacaaaaattagctgggcgtggtggcacacacctctaatcccagctacttggaggctggggcaggagaatcacttgaacctgggagacagaggttgcagtaagccaagatcgtgccactgcactccagcctcagtgacagagcgagattccataaaaaaaaaaaaaaaaaaaaactttttaaaagaggtaaagttgtggccaggtacagtggctcacgcctgtaatcccagcactttgggaggctgaggcaggtggatcacaaggtcaagagttcaaaaccagcctggccaagatggtgaatccccatctctactaaaaatacaaaaaaaatagccggttgtctgtaatcccagctactcgggaggctgaggcagagaattgtttgaacccgggaggcagaggttgcagtgagccgagattgcaccactgcactccagcctgggcaacagagcgaaactccgtctcaaaaaataaaaataaaagagagaggtaaagttgaagaaaaggaaggaaacaagcagtacacaattgtggaatctggaaaattttcaggatgaggtggcatctgacttgggcatgggtgactagggagagttgatgtcgcagtttaaatctgaagggagtctgctggcagaatctcctcttccttgaggggcttcagtcttttttcttttaaggccctcactgattggaggaggcccactcacattatggacaggaatttgttttactcaaagtctactgatttaaatgtcaaactcatcttaaacatgcctttacagcaacatctagactagtgtttttcccaaatagctgggtactgtggcctaaccaagttgacatatgaaattaatcatcacagggtggcagtgggaaatgatactaggaaaaccggtaggggccaaattgtaaagggttttgaattctgttaaaattgtctttagtaaacttctttggaaaatttttcttctcaaaatgttttcgttagaaaattgggaattgttgaaggcttctgagcaaagcaatggtaacatctgatgagtttggaagggtacttggctgcaatgtggaggatgagttggagagggcagagactgaaggtcaaatgatgggtaaggaaactgacccttgcttaagagagatgatgtgaggtactgggagtagagctgaaaagtatccaaagcatagaatataatgcaggtagcagcaagagatcaggctgagcagtaggcagaggccaggtcatggagcacctggtaagccagattaaagagcctggagtttatcctgatgataatgggggacccactgaagagttgaagtcaagggagtaacctgattaaatcgctctgactgctagatggggaataagggcaggtagaccagctagtaacagttgtagtagtgtgggcaaaagatgatggtggcttggactagggtgagagtggaaagaaagaaaagtaaacaaatttgggacatgtttggagccactggaacttggttagtgatggattagatcagagaaaggtgagagacagagaaaacttaaaggtgactcaggttttgggcctgagcaagtaggttgatgacagtgccatttgctgacatgaggaaaactagaggacagtcaggattggagtggagcaaaatcaagagttctgattaggacatataaagtttcagatgttcagtagacttctgagtagcaatgtcaagtagctagttgattacatgatcctgtggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgttaaaaaaaaaaaaaaattttgagacagagtccgctgcgacgtccaggttggagtggaatggcgtgatctcggctcacttcttcctgggttcaagccatctctgcttcctgggttcaagccattctcgtgcttcagcctcccgagtagctgggactacaggcatgcgccaccacgcctggctaatttttgtatttttagtagaaatggggtttcaccatattggccaggctggtctcaaactcccaacctcaagttatctgcccacctcggcctcccaaaatgctgggattacaggcgtgagccactgcacccaacttaaaaaatatttttttaaaaaaagaaaaaaatcggtgggcagagcagatcatataggaccttgtagcctacgagcatgctggaaccacttcctactggctcaggagaactgactgttaaatttcaggaaatttgggagctggtcgacttcgcatttggcagcctgaaatcagccatagtgggagtactgatgctgttgaaattggtaaatgctacaattcagcccttttttattttcccccagagaaccagttgttaaactttgccaccatattagtactatggcttgtaggctccagtaagaaatttagattttattcttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcataattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagcatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccacatttcttggaggctttgctcatttctttttattcttttttctctaaacttcccttctcgcttcatttcattcatttcatcttccattggtgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagactgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtcgtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccgctttgttttctttttcatctcagtttttgaggataagaatgctttgttttaaaagggatcatctgtgtctttttaaaagcttactgaattttcctggtgtgaattatttgcacgtactcatttttgtggttgatttggattttacagtgattaagattttacagtacctgctccaccgggcccagatcctgcttcccagatcttcctgggaagcaccaagaaatttagattttattctaagtgtgatgtaaagtcattaaaatgttttaagcaggtgagtaaaaggatctgatttttaaaaatcactgtacgtggccaggcgcagtggctcacgcctgtaatcccagcactttgggaggccgaggcaggtggatcacatgaagtcaggagttcaagaccagctgggcaacatggtgaaaccccgtctgtactaacatacaaaaaaattagccaggcctggtggtgcacacctgtaatcccagctactcaggaagctgaggcaggagaatcgcttgaacccgggagacggaggttgcaatgagccgagattgcgccgctgcactccagcctgggtgacagagcgagactccatctcaaaaaataataataataatacatcactgtacaagaatggactcccagtgggagaaggcaagatcgctaaggaaactgctgcaacaatccacatgcgcagtggtgccttggcagtgcaggtaagagttcagtcaagaaatttggaagattgttaacatcctaagactggatatagatggaccttgatttatcacaagttgattataattgacctgttatgtaattcgtgttacttagtgtctttttgttttagttgtggggagcaccagattacagaatgattaccttgactcatgacccagggctctttacaattcttaccagaaactggcagatgataaatcagtcatcttatttggtagcaaaataaggaggttactttcctgcatgaacataaatttcctcttttcaatatttcagtcttacattagcaggaggaacttgaagtcttgtgattaggcagattctttgtaagggaaaaggcagcttactatccttttggtaacagttctttactgatagggtaagaaggaaaggaggttgagtccgaacaatgctaaaggaaacactttaaagtaagacatccactgaagacccctagccattttgcctactgtaaaatagaaccatctacaatgtcttgtgaagagagaaatgaaatgaattttgatatttgttttctgcaaagattctacattacattgtgtaagtcttgacccacgatttttataactcatgcataaaattatgtgcaaatgctttaaaaattccagcccactcttatactgagcattttatgtactcattcagcaaaccattcattgagcaccagtcatgtgtcagctgctgcttaaggcactagagatacgaaaattaaaaagacccagtcctcacagagttcacagaacactaggaaaaatagacatgtaaattggacatgattacagtacaattgtgaaagaggtctctttgaaagagttgtctgtatttatttaccatctccagtctttcttttcccattctctctctttttttttttttttttttttgagacagaatctcactctgtcacccaggctggagtgcagtggcacaatcttggctcactgcaacctccacctcccaggttcaagcgattctcatgcctcagcctcccgagtggccgggattacaggcatctgccaccatgcccggctaatttttgtatttttagcagagacagggttttgccatgttggcaaggctggtttcgaactcctgacctcaggtgatctacttcccttggcttcccaaagtgctagaattaacaggtgtgagccaccgcgcccagcccccattctctattctctctctctctctcttttttttttttttttttgagacagagtcttactctgttgcccaggctggagtgcagtggcacaatctcagctcactgcaacctccgcctcccgggttcaagcaattctcctgcctcagcctcccaagtagctgggattacaaccaggctgggagattcagcttgtccatttcatgttctgtttctcacaatcatctgtgtttgcttgtcactgcactttaaagagaaggcataactcaaaagtttcacccttcaacttgatggagaattattttttatttatttatttatttatttatttatttttatttttttgaaacagggtttttctctgttgcccaggctggattgccgtggtgcaatctcggctcactgcagcctcaacttcctgggctcggtcgatcctcctgcctcaggatctactccctcctgagtagctgggactacaggtacatgccatcatgcccggctaatttttttttcttttgtagagatgaggtttcgtcatgttgcccaggctggtcttggactcctgggatcaagcgatctgccagcctcagcctcccaaagtgctggaattacaggcatgagccactgcacccagccattctatatttttaaagcatagaatattgattctttgagctggattaatgaggaaagatataacaatcattaatataaaataaagaattgtgaaacctcattaatttgcatgccactaacctaaaattgtaataacccagggcttagtaagcaaattagtcatataaacagcataactatagggatatttaaactgtttaccaaaagaagctgcttttaaagcctgctgaagtacttatttattactaataatgtctaatattattgacacttataatgttgctggcactcttcattgtcttatttaatttccatagcaactctaagagctaggtattatcactcccatttttgaaataaagaaattgaggccaggcgcagtggctcatgcctgtaatcccagcactttgggaggccgaggtgggtggatcacgaggtcgagagatcgagatcaccctgaccaacatggtgaaaccccatctctactaaaaatacaaaaaaagccaggcatggtggcaggcacctgtaatcccagctacttgggaggctgaggcaggagaatcacttgaacccaggaggcggaagttgcagtgagccaagatcgtggcattgcactccagcctgggcaaaaagagtgaaactgtgtctcaaaaaaaaaaaaaaaagaagaaattgaagctcagagaagttaaggaactcactgggtgcagtggctcacgcctgtaatcccagcactttggcaggccgaggtgggtggctcacttgaggtcaggagtttgagaccagcctggccaacatggcaaaaccctgtctctacgaaaaatacaaaaattagccaggcgatgtggcacgtgcctgtaatcccagctactcaggaggttgaggcacaagaatcgcttgaaactgggaggcagaggttgcagtgagccaagatcatgccactgcactgcagcagcctgggtgacagagtaagaccctgtctccaaaaaaaaaaaaaaaaaaaaaaaaaaaggaacttgcttaagatcaaaaatagctaatgagtagaagagacaagggttccaatccaggtctgtgtgatgctgaagcccacaggcagaagattcgcactctacctaggcttccacagatcactcaaccatgcatgaaagtaaggcctgaaaagtgtctctactaggttgcccttcattaatctagttccagtcatgtataataaaatggagtgtctttccaaaatttcataatttagatttcactcatttaggccgacttcccccctatacatacccactagttggaattagttgccttttactatatgctgtattgaatgtccttatagttgggggtcatgagaaaagctaaagtctaacttggacaagatgacgactggcattgccagggttgtgcagcaacagtagtggggtggggtgtcctgcaaggacatgagttaggtggctgttaggggcagcataagttgtagtgtaaagccttggagcctagatgccaaggtcgcagagtcaccaggaggcaggatcctggagtacagattgcagtggcccagtaggcacagcatctggcctctaggtctgcctctgctatgcaccagctgggggctttggttaagttgctctgcttctccaggtcataggtttttgtttgtgaaacgaataattggaagggaagatcttagggtccatttcagattggggtctctggtttagggatctgcgttatcagagtctaaagtaatcaagtccttggagatctagtaatcagaaggagagcaagaaagagccagctttcattgtcaggggcaacaaagaggtggctcatgcccataatcccagcactttgggaggccgaggcaggaggatcacctgaggtcaagagtttgaggccagcctggccaacatggtgaaaccccacctctactaaaagtacaaaaattagctgggtgtggtggcatgcacctgcaatcccagctactcgggaggctgaggcaggagaattgcttgaatctgggaggcagaggttgcagtgagccgagatcaaccactgctctctagcctgagtgacagagtgggactccatctcaaaaaaaaaaaaaaaaaaaaaaaaaaagaaagtccagaaagcctggtttgaatcagtaaaatcgagttttcacactgcttcactgattgtaattcattcttctacagatttttaaggagggtggaagagagaaaagctaagtaaaatgtggtcctagccatcacaggtctcatagtatcctgagggaaagagacaggaaacaactaactggaatataaaacagaataaaatgtgttcattacctgctgtatgaccttggtcaaatcacttaacctgtccctgagcctcagtttcctcaactttaacagacacataagcagtcaataaatgtcagcagctatgcatcagtagtggcaatagtaatatggactacatgtgtaatattttgtactatgccattacatcttagtaaaatagaaccatctacaatgtcttgtgaagagagaaatgaaatgaattttgatatttgttttctgcaaagattctacattacattgtataagtcttgacctaccgtttttataactcatgcataaaattatgtgaaaatgctttaaaaattccagcccactcttatactgggcattttatgtactcattcagcaagccattcattgagcaccagtcatgtgtcagctgctgcttaaggcactagagatacagaaattaaaaagacccagtcctcagagttcacagaacactaggaaaaacagacatgtaaattggacatgattacagtacaattgtgaaagaggcctctttgaaagagttgtctatattcaccatctccaatctttctcttcccattctctttttttttgagacagagtctcactctgttgcccaggctggagtgcagtggcgtgatctcagctcactgcaacctccacctcccgggttcaagtgattctcatgactcagcttcctgagtagctgggattacaggcacccaccaccatgcccagctcatttttgtatttttagcagagacagggttttgccatgttggccaggctggtctctaactcctgacctcaggtgatccacttgccttggcctcccaaagtgctagaattacaggcgtgagccaccatgcccagcccgattctctcttgagtccattccagtcagacttttgctccaccatccaataaacttctcttttattttttgagacatggactcactctatcgcccaggctggagtacagtggcacaatcatggttcactgcagcctcaacctcatgggctcaagcaaccctcccacctcagcccccccaagtaactgggactacaggtgtgcaccaccacacccagctaatttttatattttttgcagagataggggtcccactgtgttgcccaggctggtcttgaactcctgggctcaagcaatcctccccctatggcctcccaaagtgctgggattgcacatgtgagccactgcacccagccaaaacttctctttttatgataaccagtgacctccatgtgtttagatccaatggtcacttctcagtcttcatcttactgggccctcagcagctcaccactcctccttgacataccaccttcacttggcttcctggacaccacactttccttttccttcttcaccaactgctccttctcagtcttctttgtggggtctaatgtggaagtatccccaggctcaagccctaagtgatctcatctggtctcctggctttaaataccacccatgtactgatcactccctaattatgtctccggccctgacctctcccctgaactccagactcatgtagccaactctccatctccatttgaatggctaacaagcattgcgcagttgaactcctgatgttttcacccaccctcaaaaaacaaaaacaaaaagccaacctgcttctcccatagcgtcctccatctcagttcatggcacttctgtctatcccgtcacttaggccagaaactttagagccatccttgactctcctctcacaccctcatccagtccatcagccaatcctgttgactctaccttcagaatatatcgagtctgatcactgctcaccactccaccactagcatcccagtccaagctaccgtcatctcttgcctaaattactctagtaatctcctaaccagtctccatcctacttttccctccattcttgagtctttttcaacacagcagccagtgatcatgtgaaaatataaattaggtcatgccattcttctattcataaccccccccagtgaccagtcttctcagtaaaagccaaaattcttactgtgtgccctaccagccttatacaacctagccaccatttacttttgtgaagtcatatcccattactctctattttgttcattccattaccaccacattggcctcctcattgcctctgtaacaccccggacatgctcctgtcccagggcctttgaagatatctgtacaacttgcttcctcacttccttcagatctccaaaaagccatcttcttggtgaggtcttctctgattaccctaataaaaacttcagcatcctccagacactccttatgttccccctgcttttattttatccagagcactcacctcctcttagtatttggtgtaatttacttatttattttctttctttgtcttgtcttcccctgcaattagactttcagctttataggaacagggacttttgtctgtttggttcactaatgtatcctgagtgtcgggcatatagtaagtatcaataaatatgcaaataaatgaatagtctttagaggagataatgggagtataaaaaagagctaaggagtgcagtcagtatgattggggtgagtgatgcttttcatgttggaaaagttgtcatgaagggccttacatgtcattctaaggagcttagattttatcctataggcggtaaaatgtcagtaaagtagtcagtggtctgaattggaattttagaaatgcgttctggctgtagtataaagaatgaggccgggcacggtggctcatacctgtaatctcagcactttgggaggccgaggcaggtggatcacctgaggtcaggagttcaagaccagcctgcccaacacagggaaaccccatctctactaaaaatacaaaaattaggcaggtgcgatggcatgcacctgtaatcccagctacttgggaggctgaggcaggagaattgcttgaacccaggaggcagaggttgcagtgagccgagatcgtgtgactgcactccaacctgagcaacagagcgagactctgtctcaaaaaaaaaaaaaaaagaagaagaatgaattggaggctgggtgtaatggcttatacctgtaatcctagcactatgggaggccaaggtgggaggatcacgtgagcccagaaattcaagaccagcctgggcaacatagggaaaccctgtctctacaaaaaatacaaaaattagcagggcatggtggcacatgccagtagtcccagctaccagggaggctaaggtgggaggatcacctgagcccaggaggttgaggctgcagtgagccgttattgcaccattgcactccagcctgggtaacagagcgagactctgtctcaaaaaaagaaagaaaagaaaagaaaagaaaagaattgaaaaggacaagagtgggtccaagaggccagtaacagactgctacagtaatgcacacatgagatggtggtagcctgaattatgggagtgccagtggggatggaaaggaggattgcttggatagggcagtaagggtgggcgaaatgaaggaattccaggtttctggcttggggtagcttgttaaagacttgggccattcatcactgagataagaaatacagaagaaagaataaatctgacactgtcaagaagaaaggcaacgatagattctaggtgtgtcgagttttgagtacttgtgtactatccaggtagagctgcccagtaggcagttaggtgcttggttttggaggtcagtgggaggtcagagccaaagataaagatttgggagccatctgcctgtaggaggtgtttaaagcaaaagctatggtagaatttcctagaaaaggtatataaattgaggaggaccaaaagagttcctggttatcagtgccaaatattgccccctaagaaatccagtaataatatagccaaaaagagccactggatttggaaaccaggaggtcgacaatggaatacatttcatttattcaaatgtttattaaatatctactatgtgttaagaatactaaggatacagaagtcaataaaacagatcaaaaaatccctccttacatgtagctgaaattctagttgcagagaaggagcagataaataaaggaaataaataagtaaattattccaaatattaaaaggcagtgaatgctctgaaggttagataagctgcctagggtcacagggccaagtaagtgaagaaactaggactagaaacgaacctgctcaactccagagttgtgctcttcttactgttgtaccacacctcctctcccacatcgataatcttggttccattgccacagaatgccatatagccccaactaaacatttcagaaacaaaccaaagtatgtgtatagcttaatctaaactcaacaccatttctgaaagccagctctgaggggacatccccttcacagtggacaggtagtaccagttttatatgtagatggtatattgaaaagtcatttcatctgatcgtaaaattatttttctaagaggatggctgggtgcagtggctcacgcctgtaatcctagcactttgggaggccaaggcaggtggatcacttgaggccaggagtttcagaccagcctggccaacatcgtgaaaccccatctctactaaaaatataaaaattagccaggtgtggtggtgtgcacctgtagtcctagatactcaggaggctgtgacaggagaatcgcttgaacccgggaggtggaggctgcagtgagccgagatcatgccactgcacaccagcctgggcaacagagtgtgagactctgtcgcaaaaaaaataataatattaaaggagaaaacgttcctttcagagatggagcattttggtaataatagggttccgtcaggatggctctgaaggtggtgatgatgtccacggggtggccaaaatggtataaaggtgaggatcactgaagccgaaggccagaaactggtcatgggctgggtcgtctttatagatgccaaagttacctaagatgacggcgaggctaggagagggtgagccaccaggtatcacagtcttcaatgaacgtggaagagtggccagattagtagataatagcaggccaaggagtatggttcagtgacatcagccccagctaagtgcttctgtcgtgagagtgaaggaggaagggtttgggaacagcaacagagagcgagaagaatgccaccatcacaatgctccctaccctgtcacatctgtgaggtggagaaatgaacagcctccgcttgggagcttcacaggggaaggaccagtaaagacaaggaaacagaatactttaaaaaggctaagggcatgggattatgtttatcatgtccagaaggcacaggttgggagggaatgtaagtatgaaattgaatctgtcccaaatgtctgcttccttccaggcaaaataaacgacaaatatatggacagggtatcatgattgtattgcacgttaatatctgttctaagcccacagaacaagaagaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtcatgcccttcaatcactgtcattcctctcccaacccacactgagccagctttccttttgccatctttcctgattccaaaaagagttaccatttgtattgccaccgccattatctcactttacaagataatttaccctgatccaagttgactgcagacacattgatgttttctttttaagaacttaacttgattttcatttttggttttaacagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctggg

SEQ ID NO: 4969 - DNA, 55092 bp, human; identical to SEQ ID NO: 4963

SEQ ID NO: 4970 - DNA, 55418 bp, human; identical to SEQ ID NO: 4964

SEQ ID NO: 4971 - DNA, 55064 bp, human; identical to SEQ ID NO: 4965

SEQ ID NO: 4972 - DNA, 53397 bp, human; identical to SEQ ID NO: 4966

SEQ ID NO: 4973 - DNA, 46385 bp, human
tatcctacagacctcatcaaaacccggttgatcatgcagaacatactggaaccatcgtacagggggctcctccatgctttttctactatttaccaacaggaagggttccttgccctttatcgaggggtttccctcactgttgtaggtaagatggaccttttcaccttgtccaagaaaaggctatgttctctgaaattacaaatgtattgtatacctttgtgagccactaaatcagttttactgagatcaaggttatatggattcaacctacatagaggcaattagcttcattctattccatagccatacactccactcctaaactttggccagttacatccccgggaggggagtagaccagaaagtggaggtgactcagcaaactggtaagaatgcaattctaaccactctccatctgactgcagaaggagtattcagtgtacatacacattgatatgccatgagggcaactagggtagcaactgtgtcttctggggtctttgtaacctttgccagagctacacatttatggcccaattgcaaaatccagtagactttttccctttatctgaacttggttgcagcatttgataaggttgaccaccccttcttctggaaacttggcttccaggacccctccaagtcctgggtgtcttcccatctctctggcagctctttcttatctgacttatccggcccatctgggtcgtctgatactgccagcccctacatgttgctcttcccctgggctccttccttagctttctttttaccctcccctttagcttgcttctcatcctccaaaccctccctaggtggcctcatctatgctagtggcttaagcaagcgtcagtgtattctgtgacccttattctctacctctttagtaacaatggccaacttttggggggaagtacttaccatgttctgggtactgggccaaatgcattgcatgcgctttctcatgaggccttattttacagatgaggagatagatgcttcaggaagctaagtgacttgcccaagtccacatagatagaaagcaggagaaactagcaatagaactccagagccctctgttagcccctgactgacaccaattcccaatggtagtatgagtccctgctgttggacaccttcacctccatgctccctaggcacatcaaattcaagattaaccctgatgtcctcgttggtctcaaactagctcttcctcctgtgttccctaatgaatgagactaccttcctttcaccccgtggcccaagccagaaaaaaaagcctagggatcacttcaacttctcctctcactccacccccacttgaatcaccaagtcccgtcgatttgactcatcctctttcccacaggtccttacaactcagactctcagggtctcccacagactctggctcctacctgcttccactcttggtatctcctgccccagtcttccccgtgcactgctgcccggctgaggtgatctctccacgtgcaatttcatcgtttcacggccctcatttcactgctctccttaaaaagtattcagcgactcctgagctacaggagaaagcccaaattccttaggacattctagatccttcagacctggcccctgccagtttgtcctacctcatctcctgccatacctccacctgcattcatgctccagcccttcagaaaaacttggatttcctggaaataccactccctttatacatgctattccctttgcctttccactctgtcaaagtctgatgaactcctatttattcctcaagacccagttcaaaagttctctctttcatcaagtccctcctgactcccccaggcaaaattaatccctttgatccttgtgtacctaatgcatttcatatagcccccctgttgtggcacacatcaggggtgttatactgactttgccctggctgtctgttctcctcgatgatgagcatctccagaaattagcccgctcctctttcgattcccagcacctgacatagggcctggcacataacctaagctttccagacattttctgaatgaaggtaaatggaaggttggtgagccaattaaataaacattacatttttctaaagataagcaatttcacttgtattatcccctattttaaatttcattttgagggagaaatttagtccctctgtaaactaaagatggctcctaaaggttctggaagtttgtgaaagtgccacctactatattacttactcaccatctcagttcttagaaaggtgaggaagccacacagtgtagggtgcccactgggccatgatatgaccatgtcattcccaaaggtgaagtcaggtgacctccctcaccatcgagagtctctcactttccagttttcataaaatgtttccttctcagctagagatcagtccctcctgtcctccaaaacataatgaggtgctgcccactggctttttttacttgagtgattttttccccgaacattaaaaaaaagcttcaaacatctagaaaaattaaaagaaatctagagtatacatccatggaccatctagatgctacaattaacattttgctattcatccctccagccattcatcagtccatttttattttatttatttatttatttatttatttatttatttattttttgagacagaatcttgctctgtcacccaggctggagtgcagtggtgcaatctcggctcactgcaacgtctgcctcccaggttcaagcgattctcgtgcctcagcctcccaagtagctgagattacaggcacgcacctccacgcccagttactttttgtatttttagtagagatggagtttccgttttagtagagatggagtttagtagagacgaggtcaggctggtctcgaacccctgacttcaagtgatccgcccacctcggcctcccaaagtgctgggattacaggcgtgagttactgtactcagccagcccaccttttttttttttttaatgatttcagtgtaacttgcaaatatcaatacacttcacccctaaacccttcaacatgtgtgtcattaactagagttcaatatttgtgtatggttcttttttttgagatggagtttctctcttgtcacccatgctggggtgccgtggtgcgatctcagctcactgcaacctctgcctcctgggttcaagtgattcttctgtctcagtctcccaagtagctgggattacaggtgcccaacgccacacccagttactttttgtatttttagtagagatggggtttcaccatgttggccaggctggtctcaaactcctgacctcaggtgatcctcccgccttggcctcccaaagtgctgggattacaggcatgagccaccacgcccagccgtatggttgttttttaaagtacaatttacatccagtaaagtggacaaacctttagtgaaccatttgatgcattttgacaaatgacacaacccctaccaaaatatagcacattatcgcactcaagaaagttccctcatgctccttgggttggagggattttagcaaccccagagcccctcctgttttctttccccggaatccccccaggaatttatgttctcaagccagtgttttcccaagacagcagcagcttctccctggccttgttttgcaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggtgaggagttatcagagtggggtagggggtggaatgctttgtagtgtttgtggtcgggtaataacagcaaagaacactgaccccaagtgatgccaggtttccaaggagcttctgactgctcataaatactgtgcaaacccccactctgtggcatttctgctgctaacctcagagctgttggcttgagccccggctgcctcctcattcccatcctctgttttttggtcttttaagaagcctccaggctaggggcggtgattcacgcctgtaatcccagcactttgggagggcggaggcgggtggatcacttgaggtcaggagtccaagaccagcctggccaacatggtgaaaccccgcctctactaaacaaacaaaaattagctgggcgtggtggcaggcgcctgtaatcccagccactcagaaggctgaggcaggaggatcacttgaacttgagaggcagaggttgcagtgagctgagatcgcgccattgcactccagcctgggtgacacagaaagactatgtctcaaaaaaaagaaagaaaaataagaaagaaagaaaaaaaagaagcctccagatgaggcttctcttttctttcctgacttcctgattatatcacttgtggctctccttcctccaagaccagcagagagtagaatatgaaatgcagcctgctaatgctccctgtccttgctgcctccacagcaaggatgccactcttggtttcctcactgtgccttacctcagtgaagcagactggataggaccaacataagctaggaactgtagctaacaagggtccagcatccctgactccctcgctgaggaaggaactgcatttaaaatgtggcagcatcaggccgggcacggtggctcatgcctgtaatcccagcactttgggaggccgaggtgggcggatcccctgaggtcgggagttcgagaccagcctgaccaacatggagaaaccctgtctctactaaaaatacaaaattagctggttgtggtggcacatgcctgtaatcccagctactcgagaggctaaggcaggagaatcacttgaacccgggaggcagaggttgcagtgagccaagattgcaccattgcactccagcctgggcaacaagagcaaaactctgtctcaaaaaaaaaaaaaaaaaatgaggcggcatcttagtgagaccactgaggcaaaatcctagaatcagaagttccaaagtgagtaattgtcttagcctagaataagccaattttgatcaaagaaaaatcagactagttcaaataaggttgggtgggtaacagttatatctgtacagtgggggcaggcccagaatcctagcagggctgaggtgctgtatcttctcttagccctgctcaggcccttaaaattcaaaaatagctaatgcatgctggacttaatacccaggtgatgggttgataggtgcagcaaaccaccatggcacatgttcacctacgtaacaaacctgcacatcctgcacgtgtaccacagaactaaaaataaaaatttttaaaaaaattccacttccataggctaggctgtctccatggcctcttctgggcaaaccctgatttatacaagcaatatattcctgaagaactctatagaaattaatttggggtcagctgaatccaagtttaaatgagcagtcccagccaagtttggttttcccctgtgactctaacttgtcctcgcttgctcaatgtccctccccgctcccgctttccctctgtagtagtcccggctgccctgggccatcgcttacctcagcactaaacagcctgaaggtgcttatcaaagctgccactccactccctgaaacttcatctgtctgggttgcattcctttcctgtccttgtccaaacagataattgtcgcatcattgtaatggtagtataggtgcaaaatttttctattcgttggtaagaagtctttatatattaaagatattaaccctttgtcatacatttcacacaatttttccagtttgacatttggtgttttttttttttttgagagacagagtctcactctgacacccaggctggagtgcagtggcacaatctcagctcactgcaacctcctcctcctgggtttaagcgattcttctgcctcagcttcccaagagctgggactacaggcatgtgccactacacccagctaatttttgtatttttggtagagatggggtttcactatatgttgaccaggctggtctcgaactcctgagctcaagagatccacccgcctcagcctcccaaagtgctgggattataggcatgagccactgggcccagccaacatttggcttctagtgctatttatgtgttgttggtggtggtgctttgttgtacatatttgtagaattttatctaattatatctattacttttttgtttgtttgtttctgactttgcttttctgcttaaatgtaaagtctgcttagtgcatgcttatcttttttttttaagtatttctaattttaaaaataatgcacatttggaaggccaagatgggaggatcacttgagcccagtagtttgagaccagccttagcaacatagcgagaccttgtctctactaaaaataaaaaattacctgggcatggtggtgtgtacctgtggtcccagctacttgggagactgaagcaggaggattacttgggcccaagaggtcgaggtcacagtgagctataatcctgccaccgcattccagcctgggtgacagagagagaccctgtctcaaagaaaaaaaaaagtaatgcacatatactttaaaatggttaaaatggttcattttatgtatatttgaccacaatgaaaaaaaagtaatacacataagttgtagaaaatttgggacatacagaaaagtgcaaaaaggaaaataaattacccatagcccaacacccatggattataatgattaatagttttccttctatggaccttcatatatatacataaacacactcacacacatataaagatatataaggttatttcttttacaaaattgtgttcacactgtatataaaaattagtatccttaggccgggcgcggtggctcacggctgtaatcccagcactttggggggccgaggcgggtggatcacctgaggtcaggagtttgagaccagcccggccaacatggcgaaaccccgtctctactaaaaaatacaaaaattagctggtcatggtggcacatgcctgtaatcccagctacttgggaggctgaggtaagagaatcccctgaacctgggagatggaggttgcggtgagccgagattgcaccactgcactccagcctgggcgacagagcgagactccatctcaaaaaaaaaaaaaaaaaattagtatccttttttcacttattatataatgggtatttccctgggccattaagtatttaattatcaaataatattccaccatatggatgtgccaaaaatatgtaacaatttctcctttttttaatatttaggctttttctaattcttgagttatactaacattgtaatgaaaacctttgcattttttcatatctgtgatgatatccttaggctatattcctagaaattgacttataggtcacaaaatatgaacaattctaagactcttcatgaaatgtgcactccagaaaggttgtaagtttgtaattccaccagcactaaagcagtggctcagcttctaaactctcaatattcattgatattaattatcaatattaattgtcactttttaaatcattatgaacctaatagctgaaaaatagtatcccatcattttaattttaatttgattgattataagcaaggttgcactggccctttgtatttctttgtaagttttgtatttatgtccttgccctatttttctagaatattcaactttttctattcattggtaagaagtctttatatattaaagatattaaccctttgtcatacatttcatatatttttcccagtttgacatttggcttctaatgctgtttatgtgttggtggtggtggtgggtttttgttttgttttgtttttttagacagggtctcgctatgtcgcccaggctggagtgcagtagcagttcaagcatttctcctgcctcagcctcccaagtagctgggattacaggcacctgccaccatgcctggctaatttttgtatttttgatagagacacggtttcagcatgttggccgggctggagtggtgatgttttgttgtacatatttttagaattttatctaattatatctattagtattatcttctgtttctgactttgcttttgtgcttaaaaggcctattctatcccatgatcctatgactattcacttatatgttatttaaatacttttttagttgtgatttttacacttggcttcttttttttttgagacagggtctcactactgcccaggctggagtgcagtggtgcgatctcagctcactgtagcctcgacttcccaggctcaggtgattctctcacctcagcctcctgagtagctgggactacaggcatgcaccaccacacccagctaattttttttttttttttttttttttgagacggagtcaggctctgttgccaggctgaagtgcagttgcaccatctcggctcactgcaacctccatctccctggttcaagcaattctcttgcctcagcctcctgagtagctgggactacaggcacgtgccaccacacccagctaaatttttttttgtatttttagcagagacggggtttcaccaagttggccaggatggtctcaatctcttgacctcgtgatccgcctgccttggcctcccaaagtgctgggattacaggggtgagccgccgtgcctggccatcatacccagctaatttttgtattttttgtagagacagagacttgccatgttgcccaggctggtatcaaactcctggactcaagcaatcctacccatctcaaactcccaaagtgctgggattacaggcatgagccactgtgcccagccttacacttaacattttaatacatttagaatttacctggtgtggcagggtgcagtggcttgtacctgtaatcccagcactttgggaggccaaggtgggcggatcacctgaggtcaggagttcgagaccagccgggccaacgtggtgaaaccctgtctctactaaaaatgcaaaaattagccgggtgtggtggtgcgtgcctgtagtcccagctactcaggaggctgaggcaagagaatcacttgaactcaggagatggaggttgcagtgagctgagatcatcccattgcactccagcctgggcaacagagcaagactcagtctcaaaaaaaaaaaaaaatttacctggtgcacaggtgccgtgactcctgcctgtaatcccagcactttgggagtttgagataggtaggatcacttgaggctaggagttcgagaccagctggccaacatggtgagacccgtctccataaaaaatacaaaaattaactgggcacacctgtaactggtgcacacctgtagtcccagctacttgggagactgaggagggaggatcacttgagccctggaggtagaggctgcggtgagccgtatttgtgccaccacactccagcctgggtgacagagcaagaccctatctcaaaaaaaaaaaaaaaaaaaagaattttcctggtgcatgatatgaaacagtcatctaagttttttttttaatagtttaccaattgtttaagcaccattttttgaataattcttttctccactactttgtgctgcagctttcaccacatactaaatgtttatatctattctagggtctctatcttaatgaccataactttagaaaaatgccttttttttttttaatttttttgaaatggagtctcgctctgtcgcccatgctggagtgcagtggcgtgatctcagctcactgtaacctccgcctcccaggttaaagcgattctcctgcctcagcctcccgagtagctaggactgcaggcatgtgccaccacgcccggctaagtttttgtatttttagtagagacaaggtttcaccatgttagccaggctggtctcgaactcctggcctcatgatctgcccgctttggcctcccaaagtgctgggattacaggcgtgagccaccgtccccggccaaaaaacaccttttaatgtctagtggaatatagccctcctcattgtttttcttttcaacatttccttgattattttcgggcatttgttcttcctgataactttagaattaccttgtgattatgattggaattatgtaaaacccatacacttggagtaatttatgtaaaatatttcatcttttattcagagacacagtatgtctctcctttactttcaatcttctttctttagcttgaaccagatgaaattaccaatattcaactttgttgacatcattcaaacagcaatttcatctggttcaaaccttagaaaagttgttttcttcaaagggaaattatgctctctctaaacaaacaaaaaaatagtttctcttaaaaaatctggggagaagtagggtaggaaagaagtatgatatactgtaagtgttttattcattttttaaaaatcctggtcctaagaatttctcactgccaggggcatctctccagcactttcagccacttcatgcctagttcaaggcttcgccagcttagcttcctccccatagtgggccagtccaaaacaaccagggccttgagcctcaaggggtagggctagtccgtgaaaaagggtttcaggccaggtgcggtggctcacatctgtaatcccagcactttgggaagccgaggcgggtggatcacctgaggtcaggagttcaagaccaacctgaccaacatgatgaaaccccatctctactgaaaatacaaaaaaaaaaaaattacccaggtgtgttggcacgtgcctgtagtcccagctactcaggaggctgagagaggagaatcacttaaacctgggaggcggaggttgcagtgagctgagattgtgccaccacactccagcctgggtgacagagcgagactctgtctcaaaaaaaagagaaaagaaaagaaaaaggtttcagatgaagttcaatgacatctaaatgggacgggtaagggtcccagtcttccccataaaccttagttttgctttctcttcctgagagctagaacagtgacctcatctgggagaatccagccaacaccgcattctacaccatctgcattctatacccctaccacaacaacccactataaactggggtaagatacactagaagtgggtatttgggggtaatcctgatcatctttttcctcgtatgggagccttccaaataatgcatatatagagcataagaagaagtttcaaatagatgcaaagtcatgatggttgtaaaaaaaaaaaaaaaatccaaagaggtaattgcactgttttcacaaaataggatcaacatgtaattatgaataacaatataaatgtcatccaaagatataggaagtgaacttttagggtttcagtgaaagtgttattttgcaggggttaataaacatactaatactttgtccaccctatgttaaaaaaaaaattcacccccaagacagaactgcaggctgcttttaaatgcaaacatggcattgggcttctctggccattagatgtcactgcagtaaatggagagtagctgagcatcacctgattggagcctgaagttcggtgatctctgtccagttaacaacttcataatccctgcttgaaatccatctttggtttggagaataagaggcctagaaaccacaggctaatgctaaacttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcaggcctgtgcacacatggaatgaggtgcccccaacttggtgtgctttcacggaccccaaccaccctgcctgaaatccccttctccacgcttcagtgcatcttagctcaagcccttccaggtatagcctggcctttttgtctatctcccacacctagcccagggcctgggccagaagagatggcagaacttagtgtattgagagaacaagtaggaagggtaaaatattgacagagatgaattcatctgattaatctgtgcaccccgaataagaaccagggagtcctgagaaaatggctctctgcacaggtgcatgtgaagaagagagggagataggctggggaatactgccctgaaaatccagggagcagctgagaatgtaggagccttggaatctggcaggccttctgaaaggatcaggagggaggtaccagacacatgctcggtccccccacaactctgcctgacaccctcccctattgcccatattaggtgtctccatttcatcaaatataaaaccaagtgtgagcctgttgctttataccccagtggactttgaccccatcacagctcacaaggtaagcaggattgggccaggtcagcatttgaactgaaagcacataagatgaaggacaaaggtggtatccgagtggtacagctgactgagcagaatatacatggtcagtgaataaacagaggccccagcctactcaaatagagatgctcgacacctcgggttacctttgttgaattggacacagtcacttcattcattccctctcagggtgctcatcccctcttgtagtttttcatgttcatatctacatcttcaatcctgacctcccttctgagccatggtcccacatttcccacagcctgctcgacatcactatttggctatcatatccccactgtcacctctaacttaatgtgcatcaagctgacctcttcttttcctaacactgttattccagagttttccatttcaattccatcattgccccagtgactcaggctggaaatccacaacttgtgtttgactcttccccttcccctcacccggttaaccttgagccctgttgcttcttcattcctaacattcccatgctggtctttctttttgtcactgcctcttgccctaatcttggaccttatcagctcatacctaggctattacagtaatctcctcattggtctccaggattaattctaaaaatgatcttaagcattgaatattaatatgtactaggcactgtgctaagtgctttatgttcattatctcatttaatccttacaacagccctacaaggtgggcactgttattattaagtccattttacagatgagaaaactgaggcaccgaaaggttttgtagcctgcaagttcacccatccagtaattgagctgggatataagcccagggagcttgtctccagagtcagtgctcatttcaatcctctccagcccagcccatatgggattctgtcagatgaatctttctcagatctgtctgcgttagatccttttttttttttttttttctttttgtgagacagggtcttgctctctctcccaggctggagtgcagtggcacaatcacagctcattgtagcctcaacctcccgggcccaagcaatccttccacctcagcctcccaagtagctgggaccacaggcatgcgccacctatgcctgactaatattttaaatgttttgtagagatgaggtctcctggtctccttatgttgcctaggctggtctcaaactcctgggctcaagccatcctcccgctttgacctcccaaagtggtgggattacaggcatgagccactgtactcagcctgttgttgtgtccttcttgatggtccccagagaaaaaaggctgagccccttggcttggcatgtttcccttaccaactgtgcgatccttgttgcacagaggccctttatataagaagttacaaaaacaaatgcctgcagaaacttggaagtaacatgaaaaagagaatgtagggaaacccagataacatacactcaccctgtaaagaataagccttcaggctgggcctggtggcccacgtctgtaatcccaccactttgggaagccaaggtgggtggatcacttgaggtcaggagttcaagaccagcctggtcaacataatgaaaccccgtctctactaaaacacacacaaaaaaattagctgggcatcatggcaggtgcctgtagtcccagctactcaggaggctgaggcgggaggatcgcttgaacctaggaggtggaggttgcagtgagttgagattgtgccactgcactccagcctcggtgacagagcgaaacttcatctcaaaaaaaaaaaaaaaaaaaaaaaaaaaaagccttcaaatgcattccgagccatcatggctttcaaaagcattctggagagctaaacttcactgtgctcacaaaatgtgatttgcatctaaatatggatgacagaaaggaagaaagagagccagtagaggctgtggccagttcctcctctccaaaggacggatgccatttagaaatgtaggcccagttttcaaaggagtctaaaatccagatttttatgtaaaatctcccagtttttcactgctggcaaatgaaaattgttaagtactggctgggctaaacaaaacacacattcgtatgacctctgctctattcaagcctccaagttcatcaaactaatcttcttagccccttctcccaagccctgaagactaagtgcatttcacattccagtcaccaggcctttgttcatgaggttacctctgtcttggaacatctgcccaattttcttaaaggctcaactgaggtttgtctcagtgatggctgtcttttctgacctactgtagcacatacctgttgtttaagaaatgagttggcttttcccatccccaaaacagctgtcctatcttgatggatcaaggtagatgttttgcctttgtagaaccacaatggaggtgctccagcccacttcagaggggattctggggcaagagaagctgagttaactaacaatctactcagttaataactgcagatgccgtattttcactgtcccccacccaacccccaagggcatagttattttgttctaagagctttgtgggtgaataccacccaccccctttttatttttgagacaagagtctcgctctgtcacccaggctggagtgcagtggtgcaatctcggctcactgcaacctccgcctcctgggttcaagtgattctcctgcctcagcctcccgagtagctgggactacaggcatgcactaccacacccagctaattttgtatttttagtagagatggggtttcaccatgttgcccaggctggtctcgaactcctgacctctggtgatccacccgcctcagcctcccaaactgctgggattacaggcatgagccaccgtgcccggccaaataaccccttttaaatgatgctgttagcctatacgtgccctctgatccagccagtttcttttccatggcatttctgtccatgccctacctcttcccatcttaacactattgccctgctgttccctcactatcaaagccgcctcctgaagtcttctcccatctccccaagcagtagtctcccgctcctgaatggctcactcttgctagagctgtcttatggcccatgccacatgcttccttttgttataatcttttgtgtcccttatttcctctagattgcaaactctttgcctgtgggaagtatgtcttacacatttgtatatcctcacaacacacagcctcatgtagcagacatctaatacttgtttaaaaatgaagtttagggacagcttaggagatctcgctgtctgctaggtgagtcccaagtccgtgtggttgtacctacccaagatgaaggtaagaacacccaagcctgcctcctgctcaacctgctgccctaagaaaacctctgcatgtcccctgtctaaaactgtctatgcacttcgctctgagaatgcactgtcttccatctcctaccctagcaatcaggttctatgcatctcagtgcaaacagccgttaacgtttcaggatagacaaatatgctaaaaggacaaaaggaaaaattcttgacaccattttgatttacacctcctcttcattccagcctcctggcgctttgtatggtggctggaagtgcttgacaaatcatagcaccatcaaatttatacagtcgtccctaggtgtctgcaggccattggttgcagaatccctctctgataccaaaatccactcatttctcagccctgaagtcggccctgtgaaacctgtggacacaaaaagttggccctccttatacacaagtcccgcatcccaaatttgattgtggatgcagaacccacagaaacagagggccgactgtatttattgaaaaaaatccacatataagtgaaccagcacaactcaaatccatgttgttcaaaggtcaactgtaggccgggcgcagtggcccacgcctgtaatcaccacactttgggaggctgaggcaggccgatcaacggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagtactcttagtactcctattttatagatgaggaaacaaggcacaaggtgtaagtcacttacccaaccatcacatagctagtaagtaagtggcgaagctgggacttgaacctatgtctctccttcctcaggccctttttttattcaccaagagtacaggagcctaatcctgtaggcaagggaactggatcattttgactttagttcccttgccccaggtgtgggactagaggatgagggagcgggaaagcaaaccttgatattgggagtccacagcctcagtgcaagagttgagaaaatcaatactttgcaagctcagaaactgagaggccatagccttgtcttaatccgttcaggctgcaataacaaaatatcataaactagatggcttataaacaaccaaaatgtatttctcaccgttctggagactgagaagtccaaggtcaaggcagatttgatacctggcgaaggccagcttcctagagccttcttgctttgccctcacatggtggaagggggagctagctttcttccatctcttttaaaaggacccgaatcccattcatgagagctttgccttcatggcctaatcacctcccaaaggccctgcctcctaaaaccatcaccctaggagtcaggatttcaacagatgaattttgggaggacacaaacactcagagcataacgagcctggctttggccagggaatggttaactcaagttagagagaggaaaaaaaaaaaatctttggaaaactgggctgtcctggggtctgctttagtccctggcagtctggcaatggaaagccctacttgttgctttgacttgagaagccgtaatgagcagtgagccacaggcatagaccattcagtagacacaggtctttggccagccttgaacgacaactgctcagagggactgggaagaaagcccgcctaccacagggggcagggctgggagcagaagcaaagccccaggatgggagagtaaattgttataactatccctgcgaggaggtgctaacaaagttccaggttttctgcctacttcaatatttcccggttggcatagcatctactcttagtaggaacagagttctatttgcctaacagagtcaaattacctgtccagaggtacaaacactgctaggttctaagccttcagggtagtggagaggagtggagccttacctttagtttgttgtattttcaactctctgctgtcatcttacttttaggtctggcccctttgtgaaccaaattcttctaactgagtagcattgcgttagcagtcagaaaaaaaaaaaaaaaagatgcttttcaaatataggtagatgtctggacatcccttaggcaaggtggctctgtatgagcgtcactattaaagtgaaaggaaaggaaaagtctccccacccttgtttttttttcaaaaggtatagagtgcccgaaatactttagggatggcagctgttgagcatggaaacaagacttgtccctagagggaaggcaaggaaggcatggggaagagccttcctaactccacttagtgtaaaatcactctgtcctcttcccctgacctgagctggcttattccttggaagagataaagatctgggagtcaaaatgaccaccctgtgctgagcaggcttctttgaactccagctaaacggtaacagcacctaagataggatgttcccaccctcactccccacctcaaagtggaggtgaagagggagataagggaaagggagagaaaggtcccaggaaaggtctgctgtcaagagggaggacccgcagctggctgggagcattcacaggaagtaccaattttcacctccttttttccacagagctgttgcttatttgcctacgacggctgtgttcctcttgaggctgtaatgggcagactagctcagtgggtaacagtgtgagctttggatcccagccttgccacttactcccgcgtgaacttgtgtacaccacataacccatctgagcctcatcttcctcatctgttttgagggtaagaatggtgcctacctcatctacttgcagcaaagactaaattcgtttagtgcaaatgcagagccaggcccataataagtactgtcaataatgctaagatgccatgtttattgttcttgaagcatcacttcagaatctgtgcacagcatggaaggcctgattagaaccataaaaaccagtccaaggccgggcgcggcgactcacgcctgtaatcccagcactttgggaggccgaggtgggtggatcacttgaggccaggagttccagaccagcctggccaacacgacgaaaccccgtctctaataaaaattaaaaaattagctgggcatggtggcgcgcgcccgtagtcccagctactcaataggctgaggcatgataatcacttgaaccaaggaggcagaggttacagtgagccgagattgcaccactccagcctgggcgacagagtgaaactctatttaaaaaaaaaaaaaagccagtccagatgtgtttccatgtttcctatgattactataaacacacaaatgagctgggctcacagaacctcaatagaccttggatatgtatagctaatgatgagcagcgacaggaatcgagagttcgtacagaattttttggtttggttagcgtaacaacaggctttacagacaggctccatgtgcaagcactgcacacctctgtatgttctcagccttctgagaactgtcactgccaaatcttttccttcaccctccccaccctatctcacccccaggcaaggtgacactttcaaagttggcacggcaggcagcacatgccaggcctgtgacccaggcctcagcagctctgctcacttgcatggcaattgctttctacagtcaggcccagctgcactttgggtctccccaacccccacccccaatcaccacacaggaactggctgtttctcttttcttcgtccaagctgaatactaacctactgtggtttgcttgcttcccccattgtgatcgcaggctttctgagcagctagtcaaccctctagcctgccactgaatcggaaggcattcacactggaggggatcaaggggagcttgtaggcttgccttgctggcgggcagctgcctacacccactcgtaccaatgtccccgctgcagagcccgggtgcttcccagctgtacaaggacaactatttgggtcccggctatgccaagagaaacatgggtcatgtggttcacaggacagaaaggttcatttactccaatatgactggcatttttttttgtttgattattggatatttgccaaaagactgaagcctcctgccacaaccacctcccccacatatatgtcctcagatggtttgggaattggacagcttagtcatcaggtcctgtcctccacatccacagaagatacaagttgtttccagataacatgcagaaggttctgagctccttcctgtgtgctccagctcgaagactcttttcttttccctatgaattttttttccttttctttctctggtctttcctttttaatgcccttttaaaattaagtattctatcttttgagtgggtaacacatacacatgatacaaaatccaaaaggtgcaacgagtatatgctgaaaagtaaacctctctaacctttgtccttagccattcagctctcctgtgagtcagtactgttgttagcagtttacctgtatctttccaaagatggtctatgcaaagatccacataaacttgtacatttatgttctgtttttaggtcagcagcagcacactacatacactcttctgtgccctgttttttttccacctgaaaatgtatctcggctgggcacggtggctcacgcctgcaatcccagcactttgggaggccgaggcaggtggatcacttgaggtcaggagttcaagaccagtctggccaacatggtgaaaccctgtctctactaaaaatatgaaaattagctgagcgtggtggtgggcacctgtaattctagctactcaggaggctgaggcggaggaatcacttgaacctgggaggcagaggttgcagtgagccgagatcacaccattgcactccagcctgggtgataagagtgaaactgtctcaaaaaaaaaaatgtatcttggaaatgataccacatcaatccagataaagctgccacatatttttcatttatgacatagtattcaacggtatgatatactatttatttaactagtccctgattggtggacatttagattatttccagtcttctgctagtactaacaatgctgtaacaaatctccttgttacatacatttttcacgcacatgcaaatagatctgtaggataaaaaggggtccccaacccctggtccgtggcctgttaggaacctggctgggccacacagcgtgaagtgagtggccagcgagtgagcattatggcctgagccccgcctcctgtcagatcagcggcggcattagattctcatagcagtgcaaaccctattgtgagctgtgcgtgcaagggacctgggttgcacactccttatgagaatctaatgcctgatgatctgagatggaacagtttcatcccaaaaccattccccccaaccccttgtccgtggaaaaatggtcctcggcaaaaccagtccctggtgccaaaaaggttagggactgctgggctaaattcctagaatttttgctttggtcaaagggcatatgtgtcttacatcttttttttttttttttgagatggagtcgccaggctgaagtgcagtggcgcaatttcagctcactgcaacctccacctcctaggttcaagcgattctcctgcctcaccctcccgagtagctgggagtacaggcacacgccaccatgcccagctaatttttgtattttcagtagagacagggtttcaccatgttggccaggatggtctccatctcctgacctcatgatccgcctgcctcggcctcccaaagtgctgggattacaggcgtgagctgccgtgcccagctgtgttttacatctttataaatattgttcagttatttcagtactcatggaaagactgaacaaccaaaacgttgcctctgttggaagacctctgaggaatttatcacaggaataatcaagtgctttgcttttaagtctttgttctttatttgtatctactgcaagtttgttatttctttccttcaatatgtattaaacacctcgacctctaccatgcaccaggtaagctttgaggccaaaaccataaacacaacaaatgtggttgctgcccccacagtatttacagtctaggagatggagcagttgggggcaggagtacacatgaacgaaataattatacactgagtcattacaaactgtgttaagtgccatgaaggagaagcacagggtgactgaaagtgttcagtaggctcctgacttcgtgtggaggtctcagaagatttccctggggaaatgatgtttattctgatcaataagacagacttagtgaggccgaggaaatggcaggtttgaagtcctagaggaaggcaggagcaaggattctggccagcagcatggattacaggatctggaaagggtcttcaaggacattttgtttcagtctcctcatttgacatgtgagaaaactaaagtttagggagctaaatgacttgaccagggttatacagatagtaacaaagtcaggctgcagaatccagtgtgctcatcctgggagctgtgggtctgaactagacagctatgggatagttgcctgggtttgtgtagaaggacttaagttcaggttcttgtgacaagctgcgtgacatgtttcatttctctttactagtaagatacagtttggatgaatggccattccaatctagcgggttggtttgttcttcagcatacttgtctttcttacaagtttaaataataataacaatggtggttaattctttagcgcttgctctatgtcaaatacagttctaagcaacttacatgtattaaatcatttcattttgacagcagttcttaaagttggtgttattattattaccccattttacagatgaggaaattgaagctccagaaggtaaaggcacttgccaaccatcacagagctagtgagtggcaaagcagggggaccgagtccaaacagtctggcttcagggcccatgtgctttgtctcccaggcactctcagtgtcagcagcaggctgatggactcaggtttgagcccagagctgccttgtgccatggaaggtccaatcagtggctctcaaccctggctgcacatcagaatcagctggggagcttgtaaaaagtgctaatgtccaggcctcgcccccgttcagttaaattgcaatctctaggggtggatcccagtcactgagggtttttaaaagcttccgtggtcagcctaatgcagctaacggttgagatgtactgggatctaggcttgccattgctttgccctttgggagcaaccagcaccccatacttgcctttgtgttctggacacccacttagtaggacacttgtagaggcacttattcataccacagcacaggctcctgtctcagcctaaagaactcattcagtgtacatgctttggcagccacatccaccagtgatgtgcggtaacaagtctgtaaagggctaagagaatattttcagtcctgagcgtcagaagacagtggagcttagtggagtggagcttggctctgagtcaaacagacccagattcaagttgatgctttgtgtcatggtctgtgattttagagactggcgtttatcctctcaccaactccattttgtcatccatataatcaagctaatacgataatactacctctttcatgaggcttttgtgaggattaaatgagatagtatatagaaagcaatcagtgggccaggcgcagtggctcatgcctgtaatcccagcactttgggaggccgaggtaggcagatcacctgtggtcaggagtccaagaccagcctggccaacatggtgaaaccccatctctactaagaaaaattagccaggcttggtggcagtcacctgtaatcccagctactcaagaggctgaggcaggagaatcgcttgaacctgggaggtggaggttgcagtaagccaagatcgtgccactgcacttcagcccggaagacagtgagactgtgtctccaacagaaaaaaaaaaaagaaaagaaaagaaagaggaaaaaaaagaaagaaagaagaaaaagaaagcactcagtgctaggccatgtctttatttcatgactatccacgtagcttatgtgagtaaacagctatatttgggaaaagctactagtgacactgatattgacaggaatttgatttgacatttaataagtgcctggtatgtacaatgaagagtgaaagatcctgaagagcttggatgactaggaaggccccgtgcctgctgactggcttgctggctgggagggagcataaagacacccagataactcatataaggtagagtgtgccgcagcagaggtctaaacgagaagctaagggaggccaggggcggtggctcatgcttgtaattccagcgctttgggaggctgaggcaggtggatcacttgaggttaggagttcgagaccagcctggccaacatggtgaaatcccatctctactaaaaatacaaaacagctggacatggtggcaggcacctatagtcccagctacttgggaggctgaggcaggagaatcacttgaacccgggaatggggaggttgtagtgagccgagatcgctccaaaaaaaaaaaaagctaagggagcacaagatatggagagagaaagccccaattcaaacagaagctggaaaacaattataaaataaccaaggaaatatgaatactaactgaactcaatatgtgatgatattaaggaattataaatttttaggtgtgataacggtattatacatatatttttgaggagcaattatagtttagataaacataattctaattaataatatgtaagtcagatgaattgaaatgatgtctcgtgggggtagagatgaaagaagattggccacgtatagctaattgttgaagttgggtgatggaactttgtgttcattttactggcctctctacttttatatatggttgagatttttcacaataaaaagttttaaaaagagggccgggcacagtggctcatgcctataatgccagcactttgggaggccaaggcaggcagatcacttgaggccaggatttcgagaccagcctggccaacatcgtgaaaccctgtctctactaaaaatacaaaaattagctgggcgtggtggcacacacctctaatcccagctacttggaggctggggcaggagaatcacttgaacctgggagacagaggttgcagtaagccaagatcgtgccactgcactccagcctcagtgacagagcgagattccataaaaaaaaaaaaaaaaaaaaactttttaaaagaggtaaagttgtggccaggtacagtggctcacgcctgtaatcccagcactttgggaggctgaggcaggtggatcacaaggtcaagagttcaaaaccagcctggccaagatggtgaatccccatctctactaaaaatacaaaaaaaatagccggttgtctgtaatcccagctactcgggaggctgaggcagagaattgtttgaacccgggaggcagaggttgcagtgagccgagattgcaccactgcactccagcctgggcaacagagcgaaactccgtctcaaaaaataaaaataaaagagagaggtaaagttgaagaaaaggaaggaaacaagcagtacacaattgtggaatctggaaaattttcaggatgaggtggcatctgacttgggcatgggtgactagggagagttgatgtcgcagtttaaatctgaagggagtctgctggcagaatctcctcttccttgaggggcttcagtcttttttcttttaaggccctcactgattggaggaggcccactcacattatggacaggaatttgttttactcaaagtctactgatttaaatgtcaaactcatcttaaacatgcctttacagcaacatctagactagtgtttttcccaaatagctgggtactgtggcctaaccaagttgacatatgaaattaatcatcacagggtggcagtgggaaatgatactaggaaaaccggtaggggccaaattgtaaagggttttgaattctgttaaaattgtctttagtaaacttctttggaaaatttttcttctcaaaatgttttcgttagaaaattgggaattgttgaaggcttctgagcaaagcaatggtaacatctgatgagtttggaagggtacttggctgcaatgtggaggatgagttggagagggcagagactgaaggtcaaatgatgggtaaggaaactgacccttgcttaagagagatgatgtgaggtactgggagtagagctgaaaagtatccaaagcatagaatataatgcaggtagcagcaagagatcaggctgagcagtaggcagaggccaggtcatggagcacctggtaagccagattaaagagcctggagtttatcctgatgataatgggggacccactgaagagttgaagtcaagggagtaacctgattaaatcgctctgactgctagatggggaataagggcaggtagaccagctagtaacagttgtagtagtgtgggcaaaagatgatggtggcttggactagggtgagagtggaaagaaagaaaagtaaacaaatttgggacatgtttggagccactggaacttggttagtgatggattagatcagagaaaggtgagagacagagaaaacttaaaggtgactcaggttttgggcctgagcaagtaggttgatgacagtgccatttgctgacatgaggaaaactagaggacagtcaggattggagtggagcaaaatcaagagttctgattaggacatataaagtttcagatgttcagtagacttctgagtagcaatgtcaagtagctagttgattacatgatcctgtggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgttaaaaaaaaaaaaaaattttgagacagagtccgctgcgacgtccaggttggagtggaatggcgtgatctcggctcacttcttcctgggttcaagccatctctgcttcctgggttcaagccattctcgtgcttcagcctcccgagtagctgggactacaggcatgcgccaccacgcctggctaatttttgtatttttagtagaaatggggtttcaccatattggccaggctggtctcaaactcccaacctcaagttatctgcccacctcggcctcccaaaatgctgggattacaggcgtgagccactgcacccaacttaaaaaatatttttttaaaaaaagaaaaaaatcggtgggcagagcagatcatataggaccttgtagcctacgagcatgctggaaccacttcctactggctcaggagaactgactgttaaatttcaggaaatttgggagctggtcgacttcgcatttggcagcctgaaatcagccatagtgggagtactgatgctgttgaaattggtaaatgctacaattcagcccttttttattttcccccagagaaccagttgttaaactttgccaccatattagtactatggcttgtaggctccagtaagaaatttagattttattcttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcataattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagcatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccacatttcttggaggctttgctcatttctttttattcttttttctctaaacttcccttctcgcttcatttcattcatttcatcttccattggtgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagactgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtcgtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccgctttgttttctttttcatctcagtttttgaggataagaatgctttgttttaaaagggatcatctgtgtctttttaaaagcttactgaattttcctggtgtgaattatttgcacgtactcatttttgtggttgatttggattttacagtgattaagattttacagtacctgctccaccgggcccagatcctgcttcccagatcttcctgggaagcaccaagaaatttagattttattctaagtgtgatgtaaagtcattaaaatgttttaagcaggtgagtaaaaggatctgatttttaaaaatcactgtacgtggccaggcgcagtggctcacgcctgtaatcccagcactttgggaggccgaggcaggtggatcacatgaagtcaggagttcaagaccagctgggcaacatggtgaaaccccgtctgtactaacatacaaaaaaattagccaggcctggtggtgcacacctgtaatcccagctactcaggaagctgaggcaggagaatcgcttgaacccgggagacggaggttgcaatgagccgagattgcgccgctgcactccagcctgggtgacagagcgagactccatctcaaaaaataataataataatacatcactgtacaagaatggactcccagtgggagaaggcaagatcgctaaggaaactgctgcaacaatccacatgcgcagtggtgccttggcagtgcaggtaagagttcagtcaagaaatttggaagattgttaacatcctaagactggatatagatggaccttgatttatcacaagttgattataattgacctgttatgtaattcgtgttacttagtgtctttttgttttagttgtggggagcaccagattacagaatgattaccttgactcatgacccagggctctttacaattcttaccagaaactggcagatgataaatcagtcatcttatttggtagcaaaataaggaggttactttcctgcatgaacataaatttcctcttttcaatatttcagtcttacattagcaggaggaacttgaagtcttgtgattaggcagattctttgtaagggaaaaggcagcttactatccttttggtaacagttctttactgatagggtaagaaggaaaggaggttgagtccgaacaatgctaaaggaaacactttaaagtaagacatccactgaagacccctagccattttgcctactgtaaaatagaaccatctacaatgtcttgtgaagagagaaatgaaatgaattttgatatttgttttctgcaaagattctacattacattgtgtaagtcttgacccacgatttttataactcatgcataaaattatgtgcaaatgctttaaaaattccagcccactcttatactgagcattttatgtactcattcagcaaaccattcattgagcaccagtcatgtgtcagctgctgcttaaggcactagagatacgaaaattaaaaagacccagtcctcacagagttcacagaacactaggaaaaatagacatgtaaattggacatgattacagtacaattgtgaaagaggtctctttgaaagagttgtctgtatttatttaccatctccagtctttcttttcccattctctctctttttttttttttttttttttgagacagaatctcactctgtcacccaggctggagtgcagtggcacaatcttggctcactgcaacctccacctcccaggttcaagcgattctcatgcctcagcctcccgagtggccgggattacaggcatctgccaccatgcccggctaatttttgtatttttagcagagacagggttttgccatgttggcaaggctggtttcgaactcctgacctcaggtgatctacttcccttggcttcccaaagtgctagaattaacaggtgtgagccaccgcgcccagcccccattctctattctctctctctctctcttttttttttttttttttgagacagagtcttactctgttgcccaggctggagtgcagtggcacaatctcagctcactgcaacctccgcctcccgggttcaagcaattctcctgcctcagcctcccaagtagctgggattacaaccaggctgggagattcagcttgtccatttcatgttctgtttctcacaatcatctgtgtttgcttgtcactgcactttaaagagaaggcataactcaaaagtttcacccttcaacttgatggagaattattttttatttatttatttatttatttatttatttttatttttttgaaacagggtttttctctgttgcccaggctggattgccgtggtgcaatctcggctcactgcagcctcaacttcctgggctcggtcgatcctcctgcctcaggatctactccctcctgagtagctgggactacaggtacatgccatcatgcccggctaatttttttttcttttgtagagatgaggtttcgtcatgttgcccaggctggtcttggactcctgggatcaagcgatctgccagcctcagcctcccaaagtgctggaattacaggcatgagccactgcacccagccattctatatttttaaagcatagaatattgattctttgagctggattaatgaggaaagatataacaatcattaatataaaataaagaattgtgaaacctcattaatttgcatgccactaacctaaaattgtaataacccagggcttagtaagcaaattagtcatataaacagcataactatagggatatttaaactgtttaccaaaagaagctgcttttaaagcctgctgaagtacttatttattactaataatgtctaatattattgacacttataatgttgctggcactcttcattgtcttatttaatttccatagcaactctaagagctaggtattatcactcccatttttgaaataaagaaattgaggccaggcgcagtggctcatgcctgtaatcccagcactttgggaggccgaggtgggtggatcacgaggtcgagagatcgagatcaccctgaccaacatggtgaaaccccatctctactaaaaatacaaaaaaagccaggcatggtggcaggcacctgtaatcccagctacttgggaggctgaggcaggagaatcacttgaacccaggaggcggaagttgcagtgagccaagatcgtggcattgcactccagcctgggcaaaaagagtgaaactgtgtctcaaaaaaaaaaaaaaaagaagaaattgaagctcagagaagttaaggaactcactgggtgcagtggctcacgcctgtaatcccagcactttggcaggccgaggtgggtggctcacttgaggtcaggagtttgagaccagcctggccaacatggcaaaaccctgtctctacgaaaaatacaaaaattagccaggcgatgtggcacgtgcctgtaatcccagctactcaggaggttgaggcacaagaatcgcttgaaactgggaggcagaggttgcagtgagccaagatcatgccactgcactgcagcagcctgggtgacagagtaagaccctgtctccaaaaaaaaaaaaaaaaaaaaaaaaaaaggaacttgcttaagatcaaaaatagctaatgagtagaagagacaagggttccaatccaggtctgtgtgatgctgaagcccacaggcagaagattcgcactctacctaggcttccacagatcactcaaccatgcatgaaagtaaggcctgaaaagtgtctctactaggttgcccttcattaatctagttccagtcatgtataataaaatggagtgtctttccaaaatttcataatttagatttcactcatttaggccgacttcccccctatacatacccactagttggaattagttgccttttactatatgctgtattgaatgtccttatagttgggggtcatgagaaaagctaaagtctaacttggacaagatgacgactggcattgccagggttgtgcagcaacagtagtggggtggggtgtcctgcaaggacatgagttaggtggctgttaggggcagcataagttgtagtgtaaagccttggagcctagatgccaaggtcgcagagtcaccaggaggcaggatcctggagtacagattgcagtggcccagtaggcacagcatctggcctctaggtctgcctctgctatgcaccagctgggggctttggttaagttgctctgcttctccaggtcataggtttttgtttgtgaaacgaataattggaagggaagatcttagggtccatttcagattggggtctctggtttagggatctgcgttatcagagtctaaagtaatcaagtccttggagatctagtaatcagaaggagagcaagaaagagccagctttcattgtcaggggcaacaaagaggtggctcatgcccataatcccagcactttgggaggccgaggcaggaggatcacctgaggtcaagagtttgaggccagcctggccaacatggtgaaaccccacctctactaaaagtacaaaaattagctgggtgtggtggcatgcacctgcaatcccagctactcgggaggctgaggcaggagaattgcttgaatctgggaggcagaggttgcagtgagccgagatcaaccactgctctctagcctgagtgacagagtgggactccatctcaaaaaaaaaaaaaaaaaaaaaaaaaaagaaagtccagaaagcctggtttgaatcagtaaaatcgagttttcacactgcttcactgattgtaattcattcttctacagatttttaaggagggtggaagagagaaaagctaagtaaaatgtggtcctagccatcacaggtctcatagtatcctgagggaaagagacaggaaacaactaactggaatataaaacagaataaaatgtgttcattacctgctgtatgaccttggtcaaatcacttaacctgtccctgagcctcagtttcctcaactttaacagacacataagcagtcaataaatgtcagcagctatgcatcagtagtggcaatagtaatatggactacatgtgtaatattttgtactatgccattacatcttagtaaaatagaaccatctacaatgtcttgtgaagagagaaatgaaatgaattttgatatttgttttctgcaaagattctacattacattgtataagtcttgacctaccgtttttataactcatgcataaaattatgtgaaaatgctttaaaaattccagcccactcttatactgggcattttatgtactcattcagcaagccattcattgagcaccagtcatgtgtcagctgctgcttaaggcactagagatacagaaattaaaaagacccagtcctcagagttcacagaacactaggaaaaacagacatgtaaattggacatgattacagtacaattgtgaaagaggcctctttgaaagagttgtctatattcaccatctccaatctttctcttcccattctctttttttttgagacagagtctcactctgttgcccaggctggagtgcagtggcgtgatctcagctcactgcaacctccacctcccgggttcaagtgattctcatgactcagcttcctgagtagctgggattacaggcacccaccaccatgcccagctcatttttgtatttttagcagagacagggttttgccatgttggccaggctggtctctaactcctgacctcaggtgatccacttgccttggcctcccaaagtgctagaattacaggcgtgagccaccatgcccagcccgattctctcttgagtccattccagtcagacttttgctccaccatccaataaacttctcttttattttttgagacatggactcactctatcgcccaggctggagtacagtggcacaatcatggttcactgcagcctcaacctcatgggctcaagcaaccctcccacctcagcccccccaagtaactgggactacaggtgtgcaccaccacacccagctaatttttatattttttgcagagataggggtcccactgtgttgcccaggctggtcttgaactcctgggctcaagcaatcctccccctatggcctcccaaagtgctgggattgcacatgtgagccactgcacccagccaaaacttctctttttatgataaccagtgacctccatgtgtttagatccaatggtcacttctcagtcttcatcttactgggccctcagcagctcaccactcctccttgacataccaccttcacttggcttcctggacaccacactttccttttccttcttcaccaactgctccttctcagtcttctttgtggggtctaatgtggaagtatccccaggctcaagccctaagtgatctcatctggtctcctggctttaaataccacccatgtactgatcactccctaattatgtctccggccctgacctctcccctgaactccagactcatgtagccaactctccatctccatttgaatggctaacaagcattgcgcagttgaactcctgatgttttcacccaccctcaaaaaacaaaaacaaaaagccaacctgcttctcccatagcgtcctccatctcagttcatggcacttctgtctatcccgtcacttaggccagaaactttagagccatccttgactctcctctcacaccctcatccagtccatcagccaatcctgttgactctaccttcagaatatatcgagtctgatcactgctcaccactccaccactagcatcccagtccaagctaccgtcatctcttgcctaaattactctagtaatctcctaaccagtctccatcctacttttccctccattcttgagtctttttcaacacagcagccagtgatcatgtgaaaatataaattaggtcatgccattcttctattcataaccccccccagtgaccagtcttctcagtaaaagccaaaattcttactgtgtgccctaccagccttatacaacctagccaccatttacttttgtgaagtcatatcccattactctctattttgttcattccattaccaccacattggcctcctcattgcctctgtaacaccccggacatgctcctgtcccagggcctttgaagatatctgtacaacttgcttcctcacttccttcagatctccaaaaagccatcttcttggtgaggtcttctctgattaccctaataaaaacttcagcatcctccagacactccttatgttccccctgcttttattttatccagagcactcacctcctcttagtatttggtgtaatttacttatttattttctttctttgtcttgtcttcccctgcaattagactttcagctttataggaacagggacttttgtctgtttggttcactaatgtatcctgagtgtcgggcatatagtaagtatcaataaatatgcaaataaatgaatagtctttagaggagataatgggagtataaaaaagagctaaggagtgcagtcagtatgattggggtgagtgatgcttttcatgttggaaaagttgtcatgaagggccttacatgtcattctaaggagcttagattttatcctataggcggtaaaatgtcagtaaagtagtcagtggtctgaattggaattttagaaatgcgttctggctgtagtataaagaatgaggccgggcacggtggctcatacctgtaatctcagcactttgggaggccgaggcaggtggatcacctgaggtcaggagttcaagaccagcctgcccaacacagggaaaccccatctctactaaaaatacaaaaattaggcaggtgcgatggcatgcacctgtaatcccagctacttgggaggctgaggcaggagaattgcttgaacccaggaggcagaggttgcagtgagccgagatcgtgtgactgcactccaacctgagcaacagagcgagactctgtctcaaaaaaaaaaaaaaaagaagaagaatgaattggaggctgggtgtaatggcttatacctgtaatcctagcactatgggaggccaaggtgggaggatcacgtgagcccagaaattcaagaccagcctgggcaacatagggaaaccctgtctctacaaaaaatacaaaaattagcagggcatggtggcacatgccagtagtcccagctaccagggaggctaaggtgggaggatcacctgagcccaggaggttgaggctgcagtgagccgttattgcaccattgcactccagcctgggtaacagagcgagactctgtctcaaaaaaagaaagaaaagaaaagaaaagaaaagaattgaaaaggacaagagtgggtccaagaggccagtaacagactgctacagtaatgcacacatgagatggtggtagcctgaattatgggagtgccagtggggatggaaaggaggattgcttggatagggcagtaagggtgggcgaaatgaaggaattccaggtttctggcttggggtagcttgttaaagacttgggccattcatcactgagataagaaatacagaagaaagaataaatctgacactgtcaagaagaaaggcaacgatagattctaggtgtgtcgagttttgagtacttgtgtactatccaggtagagctgcccagtaggcagttaggtgcttggttttggaggtcagtgggaggtcagagccaaagataaagatttgggagccatctgcctgtaggaggtgtttaaagcaaaagctatggtagaatttcctagaaaaggtatataaattgaggaggaccaaaagagttcctggttatcagtgccaaatattgccccctaagaaatccagtaataatatagccaaaaagagccactggatttggaaaccaggaggtcgacaatggaatacatttcatttattcaaatgtttattaaatatctactatgtgttaagaatactaaggatacagaagtcaataaaacagatcaaaaaatccctccttacatgtagctgaaattctagttgcagagaaggagcagataaataaaggaaataaataagtaaattattccaaatattaaaaggcagtgaatgctctgaaggttagataagctgcctagggtcacagggccaagtaagtgaagaaactaggactagaaacgaacctgctcaactccagagttgtgctcttcttactgttgtaccacacctcctctcccacatcgataatcttggttccattgccacagaatgccatatagccccaactaaacatttcagaaacaaaccaaagtatgtgtatagcttaatctaaactcaacaccatttctgaaagccagctctgaggggacatccccttcacagtggacaggtagtaccagttttatatgtagatggtatattgaaaagtcatttcatctgatcgtaaaattatttttctaagaggatggctgggtgcagtggctcacgcctgtaatcctagcactttgggaggccaaggcaggtggatcacttgaggccaggagtttcagaccagcctggccaacatcgtgaaaccccatctctactaaaaatataaaaattagccaggtgtggtggtgtgcacctgtagtcctagatactcaggaggctgtgacaggagaatcgcttgaacccgggaggtggaggctgcagtgagccgagatcatgccactgcacaccagcctgggcaacagagtgtgagactctgtcgcaaaaaaaataataatattaaaggagaaaacgttcctttcagagatggagcattttggtaataatagggttccgtcaggatggctctgaaggtggtgatgatgtccacggggtggccaaaatggtataaaggtgaggatcactgaagccgaaggccagaaactggtcatgggctgggtcgtctttatagatgccaaagttacctaagatgacggcgaggctaggagagggtgagccaccaggtatcacagtcttcaatgaacgtggaagagtggccagattagtagataatagcaggccaaggagtatggttcagtgacatcagccccagctaagtgcttctgtcgtgagagtgaaggaggaagggtttgggaacagcaacagagagcgagaagaatgccaccatcacaatgctccctaccctgtcacatctgtgaggtggagaaatgaacagcctccgcttgggagcttcacaggggaaggaccagtaaagacaaggaaacagaatactttaaaaaggctaagggcatgggattatgtttatcatgtccagaaggcacaggttgggagggaatgtaagtatgaaattgaatctgtcccaaatgtctgcttccttccaggcaaaataaacgacaaatatatggacagggtatcatgattgtattgcacgttaatatctgttctaagcccacagaacaagaagaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtcatgcccttcaatcactgtcattcctctcccaacccacactgagccagctttccttttgccatctttcctgattccaaaaagagttaccatttgtattgccaccgccattatctcactttacaagataatttaccctgatccaagttgactgcagacacattgatgttttctttttaagaacttaacttgattttcatttttggttttaacagatagttccatattttggaattatgtttagcacctttgagttctgcaagagaatctgtctttatcaaaatggttacat

SEQ ID NO: 4974 - DNA, 53840 bp, human; identical to SEQ ID NO: 4967

SEQ ID NO: 4975 - DNA, 53773 bp, human; identical to SEQ ID NO: 4968

SEQ ID NO: 4976 - DNA, 4826 bp, human; identical to SEQ ID NO: 3672

SEQ ID NO: 4977 - DNA, 1509 bp, human
aggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggtaagtctagcggcccttccttcgggcggcggcagcaggggttgagtgccctggcctctggactgtgaacgccccagctgccccaaaagccggagagcgggaaacggggcatggatggggtggtcttcgcgccccagcgtctgggtggtggaccagagtcccaggggagcggcctggctgcagcgggagcgacgtgcggagatcggagcgccaagcttgcgtcggagtatctctgccccggagtgcgggtgtgtgcctgtttgtgtgcgtgtgtctacagacttgcagtcggtggtaaatcccagcaatctgaggatcaaaacacttccctgcaacctgcgccttcgctttccattcgacactccctctttgcaaagtcctggtcacttctaagagctcacgactaacgacaattagaagcagggtcctcgccccctcccaactctcttgaagctgccctgaaatttagagatgcagttgggtgggggcctgacttgcacctcgctgattggggggggggggcgggttgcgcaactctgggggatgggcgggggtgagaagaaagggggggatgaggggaggggaattcctgaggaatcactcaagacagcccagccctgccctctgcagcggcgggatcaacattctttgaatttgattgttactctgctccaaatgcacggaatgtgcatgagtgtgaaaagggagtcaggggcaggagtgagagcgcgagaaagaaacatccagcgcgagcccgcgcatcttctgaagtcgcgcttttcctcgcagggcggaatggagggggaggggcacccttcgactcctttccttatagaaactgggggacagctaccttcgggcaccaacttggctgcccctcgaagctgctttttggtagttacaaaaaaaaacaaacccagtccccctcagctgttaggcaccttcccaagccctgtgatttcactgggcggagaaattaatttggagccctggagagcgggaggggattgtaaaatcatgatcccacctaatcttttaaaattcgcctcggatacacttcaatcaaatcgaattctctctttccaacatactttacattctgcaaaatccctctgtcccgcagttcctgccatcagtctgctcaggtcttctccgatgaatttgcgggaacatctcgagtggagggggcagggagaagatcgaaccccctatataatctccctactgcccgcagaagactcagtgtcaacaaaactcgttcaccggaggggccccagaaagtgttatctcctggatggtggaaagatccgtatcctcaatggttttgcatattcagtataagaatttgctttttcatt

SEQ ID NO: 4978 - DNA, 52783 bp, human
agtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggtaagtctagcggcccttccttcgggcggcggcagcaggggttgagtgccctggcctctggactgtgaacgccccagctgccccaaaagccggagagcgggaaacggggcatggatggggtggtcttcgcgccccagcgtctgggtggtggaccagagtcccaggggagcggcctggctgcagcgggagcgacgtgcggagatcggagcgccaagcttgcgtcggagtatctctgccccggagtgcgggtgtgtgcctgtttgtgtgcgtgtgtctacagacttgcagtcggtggtaaatcccagcaatctgaggatcaaaacacttccctgcaacctgcgccttcgctttccattcgacactccctctttgcaaagtcctggtcacttctaagagctcacgactaacgacaattagaagcagggtcctcgccccctcccaactctcttgaagctgccctgaaatttagagatgcagttgggtgggggcctgacttgcacctcgctgattggggggggggggcgggttgcgcaactctgggggatgggcgggggtgagaagaaagggggggatgaggggaggggaattcctgaggaatcactcaagacagcccagccctgccctctgcagcggcgggatcaacattctttgaatttgattgttactctgctccaaatgcacggaatgtgcatgagtgtgaaaagggagtcaggggcaggagtgagagcgcgagaaagaaacatccagcgcgagcccgcgcatcttctgaagtcgcgcttttcctcgcagggcggaatggagggggaggggcacccttcgactcctttccttatagaaactgggggacagctaccttcgggcaccaacttggctgcccctcgaagctgctttttggtagttacaaaaaaaaacaaacccagtccccctcagctgttaggcaccttcccaagccctgtgatttcactgggcggagaaattaatttggagccctggagagcgggaggggattgtaaaatcatgatcccacctaatcttttaaaattcgcctcggatacacttcaatcaaatcgaattctctctttccaacatactttacattctgcaaaatccctctgtcccgcagttcctgccatcagtctgctcaggtcttctccgatgaatttgcgggaacatctcgagtggagggggcagggagaagatcgaaccccctatataatctccctactgcccgcagaagactcagtgtcaacaaaactcgttcaccggaggggccccagaaagtgttatctcctggatggtggaaagatccgtatcctcaatggttttgcatattcagtataagaatttgctttttcatttttaagggcgtagttatttacaacggggtacaaatgaggccaaggacttggtccgaatcccgagcccagcagtaccagactcccccttactcccagctcgcgcgcgcgcactctttctccaacacacacaccacgcgcacacacatacagagggagagggagagagagagagcgcgagagcgagagagagcgacagcgagagcgagagagagagagacagagaggtgggaatgcactgcttaccttggccagctgtggcgccaacaacgcagccctggctccccgacgccaagctgttgcgcttcgcgagggagggcagagtggaagagtgctggggttccgcagcgtccattcccgctgcggacgacaaccacctaaccacctgcaaatcaagccacagcgccccgggcccgtctgccttcggggagtgggctggttggtggcccagggcttaaagagtcgctacttggcgcactgctctgtgggttggggaacaagatgaagagctttctttcttgggctcccaggggccctcagcgatcttgtgtttctcgaaaggtctgcgcaacaaacagctgagtgggcttcgcccagcccagtctccacactgcgggaaaggaatcataaatcccagatagaagcggagccggcgccacgcattccactttttgaagtccgcagaccgacggcactggcaaattcctgagtccagtgctaacgctgggtttccacagtttggacaggggagtctccccggagttccctggccctggtcccgcacagtccgggcctgaatcagcgtctaggctacttaggagctactcccacttagctctggcaacaccaccttcccttgcgtggggggaagaggacagtgggtaggtaggttagtgtttcagcctccaagggcagcatttctgaggggactccctttattgtcaagacacaaccgcaaccaaaacaataaaatttaaaacacgcagacacactgcaccaaggtgcctgcactctacgcttgctggctgcctgggaatagagcagtgcgtccaaggctcagagtggagcaggcgctttgcaattaagaagatggtaatttgactccagtgtccccccatcccctcccagcaacccccttctcccttttggcaacaccgcccccaggcgcaaaggcacctctactacagtagggcattccttcctcccaaataacacatttgtaattcgcgggcggcctcggatgttctccattcagagaactgtctaaagtggggagggatggatttcagcgcctttaaggaaatgtttgggagattggcagggtcttgaggcccttgtgtgggcagccacttgtttctagggatactcaaggctgggatatccggggacccaccctgtgtggcaaagctgactcaggtaagcaaatcctaatcggttcaaaagatcaacccagagaactagccaggcatcaacaacaccgtgtacaggacaggatactgggttcccaacttttctgtgcccaataaagattatacaccttatctactctcttgggagaggataatcaagaacgtgtgcaaggtaaaacaaagtaacagagacagcatcctaccttctagcaactcacatcttggttccctcagatacacaatcctgggactggcagatatcatatgggttgtggaccagacccacggttacaattgtaatggtaccagttacaattaatatacttattgagtaaggtacctgggaatttagggacatgaataagtgattaattttgatcaagaaaaactttttggaggaggggaattttgagcatgtttcaaaggaagggaggcacccaggttcaaagaccgcaatgcagatgggggctctgaccagggggaatacccggatgagagaaaagctggttgtttttggaagggtggagatagcaaataattgggtgcttctagagctaagcatcctggtcatcaggaatctggggtggaggtggggcactgcagagagggagggctgcagtagttctgcagggaggctgctgaggaggggcaggcaaggccaatgaaaagatttcagactctctcactgctgttggttgcagaggtggttgttgtttaagcagaaatatactgggtgccaaggagacagagtagtgagagatattgtagttttcacactagttagccagaaggcttttaatttgagggaaccctcaggtgtaccctacattaaaaaatcaattctatgagactagcccatatttattcacacaattcctcccacatccttcttgattaaaagggaaacaattctgagatgttgcctcttgtttattcaacaagtaccgattgtttattaggtatcaaacactaggtataaatcgtaataggcatgattttcatatacctgctgctttatttaagtacctcctggtgcctgagtttttttacgtgtcactttactaaacaaaatcagaataagatggtcctgtgtttacagaaacatctaaggcaagccccaaattgtaccagaataagaacacggctgtacttctcccttctaaaataaaacaaccaccaggaaaatgtcctaagcagacacaataaactgccttttaggagcctgggccacaccttcagaaaatgggtatatcttgctctaagtagatgtgaattttattgagtcgaattgacactaaagataaattgaggggtgattcttcattttcaaaacgagtcaccctgggagggggttttcttaaaacagtcaattccccaagtgcaactagaaataatttcatgttacacaattatggtccttataaaataagtggtgacagggaaggacgctcgtgaggggacagagattagatattcgacctggtgatcagagagttttcttaggaattttatccaaagcaaatcctatctggagtcaaggcccctgtggggctgtgggatatttgcctgggttgctcaagtgactgaattttcaattcaggttctaaagcaggaaaaaagattttcaaatgacactatgtggtttgctgagtcacttttctgacctggctcttcctgcgcttttaaaagttagagtgatatttgcaaagaagacccaagagctgtgaataagattaaaggccagctggtggggaaggagcaggcaaatgaaacaaacaaacaaacaaaccaaaattaaaaagaccatgcatgcacacacacttctccaatttagtctgtcaggttacatgttttctgggtaaggtgttgagacacttccatatcacaaagatatccgtggtgtatccaaatgttctctcactctcttttgccagtttggggcaggggagggctagagattgtgtgagtgacaaaagagaagggaagacaagaatgggaggcaatgttggtaagtttatgttagagcccctctgtagaaccaactcacagattcactgagaagtatctatcatcaaataaacttaggcaccctggtttagagactaatttagggtccctcaaaatcaagaggaaggataactaaacttcaggtaaccagaagaaataaatcctggccttcccccaaccctctactattcctttcccagtaccatgcagtccagagctcccggctttgctcctgtgtttaccattagtcagctcccatttgcatccctaatagccctgtcatgaaagggccccgatgttacaggtgtctctagtgggcctttatgtttttgtcccatggaggctggactcaggtctctttaaagatgagtctcatttgccaactcttcttacctcttccccagggtgagacatggtgctttagcattgtagatgcctataaacgttcaaaccacttctacatttcaacgaaaaatagtcttagattagtcccatattagaaatgaccctgatgagtcacatccctcattttcgaagctgacgtcaggggagaccgcctgcccctcccacctcccttggagacttcagcagggacagtactggggaagacaggatggatggtggggttaagcccgggtgatactcccagtgcttttcttccatacaggaggggatatctgcagtggactgcaaggccagccacaacccctcccgtctcaccaccaccttgcctcctgggtctcgcttcgtttccttgacctcgtcccccttcctccatcccctctcccctccctctatcccctctcccctccctccccatggagcagtctgcatggcttctctcaacaactgcttcctgaggctgcagtgaggtctcccagaatgacagggtcttatggacagactcaagtgatctctttagggccataaatgacagtcaagccacgtgggtgggcgactccatcagggctcctcactgcttcatcctcctcatgctccaaacctccactagagagctagactcttctcatttgcttatttttttttttttgagaactcctaggtagtaactctcccctggttatttcctgttgaaggccctctccctatgcctgagaaatccctgcagagtgtgagacagtgctcggttcctttaaaaaaaaataaattaaaaagtgagcctagataccatttttctgtctgacttaataatcctgttttcaaaaaaatattggtttgcactatcatgtctgataagccctgagtgggagaatgggtttctcatcatttatgtttatgtcaccctcacataagcctaaatgtgtataagttataatcctccccacctaactcccccgatacatatctttgtggactaatggcctccaaacactcactttattacacacatttgttatgtgacaaatcttgccaatacaccattttaaagtttatacatgaggtggcaaatgtcagaaataaatgaaaaaaaaatcccagtaacttggcttggctgtgatatttacactgaaaatgaaatttcatatctctagcttatgaaaaaaatctttttagttggatattggctttaaaatgttttcatttaataccccctcccccacacacacacttcccatttatcatatgccttctaatttggtctaaaaaaccactctactaagtagttgtgacacatctcttacagagtgccaggagcacaaaaattcgttttgtttttacgtaactggtgaaatttcttctgttgtttattttcaaattggaaatacatattttattataaaagtggcacctgatgactacaaaaaataatgctctatcccttccccacaaccccccacccgtcaccaccaaagataacttcagttaccggtaggaataggaaaggaaaaccttcttagtgtttttttctttaagtcaatcctttccccagctgaaatgagcaattttaatttctctctgtgctttcaggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattgtaagtatagaaggcacaggtaggtcgcagtagcttgctgtctacagaaattctggctctgctctgatagttttcaattctgtttgagtgtctagtgtttgctcagatttcctcctttgtatctctgtatatttatgtggagaggcaactctgggcccgctaagaagagcactggactgagaatcagaagaatccagcaccatccctatctaacagtgtgatcctgagcaagtcatctcactctttaatacctcaggtttctggtttaggagatgttaccagcagtgttaaccttaggctaaggtcctttctctccgggcatctgcattcccatatataatagaggtcatctgatctcacctgaaatctgaggatcctggcagcttgacactctgaccaacagcactgatctccaaagtgatcctgcactcctatcagaaaaagctgtggaagatatgttcctaaaatatgtatatttattcacttataaattatatatatacatgttcataaaacttatataaaaatgaacattcaaaaattagataaaaataagtatacaataacttttaatatcttcatgtgaacacaaactaaaatgtcaccagataatatgcacttagtgtgaagcttgtcattaaagacagtggctttaaatccttatttcaaatggcccactagataattgtgaatatttttggctgccttcttatcccatatgattagactgtcattggagtcatgtttttaaatgtcaatatcacaatttggctgccaaaaatctaccctgggagttagaagtattaaactctgccattttcttgttgcttacgtttgcttacattattagggtcatcttcaacttctggtttctcaagaggaatcttttcaagcctcttatccattttgttgagactagtttcgttaaaattggataatacaatccaggcacacataaaatgccccaccatcaaccgtttgttgcttggaacttgccctcctccagaaggatagttcacctgatcacctgacattcacacggacagagggtgccagtgacagtctgtttattaaatattagtaatgtttggtttcttattattttagataaacaataaataggaaacagccgtattccagtggattgttttatctaccctagggtgcatgcagttccctttggagactgctaaactagttgcattagaaaaaccaaaacctaatttgagtctacgtacactgctgttgaacccaaaaacctaactctagaggtgagatcatattttaaacaccaattaaatggctcctcaattgttagagagcagaaggacctttaggacaattcagttaagaaatattttagtacagcaaagaggtcagatgtattttttgttgttgttttgtttcatttctctttgaaatgaaatgagagagagagagagaggtggggattggagagagaagcaaagcgagaggggagattaaagatgatgccttggacaagccagagctataagtgaccaagcctggagcctgttgcctaggtcactgatttcattccacagtcagcctcctcaatagctcttgagaagctgggacctaaagtgggctgcaggctatgccttcctggagctgaaggctgctgggggaagtgcctccacagctccagggcaggcagggctcctcccagctgagggcaggtgacccacagacactgtttggtgccctgtgttaaacatgtgatgtgagaactcacccagtgcacttcctgtggtgaggcaagaaaaccagtcgtcagcagaattgggttttatttttaaacacaagcaaagccggtggggggtcggggggtgggtgtgcagggaggaacagagggggtaagatagcatttcggtggcttggaaaagcaatttatagggtctgcttgactttgtgtatttcaggtagctgcattagtaaaatatttctgactgatgagcaaatgctgaagccaagatttagagtctctgtgggtgaggggaaggtattttccatgttatttaagagtatgaactcctattcataaacagtggctgtgaaccttctctgtggaatatcttactgtgggtggctaggttggaatacgttaacaaaggaaggagggtgcctgattgctgttattcaagtacctgatgttcagctagcactagaagttgaagcagtgggggcgtgtgtttgcgtgtgagtggttcactaagagctaatatggaagtgttaataggaaagccatccctaacggacactgtgcccccatgatttaacctttaaaaatgtgctctcatagttcctggagattgcttctttaaaatgcattttaattacataaaataaaggggaaaagacagcagattgaatagcagaaaaatccatttgagtttataggtcagatcacgttgtaacaaatacaattacgactcatacctcagaaacagtaaacgcctgagaatccagatttgtctgggaatggggtactttcattaactgaatagcttggttattagggagttactatagaaactccaaaccagtggtttccccactctgatgtgaataagaatgaccttgtgaacctgcaaaaaatgcagatctctactccctagcccaagagattctgattcagttggtctgcatgggccctggcaatctgaattttcttttcataaactaacctttgattgaaaaagtaataaatgttgaatccacctgaggggaaagaatccgtggggggtggggggagtctaattcaggtggactagcaaccacctggagaattaacacacagtaaaatatgcttagcaataaaaccagaaggatcataatgtgtcatctggagattctgcactgtcaaagtggtcactttaaatataaattactaatgtatagaactgtgaaaaagtttcagcttatttagaactctgctgttttagactctgattaaatgtgttaacaatccatgagaatttaaattttcaaaacagacaaattagggagaagttattagattaaaagaagacttaccatacaaatcatttaaatattgtgatctcaggtacttaaaatataactcaatttgcataattctaagtcacgtgaagctttttgggagcatctttattttgccaaatgagatatctttgtacagtgaggtgcattatcatggcatgttagctactctacctgagctagcatgtggtatcatcgttctaagagacatacgcacacatgcctctgtaaagatgtgctagtctgtacagtctgaactgtaaagttttaaaaaaactaaaaccaggctgggcacggtggcacatgcttgtaatcacagcacttagggaggctgaggtgggaggatagcttgaggccaggagttcaagtccagcctgggcaacgtggtgagacgccatctctacaaaaagtatatatataaaaaattagccaagtatggtggtgcacgcctctggtcccagctactcgacaggatgaggtaagaggatctcttgagctcaggaggttaaggctgcagtgaaccatgatcactcaccccactgggctccagcctgggccacaaagcaagactgtctcaaataaataaataaataaaatttaaaaactaaaaacggccaggtgcggtggctcacacttgtaatcccagcattttgagaggctgaagcaggcggatcacttgagcccaggagtttgagaccagcctagacaacatgacaaagccccatctctacaaaaaaaaaaaaaaaaaaaaattagcctggccctgtggcatgagcctgtagtcccagttacgtgggaggctaaggtggaaggatcgcttgagcctaggagatggaagttgcagtgagctgagatcgcgccacttcactccagcctgggtgacagatcgaggtcctgtctcaaaaaaacaaaacaaaacaaaacagaaacaaaaaccgaacaccaacaaacaaagacaaactggattaagaattttactgtcctcaaatattcaaggcattttatttcaggagggttcagatgagctttctactctgaaggcctaaaaacccaagagcttcatttgttgcctgaagctgaaagagacaggggagggtgattgctgcttcccggtacacctcctcttaccttagatgcaggaaaaagaggcctctaaatgtgtttcccaagcaacccacaagatggagttggtcccctggatagtgagacaagcctttcattcttgcaccctctcctcagctgctatattgatactattagggcgcatactagcctgagtcttctttcaggaaagagagcaagaatttctgccccctttcccagggagtgggtaggagagtcagttaattgaaaatcatttcagagttactgtgggatattaggagatggggacaacagggatcattcaaaacaatcaagatcccagaaaccttctttaggtcagtgtggcctcagattcacatgtaaagactccttggaaaagtccaaagaaattttgattaacatgaatgctcagaaaacataaggagctctggatagtgggattttgtagtaaatagtgaattaggcagaaagattttcaacaggaggtgaaaaagtttctacctcttgtttgaaaatgtttctaaaatctaagttcattctaaaatataagtccctcacttactaagtacatttttaaaatggcacctgggctgggtacagtggctcatgcctgtaatcccatcactttgggaggccgaggcaggaagatcatttgaggccaggcattcgagaccagtctgggcaacaaagtgagacccccatctctataagaaattttaaaattagccaggtgtggtggtgcacacctgtagtcccagctacttaggaggctgaggcaagggggttccttgagcccaggaggtcgaggccggctgcaatgagctaggatctcaccactgctctccagcctgggcaacatagcaaaactttgtctctataaaaaaattaagaattagctaggtacagtggctcaggcctgtagtcccagctactcaggaagcttaggcaggaggattgcctgagcccaggagttcgaggctagagtgagccttgtttgcaccactgaattccagactgggtgacagagtgagatcctgtctctaaataaataaatacatttgaatcttgatttgctggataagacttttataataccacaaggttctcaccttcattggctccctgttgcttccttggcatgtcattcagagctctccatagatgccctcagcctagtctctcattacttctcttttgcaaaaattgccaattcacagtcctctgaacacgacttgggcttttctgccttggggccgtcataacattttttcctcatgcctagaatatcctccctgatctctctctctctctctctctctctctctaggtgctctgttctatcccaacttaaaaacacagcagaaacatgtctcaaatactgaggtccacagtggtgtctacatctttgaactccctactgtagattcctcctattcatggttgctggaaaacacttgtgtcctgctttgtggcatctgttgggctatattctcatttagctttgtttatataggccctcaatcccttctctgaacccttgggtcagatgggattcagaatttagacttcttattttagaaaaattatacaatacatataccacatattatctaacaaccaagtagagccttgagaagcatcccataatcaagcacctcatgtttctataataaaacatggatttttaaactaagtgagataaagatgataatataacctcacatcagttcaagatcaggttttgccaccaagttagttacattcaagaaaaaaaaacacttttttattttaagaactttgtggatttcaggattatggaaagggattgtggactggtttacctaattgtagtatgagctcctttagcctgagtggtcttgatcataccccatcccacctcctggcctccaaattacagatcgaacacactgccagccagagtagatgtccaattaatatttacctaatgactaatttttttagcctttgtcctagatgtctgggacagtgaatgggaacaggcataggtgacaagagtccagcctcaaaaaagcccttgaatctgactttgatatctaatcatctgtcttttttttttttccacaagtggaggacagccaaaacaaagcaaactagttatttgttcaggtaatggggaatcaagatggaggtccaaaggtctgaacattacatgattccatgaagctcttgaggggagaccacagagcttacctttctgaggtctcaggggagcaagcaattgtttagaagcagctgtccattttaaggaaactgttggttttcccttctttattttcaacccctcagctcttccgcaaataagacttctcactccatccttgcagagaacttcttctctagggggcaacaatgaagtccttgttgcttggaggtcacaattctactagcactggtcacaaatgcagcgaggtgtggctaaaagaactcaagctgttattcaggggacccgagagctagtcccagacctaccattaacttgctataagagggcatacatctttacaattatctatgccttcattttcctgtctatcaaatgggaatgatatgaattccaccaaactccatagtattcctgtgaccaaagtagggggcaagtgcttctttaacttaaaatgcttttgaaatggaagattgttttagcaacactggtgagttcattaacctgtcatccaggtaagtgaattcttccagccatgactcaatacgtattagttccctgcctgctgagctctaatccatcttttgagcgcatacaaaaatgtctcctcctctatgaaaccttagcactaccatttatttagcagcctaccttatgcaaatcacactacatacttcatctcatataatcctcaaagcaaccctgtatggcaggctctattatgattcccattttatagatgatgaaaccaaagcacagagtggttaaggaattgggccaagggcacagagtttataagtagcagagccaggaatatattatattatatataatatatatattataatataatataatatatataatattatatattataatataatataatatatataatattatatatattataatataatataatatatataatattatatatattatattatatattatatattatatatatataatatatataatattatatattatatataatatatatataatatatataatattatatattatatataatatatatataatattatatatataatattatatataatatatatataatattatatatatcatatataatatatatgatatataatatattatatattatatatgatatatattatatatcatatatattatatatgatatatattatatatcatatatattatatatgatatataatatatttaatatatataatatataatataatataatataatatatttaatatatattaaatttatttacctaaatatatttaatatatatattaaatataatatatattatattataatatatattatattataatataatatatatatattatattcctggctgcgtgaattattccctgctcctatagcactttgtttttacctggtctgtggtccttaacccagtctgtctctcccttactagaccgtgagctcttggaggacagtagccatgtcttcttattcatctgacataaagctagtagtgaacgtcagaaaactgaatgcattggagtggaatagaatagaatagaatagaatagaatagaatagaatagaatagaatagaatagaggagaaggggagataactggatgaagtaactggctggcctgggatttccagttctggagtgccttgtctttccagacaattccacaagacttccacccacctcttctggtcactgccatcagagagttatttgccatgagagaatatgaggaatagagagtgtctttgcttcctgtcttaggacaaagactgctatcacgattcaggagacattctgcgaatacctttggaagctgatgaattgttaagtaaaaggacttatttttcccgtaagaagctgcctccaaatttctctcaactcaacaagtggcccagagtgccaaaaggagagactattcatggattttctcctaaaaaatagaagccgtggaacatcagagggggagacaagatggaacaaggaaattctcttagcacaaaatagagcacataattataagattttccagctcaagtcaggttagagtggctcaaaagttaaatggctgtaaaaataataataatcactagaaaaaagtaatatttactgagtacttactgtgtaccaggtgctgtgcaaagttctttgaatgtattatcctggttaattctcacaaaagccctataaggtagtcactactgtggttcctatttttacaatataagaaaattgaggtttagagagcttaaccagtttgttcaaggttacacagacatagaagagctggggttggaagccaggctagtgtgataactaagttttaatcagtatattttatggcaacatattttaattatatctgaaataagaccaggtgggagacaggcattgcttgactgttgaatgaggatgttctcagtagagtcttggatattaccctcatgcactgcagcatctgtttcccaagagacattgctgtctgagtggccctgcacaaggagtcctggagatttacattcattccttccattcattctctcattcttggggtctgagacagccacccagtccccctacactgccctaccaagctcctgcccagcccttgggtctcttagattcccaaacctaggtgcaaggcttgggggtctcaaattgaaatagatgtccctgtgagccaaagtaaggctgcagatggaaacccagaccattagtgaggctaaagagaaaagtaacttcatcactgaacttgtgttaagatttattggtccgttctcaccactttttacttcttccactttcatccccatcaacagctatcagttagtgatcattttcatctaagactggcagactcagtcttctaatggcagagctgagagggcagtgagatctgttataccaagccataatctcagccacttagacaggaaaattgtttttagggttttacactgccatttctgttcaccctttaatgaatgctttctgtccataaatgaagcagggatggaagaaggggtgaataagtgctaacataaattgcagtgggtcaaccacaaatacaggctttcaaaaaaaaagatttttaaaaaaattttttagtgtgggttaaggtgcttcctgatttctaaagtacttcctgagttggattggtatgccagatgcatcaaaattgcttttgcaaacctttattttgtgatctatacatcaaagtggaaggtctttttcaaaaaaaagataaaaataaaaatataatgtgtgcttttcatcattatatgtctcttactgactcaccagtcacatgctaggtaatagatattgcaattgaaataggcaggctctgaaagctatggttgacctttacttttagtttttgggcacataagtttcttcttaggtatgattcatagctacaagggaaaactggcaaatggtgggaaaaatacttttattgtacatgctgtatttgtgtaagtaacagctgcatgtggctttagcaccaatacctttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagttttttcttttatcctgaatcatatgaaggggctggaatgattgtgtggtcagcctgactgtcatcccacatactatgtatgccatattgctttgcagctcggctttggatcgttccttggaatcattggatcaaaccttattgagaacaaaaggcagatggtaagttttcatcccttatagagtcaagttcttcctctaaaaaagcacaacatttatgtggataagtaacacatttcttaagtttgtgtgatttggtcataaaaggaactgctactttgccgtttctcctaaacctctagggaatgtgttttactgtgaccctgtgatatgggattggttctcatcttgcttgatgctccctcactggcctagctagattccttatgccaaagggatagaatattctggatcttgccctttgctttcctccttactcccaaaggagtgctccaacctatccaatcaggctatggtcctcacctagaatgcttttgcttacatttctgttactacagccctggattattggtggccgtcacatctttctctctgatacataatcttttgggcaagttttcacagagagttcctgccttttaggagattacaatatagcagactttgatttaatgagcaagtgtacttgtggcacacacaaaaaaagataaaataaaattataaagccatcctaaagtatctccattacccatagttcaaagctaagcatgttgtaagattgaaaggaaggacaagcatataacagaaggtgaagcttctatgtcttaacaggggcccacaagggcaagctgttatactttcctggttcaatctgaaaaggctccctcaagggtaaaggtagaagatatagactgaattgcaagcatattgcagttttatagagttgtaaatcaagatgcctggtgagtggtcagatggtgattgggctccccctgtacagtctctgtggcactgaaactttgacaatggggtctatttcacagcaagtttaatcagataacgtaatagctccaaggacagagaactctaaccatatgttttcccccagcgatatggggaatcaccctcaagggagttctaatagtttttttcttccatttcacctgggctgcctccttgccagttgtgtttgcactttaggcttaaattattcaaaataatgggggaattttaattgtagagctgatcatagcatagctaataatgtcaatttcatgacattgttcatacattatttaccaattctctgtaacactataaagtgagaattatggggagaggtttctgaacaactcccaaaggagataagtatttcctcctagcctgttgaggtgggagaaccctagggtggccttgattttttttttttcgagatggagtcttgctctgtcgcccaggctggagtggagtggcaccatctcggctcactgcaacctctgtctcccgggttcaagccactctcctgcctcagcctcccgagtagctgggattacaggtgcatatcaccatgcctggctaattttttgtatttttagtagagatgaggttttaccatgttggccaggctggtcttgagctcctgacctcaagtgatccacccgccccagcctcccaaagtactgggattacaggcgtgatccactgcgccctgggtggccttgattttgattttctccttctccctggagagcagcttgatgccatgtgatctccccctcttttcttccaaaaacctcagggaaaaaaagtgctgattccatctagttctgagggtcaacacaggcaggcggtcagctcaggtagcatctatctctgcccctggaaaagccttgaaattcctattttcccccacatttggttgtagtagcatctttgtaatagtagacaaattattaggaaaatttctgttatctaacacaattagagaatagggtagcctggttctagcaaacatttgtcttacttgaaagtttttatatgtaccatactggctgtgcatagtggctcacacttgtaattccagcactttgggaggctgaggcaggaggattgctgttctcaggagtttgagaccactctaggcaacataggagacctgtctctaaaaaaatttaaaaattttaaaaatatgtatcatacaacgttgattcagagacttcaatcctttgtaaaatgtccttgacatgtaagtcttaagttgaatgtcctgtttcttcagtgttgcagaaggtcatgtaaagttttgcaggaccccggaatcatcattgccttcatcagtgcccactatagcatcaagtagcagtgtgagggggtaaaaagaacactggattaggagttggtgagcaccaggcttttccacagactagatggagaccctgggcacaccatttcccctcactgtgcctccatttctacataaataaaatagaggattgaactacctaatgtcaaaagtccaacattatttctgagtccaaggatggaagggccgtgcagtcaaattccttcatggacagcatgctagataccagcaagcctcctcttcatttggtgctcacagagtgaatttcttagctttccctgaaaatgtaaaaattgcttcagttgcccattctctgcctcccctgcctacctcccttccactcatcctgcatgaccaaaaagagcattcccatggggtggtaggctagagttctgctttggctggaagtctcttggggattgcctggtccccagaggcagcaagtgcgaaaggctaacagacgcttttgttttattcccccctacagctggtggcttctatcgtgtttatcagctttggtgtgattgcggctttttgttgtgccatagttgacggggtctttgctgccagacacattgtgagtattttttcgtcctgagttaaagtaaataggcaatacaacaaggccccactgaatgtgtgctcgatgttcagtcctttgcttagtgtcatgagggttacatgagagggagaagacacagtcccttttctcaaggagttggcagtcaaggtgaagacaccaatggacacgcggacatctagagaatgaggtctaagctgggggaacaaactccaagtgccatagtggcttatcttggattccagaggtcagagaaggcattcagtggtggtagggctggagctaggcctttgacacgtgggtaagatttgagaaggcaaaggatcaggggaattgcttagaactagtattgggggcaacggggtagagagagagcaccaagaagccacatgacttatggtcaatgccgtcacccaaatagtctatgaaatggcatctgaagaaacaattcctgggcaaggagaaaaacaaggaatgccagagaaaggccctttgcctgattttctttcaggaccaggaatataaatgtaggcccctctaccagatccatcccttctgattttagctgagatcagccatctttttcatcatctttttcttcttataaagcaaatgacacatcagtaactttaaacatccataattctaccaccctaacttgacaatttttattgtttttgcatattagctgctgagtatatacctatttttgtagcatagttgcagtcaatcatagtatgcatactattttgtattcaacagaagccatcttaataacaataattccttgttttgtgtagtgcatttagcttttcaatgtgacttcacatctattacctcatttgaaacccacagtaatcctgtgatatatatagggcaggcattattatccccatttgacaaacagtattcactctgaggcagtctccatggcaacataggcctagtggctaagaagcctgcagtagattttgatggcagcatgagctaaaatggcttccttttttcccctcttcccctcattcctaatgttgtttaatagctttattgagatataattcacatcccatacaattcacccatttaatgtgtataattcaatgatttttaatatatttagtatgtatcagttatttatgtgcaaccatcaccacagtcaattttagattttcatcatcttgaaaagaaatcccataccctttagctttcacctccacattcccacattctccccagacccaagcaaccactaatatactttctttgtgtaaggtatccctattctagacatttcatattaatagaataatataatatatatattctcttgtgattggtttctttcagttagtataatgttttcaagattcgttcatgttgtatcaagtacttcattccgttttatggactaataacattccgttgtatgggtataccacattttctttgtccgttcactagttggtgtacatttgagttgtttccactttttggttattatgaataattctactgtaaacatttatgtacaaatttatgcatggatatatgttttcattttcattttcattttctttctacctaagagtataactgctggatcatatagtaagtatgtttatttgtttgaggaactgccagagtattttccaaagtggctgcactattttacattcccaccagagtgtttgatgggtttgattttgctacatactcatcaactctcattattatctgactttttgattccagccatcctagtgggtatgaagcagtatctcattatggttttgatttgcattttcctgacattccaatgtttttgatcattggctccagtcaaaggcaatgggcaaaaattcaaattatatttactggaagtttcctctaatgaccactacttgcctctgagtccaggccctctgtacctcctgctgctggtgacctgcagtacagcatttgactcaagtatttgggggtacgactggatgaatatttaagaaaatctttctgcttatactatacctgccctaagacattggctagtcctcattgacacccagagagctttgaggaaggaggctttattaatctatgatggtatctgttggccaacttaaatgaaaggcacatttggaccctagcacagcttggatgggtgagagccagctgtcctattgttgaggccctttaacatcatctttccctgttcctttgacttgggtgaatctgaacttcctctcaagacctaccaccttctcactcacccttctctatgtgtcttgtgccatttctcttttgtctcatatttctttcctttcccctctccctagtatagccattaactagcttggaaaatcactttaccttcttgtaccatagttttcttttcttctaaatggatatagtagtaacctacctttcagggttagcatgaacgtgaaattaaataatgggaatggatatgccctaagagggcctggcatagagcagacactcaacataaaacaatttccttttctaccccttcatgccatagttggtagcccttcagattacagaggttgccaagccctggctgagtgaccttttcttgcctcccaattgccttgttcttgttactcttctgggcctcaatgaagagtatcagccagaggcagcaaatgggcaactatcacacgtctgtcttcatgtagggcacttggtgcctgaatgctttttgcaaaaccaggaggtgagaagggctgtgaccagcacattaagcctcctcttcagcaggataattatgataattattctgccactacccaaacaccaaacatggacaataagcccttccaggtgtgagcatgaacaccctcattcctttccagctagactccaagctaagctaacagggcaaggtactttcagaacattgagcaggcaggagtttcatgtagaagtagctagctgatggaaagtcctagaaccttaatggggaggccggctaaaaggcaggaggcatttgagtgccaagtacaaaagacgctaaatcacatgtgtggggaaaagcagccactgagatgatcgtaaatggtgaaagaagtgggggcagaagggaaggagacaatacataaattccctctgcctgggtacttctgccaaaccccaaggtcaatttgcataagttgtttgtcctgtcctaaggtgcctttggaagaagccccctaccactcaggggaggtttagcatcagtccggaaagtgaacagcagctcctgcctgcaagcttccaggcagccctggcttgtgtctattggttctaccccaacccccatgcatgagagctctctctcatcaggaagctggccaagccagcagagtaaatcgactgtccttgagccccatgttagttttctgagacttgaacagtgtttttggagttcactgattttatctaatctatgcagttgggtgaaaatggctcacagttcaattgagttaaaatctacagcagcctcaggagctgcccctcctcctgaggcttgcttcctgagctcttccttctgaaaatgatgcggaaatgacagcaagaggtacaagtcagccaaccatagtcctgtccccaggtgataatgaaacctcattgttggacttgagctctctctgcttgaaagtgtcatttcataataacctggagttttgcatcttgttccctgaggactgtttacaagaagacaaaggccagaagtaaaagaaaaccagagaggaaatttcaagaagcccatttctcaatcagtttcataatttctcattaaccaagtagtctaatagaaagtaatttttaaagtatttttgtctaatcttcactcagtctccctagacaggtgactttcagaaattaacccaatctactgcctgcctgcttctgtgtgtgtgtgtgtgtgtgtgtgtgtgtattcaaaccttttattaccaagtacaacacttgctgttttattttccaaagtcaaaacccctttgttttggtgtttcccttttcaggatctgaaaccactctacgctaaccggtgccattatgttcccaagacatcacagaaggaagctgaggaggtgagccagaatgaggctgcatgtctttacctcctgggaaagtcccctgttctgcctgaaacaccctttcttttactccttttcatgggcctaagttttatttctaggtatgtatagctgatttgttcagtgggtcagagcacattgctaatgaggccatggtcataggttggagcctcatgaggcctaatcagttttactttgttctgtggccacaggctgaccctctgaccccagccgggagcctccccatatgtggctttgatcctcagggggacaaatgagagtacagaggccacaggacatgaccctcccccatctctgtggatgatggttcagttgcctgaactcagtgctcagttggaataaaagtggaagccccaccagggcactaggcctgaactacggaggcagagcctgagttccacacataggatgggtctggaagccaaatgagggtaactgagaagccagatccacctttatgctctggggaggctgggactgtcagcctggcccctctcataacacctccaagaggccagcctaataatgcttgagcatgcacagatgagtctctcttctgccccaaacagctctccttatgttccatgttgcctcaagcagagctagatgcaatgcgtagtgaggcaaagtatgactccaggtcatttttggagagctttcatttcagtatacaataatcccttcccaacccagggatttctccatatgaaactgtacctaggcttccaggaatcttgacaattttgtactctattaacctcacattgaaagtcaatcattcccaaatagttagaaaaatggtaaactttcagttgggaagagaaaaggaaggcaattggatgtaaaatggccactgcattgcacagcttcaggggaagccattttacataaaatacaatgtgaatgggtgcccttggagtaaggcaaagcagtcctgctccaaaggcaccatggcaaatactttgattatgtctctgccatccacttgactcctttttcttttaacaaccataaatttactatttctctcactgttctcaggttagataggaggaatagaaatgcatatatgataacagcttatctgaaaggcagtaagcatttggatgaaggacccaatatagaaaaaaatgcccatttgctatgaatattctctataacaaagcaagacaaatttagcagcacttcattgcatctggatgggggagagagctggacaatttcttgctaacaagagatggtaaatgaaattcttttccgtttttaaaacctttttgctaactcaaaatgtgtaaaatgtcattgctgttctctagattttgttgtgatagctttcttgcgttaatttggtgactgtaaaaatattaataatgacttccataggttcacttgtaaccctggtccccctaaccctatttttcctacataaggtcataagttcctcaaccaaaaattctccttccacgagggttatgaggaaccttacccaggcagctagagaggtactattgtacttcagagtgcatgcgccggctcctctgtcttccttcccaccttatcttctttcctcctgtaccctgattttgcctgccctcatattctcatttccttcagtccatttgttcttccgtctgtccttccatctgtccttccttctctccatctccaccattcagggatggggcactgagggctgtggcagaggctggacatgagcccagctacacagtgacttgcctcatgcacaagttcggccagctccccatccagccccatccttcccacacattgggtgttcatttcaaagccatccttactgtctccatcagtcactaactcgcatttccaatcccagagggtcctgcttcctatccaatgccagctcatctcctcactgttatataccgtcaggttaactgccctcacctcagccgtgaattctgcacacctcgcatccggggcaacacctgcttctgctgtgacctctacaactgtggcaagtaagtgttgaggcccagacacaggaataatggtctgaccacaacggacactagaagggctgaggttaaggaagggtgcattgtgggaattagggaagtggaagacattgatctgttaacagattttggctaacagacattacttgccttctctgtgccaggcatcatgctaggtactttcacatacttgatctcatttaattcttacttatgatgtatgcagagtaatcctcattttatagatgaggagagtgaagttcaaaggaaacagacaactagcccaaggttacacagaacttgaaaataatatgtataggattcaaactcagctctgtctatatccaagtttaacaatgttcaataaatagttactgagtaccttctcggtgcctggctctgttctagacactgaaggttcagcagccaacaaaacagaagtcctttcccctgtggagcttatattctagtaggggagacagtcaacaaatacagaaatatataatataatgccaggtggtgatcagagctctgaagaaaaatgaagcaggagaggtagatagtgatgaggggtgtgtgtgtgtgtgtgtgtgcgtgcacgtgcacatgcacgcacactgtatgttagatagagtagccagggaaggcctctttgagcaggtgacatttgtgcagacctgaaagtagttgggggtgggtgggcaacccaggtagatacctggagaaagagtgcttcaagcagagggaatagcaagtgcaaaggttctgaggcaggagcagttttggtgctggttctgctacagccactctggctctgtgcactccaaattgctaaaacatcctttattctttctttcaaaatatatttgggcgctaggaatacagagattgccactgaagagctcgtagactagtaaagaggatggacatgtgaacaatcgattgcaatataatgtgataagtgcagtggggatcagtggatgtggtggggattctggaggcccaatgaatgaaagtcagagtttgccgggagggaaaagtgtcaaagagtaggtgatatgggagctgagacttacagaataagtagggaatcaggagacaaaccaaaagaagacagaggtgggaaggatattcctggtagttgtgaagaggtagtgggtggaggtagttacagaaggtgtggtaggaggtaagacagaggtgtagccagagatcagatgatagagagctcattggccataggaatgacttcagacttgaccctgtaggcaactgggggccattgaagggtacagcatggaagatggaattgagtggttgaggaatggaggcagctaggaggccattgcaagagcgcaggccatagagaatggagcctagatcaagttggagacaatgcaaagcggggaatcattttaagagcaatttagaaggtagaatcaatagggatgtgtgagtaggtgatgtgcacagtgagtgaacacctctccatgcagggtatgtcgaccaatgttcgtcatgcacgtatttccttcagaatcttagtgaaggcgaactgagggccacgggagggagggagtaaggggaggaacctgcagagtggggctggatggagctagattcagaggcagcaagtggatgcagccccctcatcactcacattccctactgtcggtattttggggtcagttactctggtttaaggattaagacttgccagactagagtcagggaggagaaggcagagaccatacaccagctctttaccttctttgcttgtgccagtcttgtttcattgaaaggtttggcagtggaggaagagaaatttacagattcaaatgaggtttagggattatctggggagttcaattatttatgttgtaataataaccatcacttgtaaaggacttccctccttagcagcaatgatggagagctggctataactgtacttcctcagcccatccttacaaaaatgatcaaagaaatgtaacacgggtcctaggggaattggggttattttactatctttcctcttgcctcccctcatccttccttccccgatctgtctttccctttgtttttatctcctccctcttctctccctcctcctgccatccttctccattttccttggtgctctcctctcctttcccatttcatggcctcctagggtggtgctgggagctggccagaactgggcctgagatctcaaggagagaggaggcccactgagagggttgataagtgattccttgcagacacacctttctctctgtgacagtgtgtttctgaaaaaggtttgaatacacaaaaccctactttaaattccatttagctgagtcctcaggtgaattgtttttgaaagtggaggctcaagtccattctatgttcctgtcaatctgaacttcataaaaattgacttccttactttcttaaagcaagttataccagaagagtcttcaaggaattttatgaggagctgtgctaaactatgcactccccaagggcagggagcatgacttaatcttatctatacttccctggccccagcacagggctgggcatgagtaaagagccgatgaaaagggagtgatatttgttgaaaaggaacaaaaagaagaactcccttttcactggggaaaataaaatattggactaggcaactgagaggggtcatgggaacagtcctactaaagatcttcaagcctagaaatgtctttcacctacctagtgcctggaagccagccccggacatctctcaaagccctttcccaagtctgtagtgctaagattccaagggcaaagccactagaaaaggacttccttagcttttcctgaggaaacagtcccaccaggccataaacccaggctgagactgaagaggcgagggtcccacaatagaggaaaatgttttttcttgacctggggctttttccacccagagccaaagagacctaaactcaaggcctaaatatagctagcaataagcattctgaggcttggagactttaattttgccaaatgtgtatttgttttcctcacacgaagcctatttttaatcaattgccagctcctccggtccatttcctggaaaggaggccaagaaaaaaaaagtgggaacaaaaacatcaggcagtcatttgtacagtgctacagaaacagagtctctactgtcccctcgaacccacaggccttctttgacgtcaggggtgttgaggttttaataccaaacatagattattctatttagcctcatgcaggaaggtggctttctctaggacacagctcctcagcagttgcctttcagagtacttcaggctttcacctactcactcatctttggaaaggtcaagtcaatatcactggttttcagcccgtaacctaaaggaaatgaagtgatttgtgaacagcatcagctggtaataaaatgaaagaagatagcctacttccattcactcttttcttcgacaaacttttcttgagctcctactatgtgctaggggctgttctaaaagaatgggcatcaataagacacagctttgcccttaaggaactcaatttgccagggagattgaagggaaggggacttaaacgtatatgcagaatgcatgcagcaggagagagacacatagaggctggccattgccactgcctgtccaccaagaattggtgagtgctccaggcccttatggaagagcagaaggatgccctcctgccttatctaagatcttctgctgcctactttgttaagtaggagactgaaacacagagaacttatccgtttctctaggtccacccagaacgttgagagcaagggggtaaaagcccacattgggtaatcaatctcatgatcaatacagtgattagtctttgcactcagttactcattcaccgagtatttattgacgacctttaatgtttctaccactgtgctaggcagtgagagagacacaaaggaatgttaagagacgaccctcgccctcaagaggttgcgattttgacagaaacatcatgtcggccttggccttgattgtaacattagcaccagcacagtatttagcactgatacgctaccaacacatattagattaaataaataactgaattattgatatatacaaagtgccaaactaagaggaatagactatgggagtccaaggaaaaagctaatgaatgggtagtggcgtctttgaagaaggcactattgaagctttgagcagtgagagagattaggataggcagagaacagaaagcaataccttcaatgcagggggagaaatctgagcaaaggtttggaattagtacccagcatagccagtgtggggcttctgtggactccagcctggctggagtgtatactccattttgaggctggactttggcagactgaggaatttgaacactcccctgaaggtactggggagccacagaagggttttgattaagtgaatgacatatttttaaaagtgttttaggaagagtaatcaggcagcagtggggtctggcaggacagccttacagtgatggaggcatgaggatgggagcagtgggaatgcaaaaggtgcaatttcagaggaagctctgcccagagactgaaccaaatggaatcctgaatctcaagcagaaaaaaaccacattaatttgctaaacccgaaccatatctaagaattagctttcttttccttcatggttcagtgaaaaaaaaaaattaaatggctgctggaaccactcaaactgaaaccaagtatatattatctaaaattattgaatattttaaaacaaactactatcctattcccatattgcggtttgtgcctacaaagtcttaatactggccagggacagtggctcatggctgtaatcccaggactttgggagcctgaaatgggaggatagattgagcctaggagttcgaggccagcctgggcaacatgtcagaaccgcatctctacaaaatttagctgggcatggcagtgtgagcctgcagtcccagttacttgggaggctgaggttggaggatcacttgagtcaaggaggttgaggctgcagtgagccatgaccataccactgcactccagcctgggtgacagagcaagaccccatcaaaaaaaaaaaaaaaaaaaaaaaagaaagaaaaggaaagaaaagaaggaaggaaaaaaaaagaaaaagaaaaaacccaaccaaccaaacaaacaaaaaacaaaataaagtgttaatacctttaagaacagggttcaaaggtttgaattgtgttgccagaggctggctcttagaaggaacaaaatgtagctacatattttagtggaggcttttattatatgttggagtactgctttcatgcctgttggcattacatcccccgggctcagagaagttaagtaaagtaagtaacctaagagtaagaaagtaagttgctagagtcagcatctggtgacagagcatagatgacagagccaggattcgaacacagtctgacttcagagtcagctatggcatactgcctgcctatatatactactagtccacccttggtgttttaggaggcaggcaaacataatttgggggatgtcagaagttgactcccaagctacaaaggtgctcctgcagttccacactcacccatacacacaggtctgtccttttcagagaatagtccttgtacagctgtccgtttttgggggcagtaaataatctgtgcatcctccctgccctgtccccagggcctagtacaatgccagctaataggagacaatgtatgcttatgcatgggctcttgagatatgctcctgaaaatactgaaatccaattcaaactctgattaattgaaactcccttaaaattccactatgggccaagtgtggtggctcacacctggaatcccagcactttgggaggctgatgtgggagtatctcttgatgccaggagttcaagaccagcctggccaatatagtaagactctgtctctacaaaaaatatttttttaaaaaattccactacggaagcttactattaaaaacagtgggtctcaaacattgatgaacttgttaacacagattcttgaccccatcaccagagattctaccagattcagtaggactggggctgggcctaggaatctgcatgtttaaccatctctctttctcaaagatacatgcacagatacacgcagagacacccacaggcacacacaaataatgcactgatacaaacaggcaggcacacatagacacaaacacagatgattctgatgcagtctgccctgtaaccacactgacttcacctccttagagaaacactgactttaaagaatctgaagataaattcatctgtaaagtttaagtcttttcatatgtgaatagtccctctctgattcattttggagatcagcctttgattgtttttctgttttcttttttgcattcttatagcaggggagtcacatgtaataatcatcctaatgccagggcgtttcgttgtgactttaagtgttttagattcgtgatgaactccagtggccaagttgtaaactagtttgtgacatccaggaggacaggaactttcatttaattaattccacaggtatttatgtagcaccaactgtgtgtcaagcacagcagtgagcaaaatgaaccagttcctgccctcatggagctcacgttcaagttggggaggcagacaataacgtagtagacacatcagtaagttattttcatatgggaatgaatgctacagagaaattagaaaagggtgatgtattgcttagctcgggctgccataacacgataccatagaccaggtggcttaaacaatagaaatgtacttatttctctcatttctggaggctggaagtctaagatcagggtgccaacatggtcgagctctggtgagggctctctacctggcttgtgccacttcccctctgtgctcacagtgacctttcctttcacattcaagtagggagggagagaacgaaagtcggggtcgggggtgggtgggggaggggcgtggagtagggaagtcaggggagaaggagggaaaaagaggaggaggaggaggagagcgagatcttccttttcttataaagccaccaatcctatccgattaggaccccacccttgtggcctcatttaactttaattatcttctaaaagccctatctaaaaatacagtcacattgggggatagggctttaacacatgaatttggagggacaaaattcattccatagcggataatgtgatagagagcgacagggctgggaaggggtgtctttggacagagtggtcaagaaaggcctccccacggaggcgactttcaggttttgtgtagcaactcagctttagttgtttaccaggacattggtttttatttgtttgtttttttgtttgttttgttttgagagggcacacactgaagtctttgaagcctgaattcaggtcccagttctaccacttacgacttgggcaagttctttaacttctctgtgcttcactttcttcatctgtaaaatgtgcatggtgatagtccctatttgataggatactgtgaggatttgcagaactttctgcaatgatggaaatgttctgtaacctgctctgtccagtatagtaaacactagccacatgtgactattgagcacttgaaatgtggctggtgagacttaccaactgaatttttctttttacttaattttacttaatttaaatttaaatagccacatgtggctagtagctaccacattaaacagcacagatgcaatgaattcacacatgtgaaatgcttagcactgtgcctggtacatagcaagtgtcaataagtgctatctaggattagtgttagtggtggttacaagtatttttctggcaggtaggagttttttttcggggagtggggataaacaatcacactttgatttattatagtacatggctatgatgtctcttactgtagctccccacctgcccacctgtcttttcactgagctgtatggtagcccaatcccagagttggggagggggctggggaggacagcctgctccctggggactgactggagcatgctcctccctgtccagccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatggtaaggaaagaattgactttgcatttcacagtggcccctgttggacatagggggaaggctaggcagttgggggaaatgcagacacatattttgaagggaagaatcagaagcaattgcttcaaggatgtagctgccttcaaatgtctcaagttgaaggagccaggtaatgtcatcagtctgcaaatatttcttgttatacacaaattacctgtgttctggaggcaccttctaggggtggggggtgaaaggaggaaggggtgttctcagttcccccattcgcactggttatgtaaacatagtcttttatagccccaccccacacttttagtaaaattttttgggaatagttttcccctaacaaactttgggagagatggaaggaaaggttattctagctataggtaggattaatgctagtcttcccctccccaggtatttcatagtgaagtttcttcagaaagagcatctgggctcttttctgtttgcattcgcagagccagctctaggctaagttgcttgccaggtcttgccttcaacttggacctcaacctcagcctccccactttccattcttcccttccaaatcttttctatttgtgtgtgtgtgtctgcaaaggcacagcaggactcagcattcagtaggtactccatatagtaggcttctttttttcctttccttctaaggcatttctaagcatttatttgtttatttgataaatctagatctctaattatggagataatagctttgagttatggttatcaacctggcttcatataagaatcacctgcccagcatggtggctcatgcttgtaatctcagccctttgggaggccaagacaggaggattgactaagcccaggggtttgagactaggctgagcaacagcccctgtctctattaagaaaaaacaactttttttaattagctgggtgtagtggcacatatctgtagtcccagctacttgggaggctgaagtgggaggatcacttgagcccaggaggttgaggttgcagtaagccatgattgcaccactgcactccagcctgggtgacagagtaagaccctgtctctaaaaaaaaaaaaaaaaaaaaaaaaatgcttgggctccttctctaaagattctgatttaattggtctaaactgaagcccaggcatcaggttttgttttttggttttttggttttttttttttaagctcccaggtaattctgatctgcagccatgattgaataccactgctttaaatgaacatcccacatctgtttatggaattattttgtgcctaagagggactttcctttgaccccagaaattagctcctaggcccttggctgtttctgtcagattttggggtccctgaagaacagaacctgaaaggcagtttgtaatttgatcctggacggtcaaaaggatgaatgttggaaagtgaaaggtggggtaggacaagggaaaagaaagaaactctgtcgttttggattgcaagtctccagcagtactgggctgactggaactattaagtgttcctgctagtgactctaagtcaagagaaatcctttcctgcccatctgcactctctctttcttctttctctccctctctcatccgcacatttctcttcccagcttccctccccagactctggaatgcccaagcactaacaagtaggggaagcatcaacaaaggtggagccccaggagggaaaaggatttcctgtaaatttggccttgaggaagcttttaggttagagagctgcaaaaaaagctgtttctgggttggggcttctttggagaaaagaatgccctttgttcttggagaatttccccagggggcagatgaaagtacaggtattgtgtggaatctcagcagctttggctggaagagaagctcccaggtttggcgagttgaggagatgggacctcaggatgagtgttaagagttctctaaattgtccctagagctttcaggcttggatggcagagataccttgatgcacaaatggagtaggtggtagctacttggtaggctctgtggggtgcctgtaaggcttccccctctccaattttaccctactgtgggcgctgaaactgccaccatgttttattccttactttaagataagcattgtcctttttctccttgtccactttcaagatgcgtgtattaaacaaaggaataggctagtaggccacagaggtgtttatactttgagttactagtctctcagtgtgaaggatttgataagacccttttccatggtgatggaaagaattggattttgaaggcaaagggcatctgaggaagacagggagagtggctagatggacactttcaagaaatttctggaagttggaaagaagggaggaataggaagatgatatgctaaggaacacaaccctgccaagcttttagccttagctttagtcccgttttccctcactgtccccctttaaaaaaaattgaggtggaagtcacaaacataaaattgatcacttcaaagtgtacaattcagtggcatttagtacactcacaatgttgtgcaatcatcatttctgtctagttctagaactttttcattacctgaaacctgtacccattaaacaatcactccttgttgccccttccctgaggccccagcaacccctaatctgctgtctgtccctatggatttacctattacaggtattttctataaatggaatcatgcaatattcgaacttctgggtctggctcctttcacttatcatattttttttgtttttaaaattcatctaccttgtagcatatatcagtgcttcatttctttttatggctgaataatattccattgtatggatagaccacgttttgtttagttttttatccattgatatacatttgggttgttttcatgttttagctactgagaatagtgccttcatgaacaatcacttacaagtacttgtttgattacctgcttccaattctttttccacctatgggtggaattgctgggtcatttggtaattctatgtttaactttttgaggagctgccaaactgttttccacagcagctgtgtcattttacgttcctacctgcagtgtgtgagggttccaatttctccacatcctcaccaacactttctcaaaaaaaattataaacattctagtgggcacaaagtggtatcttgttgtggttttgatttgtacttccctgctgaccagtgatgttgggcatctttttatatgtttgtgtgcaatttgtatgtatatcttctttggagaaatatctatcaagtttttgcagatttttttattttccaaacaatattcaagattgttaaacaaaattttaaagtattataaaatgtttaattttcattagctttaaggtttatgttacccccaaattttgtatataactgaagtttcaaatctactaacactcactgaattgataccactctggattctaaggcatcagtttcttcttaccaatttttctttgcttcttctaacatttcttgtgtttcatcttgagaatggctaatgaaaacatcaccaatttgataaggtatcattaagcagtcatcatctgcaagcatgatgtcattgcaaacaacttctaaattgtggagttgtttccttttaacttctgtttcttccttcagctctgtgattctactcatattccttgcaaatttgtttacctaatgttgatcttcaaaagtagcgttgaaattttctgcagcctgtaaacaacagcactagtagcacctacctgtggacttgtgagggctgatgtgataacccaggtaaagtgcatgtattagtccattctcacactgctataaagaactgcccggccgggtgcagtggctcacacctgtaatcccagccctttaggaggccgaggtgggcagatcacgaggtcaggagtttgaaactagcctggccaacatggtgaaacgctgtctctactaaaaatacaaaaattagccgggcatggtggtgcatgcctgtaatcccagctactcgggaggctgaggcaggagaatcacttgaacctgggaggtggaggttgcagtgagccgagatcgtgccattgcactccagcctgggcaatagagtgagactgcgtctcaaaaaaaaaaaaaaaaaaatagcccaagactgggtaatttataaagaagagaggtttaattgactcagctctgcatgactgagaaggcctcaggaaacttacaatcatggcagaaggagaagcaggcacatcttacatggcaacaggtgagagtgcatgtgaaggaagcaaagggggaagagccccttataaaagcatcagatctcgtgagaactcattcactatcatcagaacagcagcatggaggaaccacccccacgattcaatcacctcccaccaggtctctccctcaacacctggggattacagggattacagttcaagaggagacttgggtggggacacaaatccaaaccgtatcagtgcatcaagtgcgtaaaagccaacctcagtcaatgggaccttcagtttcccataccctaaggacaaggcctgggctgcagggtcctcatgctccccagaggcaccctcagtactgagagaggtgcccagagccctccatggattccggcctggggaccccctgcctcaacaagccaggtgactaagcaaatgctcagggccctaggtgcagacagggctccccacagagcagctgtaagggctgggggcctcagtcttgggccccacactgagcttcagagctgggcacccccagcatcccacaccctccactcccctgctatagctgagacctggccactgaccaagaatcctgcccatttttaaatctgttttgttgttgttgagttgtaagagttctttataaatagcggatactagagcattatcaaatatgtgatttgcaagtacttcctcccatgctgtgagttgtcttttcactttcttgataatggcctttgaagcacaaaagtttttaattttgatgaagtgtcatttatctatcttttcttttgttgcttgtgcttttagtgttatatctaagaatctattgccaagctcaaggtcatgatttccacatttttgcctaagaattttatagttttagctgttacatttagggctttgaaacattttgatttaatttttatatctagtataagttaggggctcagtttcattctttttcatgtggatatccagttttcccagcacatctgttgaagacactgctctttccctactttatgatcctagcaaccttgtcaaaaatcaattaactgcagatatatagatttgtttctgcgttcttaatttcactgttatctttgatctcctgaggaaaaaatgggtttgctgatggtctgtcttgatagcggcaataatggcccctaaccctctgcaaagtgcttttgcacagttaatcttcactattactactttgtgaggtaggtattactgtctctgtttaacaggtgaggaaacaggccaagaggggtcaagtgacttgcccagagctgagtagcagaactgggactggagcccagatttgccaaatgccagagcctttgctctttctatttcatcccagctgcccctgactaacatttgggtagccctttctggttctatgagtgttttaacatatattacctcctttgtttagttgatttaattaaaaaattaaaagcaagttgtttccacctgttgggagcttctttgacagtacggaaggagagcaagggaagtaccgagcattatcaaatgtgaatcccgggaactctatcaaggaccagggcagaaaaaaaatgaaagcaaagatctggggagaagatctttgattcatgagattagagaaccagtgggggcacagataaggataccaaggaggaatcattgcctagatcactctattaaaataagaccatggtgtaaaaagtccaggaacatcattcaggtgagcctaagtacaatccttggcctacatccaagtgtggttggtgacttgtgatgtgcctctccctgagtagagtccccggggtctgcagggaggcccgggggtgctggctgatgaaagccgtttgcagagagtgaggacaggagccgagggctgtgagctggcagtcttcaatggaatcagctaggaaccaccatttccaaagttgtgggatcctgaaaggaaccctgacaagaggtgcttggtgaaaaagatcttaaagaaatgtttgaagaagtgcttgttgaccaaagatatgaggatttgagatgaatttttaaaaagtgaatatatctttccattttctcctaattggtatcgctggtttagagtaaactggagagggaaaaaaagtagcattctttccaaagtccacaatcattgtctcagaatagactcagttttgtccaggcaagattgctttcaccatttgctgtgctacctagtaaccttttgtgttactggagctcggaatgctactgatcaataatgggggggcagggcgggcgtctcacaacgtaagccccagaattctaacagaaatacacatacacacacacacacacaaacacacactcctatacgtgcacacaaatagaaacagggcccaaatttattgtaaaatcagatttattgatttaaaatataaccagaccactattttggcccatctcttttgccccatccctgactaagtcttcactccattccccatttcctcttcttccttctcttgctggcttgtccattttctctatatcctctacccctgactgtcttctcttcagagactttcctatacccatttaatcttactctcatgtttcttctgtgctgccttctctaaatagtcaacttcctttcaaatattgtctagacccttggccttgctgaacacacaaaaacttttatatagtttacattgtatgattgtttctccacagttaggcttaatttatttagatagaagagctggtttcattttgcgagagctggagggtgtgtttttaattgacagtatgccaagggaacatgatttctggtacttccccagagacagaatttctttaaagaattctgggggagaggtaagggcatttctgagtaaatgtaaagcaagccagcccttggaatggtcaagatctcagccctctttcacacattaaagaggctgacaaacatttatctggctgtctgtgagctgtattatgactgaggtttgtagctcttcaaacctcctagagatgtaaacagtaacccactccaaggaagagagcaacagaactgtgttgaaacttgctggaagggagtttccccctgccaacaccctaacatggttgcctttgtgactgccaaagcctgcctacacattttcatcacttgagaggaagcttctgcttctctgttaatgtgctgtagctatgttccaaaaggaagacacattgatttttcagacagctctcaattatacacatgaatgggggaggtatcaatgacatagaagatggaaaaatcatttaccccacaccttgatccatgtggcacaaagcacagtcctacttgggaactaatgagtagtggtaacttcctttagcagtgctttggctctgatgagagcagggcctccattctggacaaggttagctttaacccttgaagggctacacacaccaccatgttgtgaaaaggatataaaattatgtctgcatcgttttatttgcaaaaaaaaaaaaggtggggggatcaatatatttttcttggtctttcatggcttctgtgcactgctaggattttgcctctactctacagggctgatgagaaatcaatacccttcatgtcttcaggagacccccttagcaaggttgggatctctaagaatccttacaacttttacaaattctttgtgattgaacacactctgtcacagcaagaacactagctggttcggccttctctatttgatgttttgcattttgagtcttattttttctttttaattcttgtttttaaaaatcacacaaatgatttcaacttttctataggtttaaatttttcaagttaaaaagtttggggaaaatgacacaatacaaattagttgtaaacattttgacatatatagtagaaagttaagaatccctatatacctcctaattctactctgctccccagagataaaccacagttaatagtttgctatgcatccttccaggttaatttctttgcatttacaaacatacatacatgtataattttgggggtctttttttaaaacataaattgggatcatgttatattaatgtaacataatggcttttaaaacataaaaatatatcctggacaaccttctctaaataggtccacatcattgtttatcaatagctgcatggtattccatagtatagatgtactaagtttatttaaccattctcctagtgatgactgtttatgttgtttctaatttgtgtttttctacagaacccaactctcccagcactgaactgttctgttgaaaatacccatccaacagtttcttactatgctcatccccaagtggcatcctacaatacctactaccatagccctcctcacctgccaccatattctgcttatgactttcaggtatgttttgggagaaaaaagaactctgtattacccttgttctcactcatgctctcttgttctctccctaaattcaattatggaacctttccattgtctgcatatgtatgaggtagccatgcatctccctaatggccagcagcctgtggttgccagcttaaggactatgtaggcaggcaacgatggcagagatgggcgggtggaagctgcgcaagagaagaaacagagagatggaagaaaaagggagagagggaggtaggatcaaggtatcccaaattgccttaaactacaccaaggagaagataagctagttgggaaatggcagctcattagtacactaccatggacccctgtgcaacagtggctttttccattcccctgatatggggagaggcctaatcctgctccttaacacaagggcattctgagccacacaagggtttgaatcaaacctgtaatgaggaagaagtcccattctttttctccaggcctcctaactaggactacacagagcaatacacagagtatttttataacacccctcccccttttgccctgttatcacgtaagtcagaaatagtgttaacaaatttgcactttccccttttccttttgaactgtgactactagtagaaaaccagacccaaaaaaggcacttacttaaaaggaattcattgcatgcagaacactgaactagacactttgggcaaacaagtgaaatggtcctttaggtatgtataacgattataaacccttgaccatagaagagcaaggttacactaaaatctagttaattcaaactttagagaccaaaggaaataccttttaaggaagggaaactcataataaatttgcttctattgatcaagagaccatgaatgttccatggggacataaaagtacaactatctgggggtacttccaactaaccagccagtttggcaatacaaagcccttgggcaacctaatttcaacttcagtttggcaaaataactgaaacttaaaaatctgattaagttgaataaagtgttgttgtggttggtttagataccgttcagagaggtctgtggctccataatgcaataataatacatatagtgtgcacatgtacttgttcacttttataaaatatagtactagttcaaaaaggtatccattaacccattgatgccagaggttgcaaatttttttgtgaaaaatcagaccttggcgatgaccttgagcaggaggatataaataactcccacaagcttagcgttccaataatgggacactaggcataaatgggttaaagcttagaaaatataatgataaaattcgttctaaagcctactgtgtacacaggtagacaactcaggtaacttgttacccaaataggtggtatagactggaaaacaaaaatatgttcaagaagggcatagataatttcaatagtgaccgaggcaacaaggaattcttcaagagaatgcagggatgttgaagctaaaacaaggaaggtcatcattctcttggggtccctataataaaaagtcatccttaaatagaggagccacacatgggtctagcccaagaggcctcctctacttttatatcaaagtaaattacattgatttcaggaatttgcactttataatgaaccctttaagtagggacaataatacatctggtgatggttaccacaaattataagataggaaacctctcttttgggtatggagccatcattcctcattcaaatcctaccccagaaatgaaagcaagattgagaatgccaacggtgacttggattgttggtttcagttcaatcaatgtttactctgtgttccatgtgccacgcattgagccaggagctgtggaaatagaaattaaatgagacagtccctgcgttagtctagggacttgggggtggggggtcaggggacagtagtggggacaaaaaagtaaagaaaacattacccagaatgctatggaaacagcatacctaacccagaaaagggatccagatttagctacctagtccaaacctatactatgggcttgtagcagagactttggggattgttagaagcctctcctttttttttttttttgagacagagtcttgccctgtcgctcaggctggagtgcaatggcacaatcttggctcactgcaacctccacctcctggggtcaagcgattctcctgcctcagcctcccgagtagctgggattacaggtgcgtgccaccatgcccggctatttttttttttttttttgtatcttttgtagagacagggtttcaccatgttggccaggctggtctcaaactcctgacctcgtgattcacccgcctcggcctcccaaagtgctgggattacaggcatgagccaccgtgcctggcccacccttactttttaataacagctactattcactgagtacttactatgtactaagcattgtgctaagtgctttacatatatcatcattcaatcatttacctctttaagagaagtactcttgcaattgccatttttaagataagatgactgaatcatggagagattaagtgacttcaccaaagtcacagaggtggtaagtgaaagagtaaggatttatatctagggctgactgattccagagattgggttgggggatttttgaagttgtgaatctaagcggagcacagctctttccccagttaattttgggatatttatactttctactggatatttatactttctactggactcatggtcctcagaaagggtctctttactcttgatccccactgaaaaaggattcccttccttcatgcattcctcagaggggaattcaggggctgcttggacactttttatatgtctcccacttctttccctaggctcaagatgtctttagtatttcctgtttgaagactttataattgtatagcctaagtcttgagggggtaagattttaagtgatttctctctagaacttaaatggtttcattttagtattttagtttagctttcttttgctcaccaagtttcattcccttatagtttcataggcgaaaataccattctttacacaagaaagtcagccaggcgcggtggctcacgcctgtaatcccagcattttgggaggccaaggcgggcgatcacctgaggtcgggagttcgagaccagcctgaccaacacggagaaaccccatctctactaaaaatacaaaattagctaggcatggtggtgcatgcctgtaatcacagctactcaggaggctgaggcaggagaatcacttgaacccaggaggtggaggttgtggtgagccgagatcacgccattgcactccagcctgggcaacaagagagaagcgctgtataaaaaaaaaaaaaaaaggaaagtcaagagggcaggaaacgtctgcttatattcccagataaataaaaaggagtcagcaaatgcactccagatctgacaataaaaccacctgaagcacagacccacccccaaaaggccagagctccctcatgctcttctgattgtaaaatgacctaagttacagccagaaaatggacctttctagactttcttctgaatgacttcccattttggttatttccaagtaggactatttctgtgactttgggtttggtgatttcaacttccttttgaccctgaggctaataggaggatgaggaaaaaagacttataatgttttgttttaacccctcaaagtcatacccttattgggtagctgtccagtgaggaagcttgggaaacacttcttgtggtcagacatgagcaaggatttgggtctgatcagctggccctgaggaagttttgagtgctgagcttagagaaactggattctttcaaacactgggctccagggtgtccttgcttctcaggaactcctcatactccaaagcaggaaggatataagctgagactacctttgcctcctcgctcatctgtccaacactcatttctcttgtcctttgcactatttccccaccaccccttcagctttagccaagtagtccaaaatctgtagggtacaaagcatcagttttcacttctgctgggaaattaaacccagctatttataaacccctcaaggttcccagcaatatttcccagtctggcatactgggccagtacccctactttactctaaccatggaatggtccctttcctatccatttggtgaccagccaagtttaagcttaaaacgaaagtctcaacctatgcaattcaaaagtgcctctatttttcctctttatttaatcacgagggtacactaggtttcaccctagccactaaaagttactcattataaattgggcccatttattaaaaggattgctttgatcctaggagggtacagtttatggcacaggttgctgagagccttagaaggctgttgttgctatcactcaactttttcttccccccgccacccgcccgccaccccgctgtcaagtctttcctttcgtcccctcctttcccttgttcctgactcatccttttttttttcctctttcttttacccactcttctctccatctccctagcctttgcttccaggggcagaacagagagggaatgcacaataccgacagatgctgggattttacccttgggacacagtgtctttaactagtaattatcaccagccagttcctgggctctttgtgaagtcactgtcccacaaggctcctggagagaagcatgccctgacggaaatgcgcattgatcttgaagggtgtgggtcagccatcaggcaggcaggaggcaggctaaggtggaagaggaaagccatctgtgtccctgaaagggtggtgctcctcttcaagcaccatcagcctgttggccaccccagcctctaagaagccgctcaggaagctggagctgactaggcccagcagtaggctatttagatgctcttcgtgcttggtggtgcacaaggattcaaagttctgttctcctgagctgcccacagcattattaaagtcacactctcaggcaggaaccagaatacaccaggccaactccctggctgcgacaaagccagatctttcccaaggtgcctgcctgttgctaggaaactatgcactggtactatgggccttttcccccgctaaaccccaagggtgtgtggactgcagccagttagctccctagctctgccaggaacccttcagctttatccttaagactcccagcatcctcaaagggaagtgagaatcatgaccccctccccccatacttctcaaacacaaaactaagaagtgaaaacccaagggccgttgtaccacccccttttattatcaaagtgtacaactgccacccacagcagctgctgcccacagaagccttttaatgcctctcaggacagaactgcctttagcttcacttcaggaaacttgcctctcccttctgtggctgggaacacctaaaactggcctgctgcctctcatgtcatctctgtagtgggatttagagaggcagtgagtgccatatgcccaggcacagagattctttgccctggtgggtctttgttcccctctctggttaagaggagagagttcttagttgaggaaagcaacagaacaggagggagggagaggaggaggaagggagagtttgaagggtgcaagatggaaaatcaggaaatcactataccgatgtttttaacaaagggtatcttcttggagggaggaggaaaattgagtttttaagaaggaatctagattgtcttgagtccactgcctcaggttgttttgcctttaagggctctccaggttctacgaccctgccatttctttggagtgaaataatggatgggatttgggaggcaggggatgatggcagctagcatctcttctcagtcttaacattatgtggtaaggaagatttttctgtgtctcaagcaaggcttagaaatctggacataggttttatttatttatttatttattttcgagacggagtctcactctgtcacccaagctggagtgcagtggcgtgatctgagctcactggaacctctgcctcccaggttcaagcgattctcgtgactcagcctcctgagtagccgggattacgggcacccaccaccactcccagctaatttttgtatttttagtagagatggggtttcgccatgttggccaggctggtctcaaactcctgacctcaggtgctccacccacctcagcctcctacagtgctgggattacaggcgttagccaccgcgcccggcctagattttattttttaaaagcatgccaagttcatctactatgctcctgaagttgtattcactcattcaagatttattgagcacctattacttggcaagtactgttctgagctctggaggatacagcaacaaacacaacaggccacctctccttcagcagggaaatcactagagtcaaggatatacgtgggccagggagagaaaggggcaaatgactcctgccaattcactgcatattttaaaaaattcatttccattcctttcccaaagtaagacaacacaaagtaaaactgaatactcagtgtctctgcaacctgacatattgctcctcattctcacctccatgcctttgttactctttgctctccaacctactctgcacttggggatgagggggcagcagttaaggtggagtagaaaatgttggacttggagtcagaagactccagatccgagcaagctatttcacctctctgaccttagtttcttgtctatgagaggggctcctgaccactgtactacctctctgtgatatactcttttagcaaagactttcccagggatcactggcttaatatcattaaatgttctcaaagccaaaaattaccttttgaagactagttgggacattgttgccatagcttaagggagaggtattggaggcttgagttataaatgtaaaaaaggtagtgatggattcaagagacaacacagaagtagaagcaacaggatttggcaattgattggatgtgggctgcaaggggttgcagaggaggattccctatttctgcaggtggcttgtagcctgagtgactgagagaaccacctgttccaggctcattaactctgtgaggtttgggagctctctgttcttccaaatagaaaaaaagctttggcccatattcatttttaaatagtaatgactgttcagggaattgcaaactcactgcctaaactaacgttttctttttatcacacagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtt

SEQ ID NO: 4979 - DNA, 52885 bp, human
aatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggtaagtctagcggcccttccttcgggcggcggcagcaggggttgagtgccctggcctctggactgtgaacgccccagctgccccaaaagccggagagcgggaaacggggcatggatggggtggtcttcgcgccccagcgtctgggtggtggaccagagtcccaggggagcggcctggctgcagcgggagcgacgtgcggagatcggagcgccaagcttgcgtcggagtatctctgccccggagtgcgggtgtgtgcctgtttgtgtgcgtgtgtctacagacttgcagtcggtggtaaatcccagcaatctgaggatcaaaacacttccctgcaacctgcgccttcgctttccattcgacactccctctttgcaaagtcctggtcacttctaagagctcacgactaacgacaattagaagcagggtcctcgccccctcccaactctcttgaagctgccctgaaatttagagatgcagttgggtgggggcctgacttgcacctcgctgattggggggggggggcgggttgcgcaactctgggggatgggcgggggtgagaagaaagggggggatgaggggaggggaattcctgaggaatcactcaagacagcccagccctgccctctgcagcggcgggatcaacattctttgaatttgattgttactctgctccaaatgcacggaatgtgcatgagtgtgaaaagggagtcaggggcaggagtgagagcgcgagaaagaaacatccagcgcgagcccgcgcatcttctgaagtcgcgcttttcctcgcagggcggaatggagggggaggggcacccttcgactcctttccttatagaaactgggggacagctaccttcgggcaccaacttggctgcccctcgaagctgctttttggtagttacaaaaaaaaacaaacccagtccccctcagctgttaggcaccttcccaagccctgtgatttcactgggcggagaaattaatttggagccctggagagcgggaggggattgtaaaatcatgatcccacctaatcttttaaaattcgcctcggatacacttcaatcaaatcgaattctctctttccaacatactttacattctgcaaaatccctctgtcccgcagttcctgccatcagtctgctcaggtcttctccgatgaatttgcgggaacatctcgagtggagggggcagggagaagatcgaaccccctatataatctccctactgcccgcagaagactcagtgtcaacaaaactcgttcaccggaggggccccagaaagtgttatctcctggatggtggaaagatccgtatcctcaatggttttgcatattcagtataagaatttgctttttcatttttaagggcgtagttatttacaacggggtacaaatgaggccaaggacttggtccgaatcccgagcccagcagtaccagactcccccttactcccagctcgcgcgcgcgcactctttctccaacacacacaccacgcgcacacacatacagagggagagggagagagagagagcgcgagagcgagagagagcgacagcgagagcgagagagagagagacagagaggtgggaatgcactgcttaccttggccagctgtggcgccaacaacgcagccctggctccccgacgccaagctgttgcgcttcgcgagggagggcagagtggaagagtgctggggttccgcagcgtccattcccgctgcggacgacaaccacctaaccacctgcaaatcaagccacagcgccccgggcccgtctgccttcggggagtgggctggttggtggcccagggcttaaagagtcgctacttggcgcactgctctgtgggttggggaacaagatgaagagctttctttcttgggctcccaggggccctcagcgatcttgtgtttctcgaaaggtctgcgcaacaaacagctgagtgggcttcgcccagcccagtctccacactgcgggaaaggaatcataaatcccagatagaagcggagccggcgccacgcattccactttttgaagtccgcagaccgacggcactggcaaattcctgagtccagtgctaacgctgggtttccacagtttggacaggggagtctccccggagttccctggccctggtcccgcacagtccgggcctgaatcagcgtctaggctacttaggagctactcccacttagctctggcaacaccaccttcccttgcgtggggggaagaggacagtgggtaggtaggttagtgtttcagcctccaagggcagcatttctgaggggactccctttattgtcaagacacaaccgcaaccaaaacaataaaatttaaaacacgcagacacactgcaccaaggtgcctgcactctacgcttgctggctgcctgggaatagagcagtgcgtccaaggctcagagtggagcaggcgctttgcaattaagaagatggtaatttgactccagtgtccccccatcccctcccagcaacccccttctcccttttggcaacaccgcccccaggcgcaaaggcacctctactacagtagggcattccttcctcccaaataacacatttgtaattcgcgggcggcctcggatgttctccattcagagaactgtctaaagtggggagggatggatttcagcgcctttaaggaaatgtttgggagattggcagggtcttgaggcccttgtgtgggcagccacttgtttctagggatactcaaggctgggatatccggggacccaccctgtgtggcaaagctgactcaggtaagcaaatcctaatcggttcaaaagatcaacccagagaactagccaggcatcaacaacaccgtgtacaggacaggatactgggttcccaacttttctgtgcccaataaagattatacaccttatctactctcttgggagaggataatcaagaacgtgtgcaaggtaaaacaaagtaacagagacagcatcctaccttctagcaactcacatcttggttccctcagatacacaatcctgggactggcagatatcatatgggttgtggaccagacccacggttacaattgtaatggtaccagttacaattaatatacttattgagtaaggtacctgggaatttagggacatgaataagtgattaattttgatcaagaaaaactttttggaggaggggaattttgagcatgtttcaaaggaagggaggcacccaggttcaaagaccgcaatgcagatgggggctctgaccagggggaatacccggatgagagaaaagctggttgtttttggaagggtggagatagcaaataattgggtgcttctagagctaagcatcctggtcatcaggaatctggggtggaggtggggcactgcagagagggagggctgcagtagttctgcagggaggctgctgaggaggggcaggcaaggccaatgaaaagatttcagactctctcactgctgttggttgcagaggtggttgttgtttaagcagaaatatactgggtgccaaggagacagagtagtgagagatattgtagttttcacactagttagccagaaggcttttaatttgagggaaccctcaggtgtaccctacattaaaaaatcaattctatgagactagcccatatttattcacacaattcctcccacatccttcttgattaaaagggaaacaattctgagatgttgcctcttgtttattcaacaagtaccgattgtttattaggtatcaaacactaggtataaatcgtaataggcatgattttcatatacctgctgctttatttaagtacctcctggtgcctgagtttttttacgtgtcactttactaaacaaaatcagaataagatggtcctgtgtttacagaaacatctaaggcaagccccaaattgtaccagaataagaacacggctgtacttctcccttctaaaataaaacaaccaccaggaaaatgtcctaagcagacacaataaactgccttttaggagcctgggccacaccttcagaaaatgggtatatcttgctctaagtagatgtgaattttattgagtcgaattgacactaaagataaattgaggggtgattcttcattttcaaaacgagtcaccctgggagggggttttcttaaaacagtcaattccccaagtgcaactagaaataatttcatgttacacaattatggtccttataaaataagtggtgacagggaaggacgctcgtgaggggacagagattagatattcgacctggtgatcagagagttttcttaggaattttatccaaagcaaatcctatctggagtcaaggcccctgtggggctgtgggatatttgcctgggttgctcaagtgactgaattttcaattcaggttctaaagcaggaaaaaagattttcaaatgacactatgtggtttgctgagtcacttttctgacctggctcttcctgcgcttttaaaagttagagtgatatttgcaaagaagacccaagagctgtgaataagattaaaggccagctggtggggaaggagcaggcaaatgaaacaaacaaacaaacaaaccaaaattaaaaagaccatgcatgcacacacacttctccaatttagtctgtcaggttacatgttttctgggtaaggtgttgagacacttccatatcacaaagatatccgtggtgtatccaaatgttctctcactctcttttgccagtttggggcaggggagggctagagattgtgtgagtgacaaaagagaagggaagacaagaatgggaggcaatgttggtaagtttatgttagagcccctctgtagaaccaactcacagattcactgagaagtatctatcatcaaataaacttaggcaccctggtttagagactaatttagggtccctcaaaatcaagaggaaggataactaaacttcaggtaaccagaagaaataaatcctggccttcccccaaccctctactattcctttcccagtaccatgcagtccagagctcccggctttgctcctgtgtttaccattagtcagctcccatttgcatccctaatagccctgtcatgaaagggccccgatgttacaggtgtctctagtgggcctttatgtttttgtcccatggaggctggactcaggtctctttaaagatgagtctcatttgccaactcttcttacctcttccccagggtgagacatggtgctttagcattgtagatgcctataaacgttcaaaccacttctacatttcaacgaaaaatagtcttagattagtcccatattagaaatgaccctgatgagtcacatccctcattttcgaagctgacgtcaggggagaccgcctgcccctcccacctcccttggagacttcagcagggacagtactggggaagacaggatggatggtggggttaagcccgggtgatactcccagtgcttttcttccatacaggaggggatatctgcagtggactgcaaggccagccacaacccctcccgtctcaccaccaccttgcctcctgggtctcgcttcgtttccttgacctcgtcccccttcctccatcccctctcccctccctctatcccctctcccctccctccccatggagcagtctgcatggcttctctcaacaactgcttcctgaggctgcagtgaggtctcccagaatgacagggtcttatggacagactcaagtgatctctttagggccataaatgacagtcaagccacgtgggtgggcgactccatcagggctcctcactgcttcatcctcctcatgctccaaacctccactagagagctagactcttctcatttgcttatttttttttttttgagaactcctaggtagtaactctcccctggttatttcctgttgaaggccctctccctatgcctgagaaatccctgcagagtgtgagacagtgctcggttcctttaaaaaaaaataaattaaaaagtgagcctagataccatttttctgtctgacttaataatcctgttttcaaaaaaatattggtttgcactatcatgtctgataagccctgagtgggagaatgggtttctcatcatttatgtttatgtcaccctcacataagcctaaatgtgtataagttataatcctccccacctaactcccccgatacatatctttgtggactaatggcctccaaacactcactttattacacacatttgttatgtgacaaatcttgccaatacaccattttaaagtttatacatgaggtggcaaatgtcagaaataaatgaaaaaaaaatcccagtaacttggcttggctgtgatatttacactgaaaatgaaatttcatatctctagcttatgaaaaaaatctttttagttggatattggctttaaaatgttttcatttaataccccctcccccacacacacacttcccatttatcatatgccttctaatttggtctaaaaaaccactctactaagtagttgtgacacatctcttacagagtgccaggagcacaaaaattcgttttgtttttacgtaactggtgaaatttcttctgttgtttattttcaaattggaaatacatattttattataaaagtggcacctgatgactacaaaaaataatgctctatcccttccccacaaccccccacccgtcaccaccaaagataacttcagttaccggtaggaataggaaaggaaaaccttcttagtgtttttttctttaagtcaatcctttccccagctgaaatgagcaattttaatttctctctgtgctttcaggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattgtaagtatagaaggcacaggtaggtcgcagtagcttgctgtctacagaaattctggctctgctctgatagttttcaattctgtttgagtgtctagtgtttgctcagatttcctcctttgtatctctgtatatttatgtggagaggcaactctgggcccgctaagaagagcactggactgagaatcagaagaatccagcaccatccctatctaacagtgtgatcctgagcaagtcatctcactctttaatacctcaggtttctggtttaggagatgttaccagcagtgttaaccttaggctaaggtcctttctctccgggcatctgcattcccatatataatagaggtcatctgatctcacctgaaatctgaggatcctggcagcttgacactctgaccaacagcactgatctccaaagtgatcctgcactcctatcagaaaaagctgtggaagatatgttcctaaaatatgtatatttattcacttataaattatatatatacatgttcataaaacttatataaaaatgaacattcaaaaattagataaaaataagtatacaataacttttaatatcttcatgtgaacacaaactaaaatgtcaccagataatatgcacttagtgtgaagcttgtcattaaagacagtggctttaaatccttatttcaaatggcccactagataattgtgaatatttttggctgccttcttatcccatatgattagactgtcattggagtcatgtttttaaatgtcaatatcacaatttggctgccaaaaatctaccctgggagttagaagtattaaactctgccattttcttgttgcttacgtttgcttacattattagggtcatcttcaacttctggtttctcaagaggaatcttttcaagcctcttatccattttgttgagactagtttcgttaaaattggataatacaatccaggcacacataaaatgccccaccatcaaccgtttgttgcttggaacttgccctcctccagaaggatagttcacctgatcacctgacattcacacggacagagggtgccagtgacagtctgtttattaaatattagtaatgtttggtttcttattattttagataaacaataaataggaaacagccgtattccagtggattgttttatctaccctagggtgcatgcagttccctttggagactgctaaactagttgcattagaaaaaccaaaacctaatttgagtctacgtacactgctgttgaacccaaaaacctaactctagaggtgagatcatattttaaacaccaattaaatggctcctcaattgttagagagcagaaggacctttaggacaattcagttaagaaatattttagtacagcaaagaggtcagatgtattttttgttgttgttttgtttcatttctctttgaaatgaaatgagagagagagagagaggtggggattggagagagaagcaaagcgagaggggagattaaagatgatgccttggacaagccagagctataagtgaccaagcctggagcctgttgcctaggtcactgatttcattccacagtcagcctcctcaatagctcttgagaagctgggacctaaagtgggctgcaggctatgccttcctggagctgaaggctgctgggggaagtgcctccacagctccagggcaggcagggctcctcccagctgagggcaggtgacccacagacactgtttggtgccctgtgttaaacatgtgatgtgagaactcacccagtgcacttcctgtggtgaggcaagaaaaccagtcgtcagcagaattgggttttatttttaaacacaagcaaagccggtggggggtcggggggtgggtgtgcagggaggaacagagggggtaagatagcatttcggtggcttggaaaagcaatttatagggtctgcttgactttgtgtatttcaggtagctgcattagtaaaatatttctgactgatgagcaaatgctgaagccaagatttagagtctctgtgggtgaggggaaggtattttccatgttatttaagagtatgaactcctattcataaacagtggctgtgaaccttctctgtggaatatcttactgtgggtggctaggttggaatacgttaacaaaggaaggagggtgcctgattgctgttattcaagtacctgatgttcagctagcactagaagttgaagcagtgggggcgtgtgtttgcgtgtgagtggttcactaagagctaatatggaagtgttaataggaaagccatccctaacggacactgtgcccccatgatttaacctttaaaaatgtgctctcatagttcctggagattgcttctttaaaatgcattttaattacataaaataaaggggaaaagacagcagattgaatagcagaaaaatccatttgagtttataggtcagatcacgttgtaacaaatacaattacgactcatacctcagaaacagtaaacgcctgagaatccagatttgtctgggaatggggtactttcattaactgaatagcttggttattagggagttactatagaaactccaaaccagtggtttccccactctgatgtgaataagaatgaccttgtgaacctgcaaaaaatgcagatctctactccctagcccaagagattctgattcagttggtctgcatgggccctggcaatctgaattttcttttcataaactaacctttgattgaaaaagtaataaatgttgaatccacctgaggggaaagaatccgtggggggtggggggagtctaattcaggtggactagcaaccacctggagaattaacacacagtaaaatatgcttagcaataaaaccagaaggatcataatgtgtcatctggagattctgcactgtcaaagtggtcactttaaatataaattactaatgtatagaactgtgaaaaagtttcagcttatttagaactctgctgttttagactctgattaaatgtgttaacaatccatgagaatttaaattttcaaaacagacaaattagggagaagttattagattaaaagaagacttaccatacaaatcatttaaatattgtgatctcaggtacttaaaatataactcaatttgcataattctaagtcacgtgaagctttttgggagcatctttattttgccaaatgagatatctttgtacagtgaggtgcattatcatggcatgttagctactctacctgagctagcatgtggtatcatcgttctaagagacatacgcacacatgcctctgtaaagatgtgctagtctgtacagtctgaactgtaaagttttaaaaaaactaaaaccaggctgggcacggtggcacatgcttgtaatcacagcacttagggaggctgaggtgggaggatagcttgaggccaggagttcaagtccagcctgggcaacgtggtgagacgccatctctacaaaaagtatatatataaaaaattagccaagtatggtggtgcacgcctctggtcccagctactcgacaggatgaggtaagaggatctcttgagctcaggaggttaaggctgcagtgaaccatgatcactcaccccactgggctccagcctgggccacaaagcaagactgtctcaaataaataaataaataaaatttaaaaactaaaaacggccaggtgcggtggctcacacttgtaatcccagcattttgagaggctgaagcaggcggatcacttgagcccaggagtttgagaccagcctagacaacatgacaaagccccatctctacaaaaaaaaaaaaaaaaaaaaattagcctggccctgtggcatgagcctgtagtcccagttacgtgggaggctaaggtggaaggatcgcttgagcctaggagatggaagttgcagtgagctgagatcgcgccacttcactccagcctgggtgacagatcgaggtcctgtctcaaaaaaacaaaacaaaacaaaacagaaacaaaaaccgaacaccaacaaacaaagacaaactggattaagaattttactgtcctcaaatattcaaggcattttatttcaggagggttcagatgagctttctactctgaaggcctaaaaacccaagagcttcatttgttgcctgaagctgaaagagacaggggagggtgattgctgcttcccggtacacctcctcttaccttagatgcaggaaaaagaggcctctaaatgtgtttcccaagcaacccacaagatggagttggtcccctggatagtgagacaagcctttcattcttgcaccctctcctcagctgctatattgatactattagggcgcatactagcctgagtcttctttcaggaaagagagcaagaatttctgccccctttcccagggagtgggtaggagagtcagttaattgaaaatcatttcagagttactgtgggatattaggagatggggacaacagggatcattcaaaacaatcaagatcccagaaaccttctttaggtcagtgtggcctcagattcacatgtaaagactccttggaaaagtccaaagaaattttgattaacatgaatgctcagaaaacataaggagctctggatagtgggattttgtagtaaatagtgaattaggcagaaagattttcaacaggaggtgaaaaagtttctacctcttgtttgaaaatgtttctaaaatctaagttcattctaaaatataagtccctcacttactaagtacatttttaaaatggcacctgggctgggtacagtggctcatgcctgtaatcccatcactttgggaggccgaggcaggaagatcatttgaggccaggcattcgagaccagtctgggcaacaaagtgagacccccatctctataagaaattttaaaattagccaggtgtggtggtgcacacctgtagtcccagctacttaggaggctgaggcaagggggttccttgagcccaggaggtcgaggccggctgcaatgagctaggatctcaccactgctctccagcctgggcaacatagcaaaactttgtctctataaaaaaattaagaattagctaggtacagtggctcaggcctgtagtcccagctactcaggaagcttaggcaggaggattgcctgagcccaggagttcgaggctagagtgagccttgtttgcaccactgaattccagactgggtgacagagtgagatcctgtctctaaataaataaatacatttgaatcttgatttgctggataagacttttataataccacaaggttctcaccttcattggctccctgttgcttccttggcatgtcattcagagctctccatagatgccctcagcctagtctctcattacttctcttttgcaaaaattgccaattcacagtcctctgaacacgacttgggcttttctgccttggggccgtcataacattttttcctcatgcctagaatatcctccctgatctctctctctctctctctctctctctctaggtgctctgttctatcccaacttaaaaacacagcagaaacatgtctcaaatactgaggtccacagtggtgtctacatctttgaactccctactgtagattcctcctattcatggttgctggaaaacacttgtgtcctgctttgtggcatctgttgggctatattctcatttagctttgtttatataggccctcaatcccttctctgaacccttgggtcagatgggattcagaatttagacttcttattttagaaaaattatacaatacatataccacatattatctaacaaccaagtagagccttgagaagcatcccataatcaagcacctcatgtttctataataaaacatggatttttaaactaagtgagataaagatgataatataacctcacatcagttcaagatcaggttttgccaccaagttagttacattcaagaaaaaaaaacacttttttattttaagaactttgtggatttcaggattatggaaagggattgtggactggtttacctaattgtagtatgagctcctttagcctgagtggtcttgatcataccccatcccacctcctggcctccaaattacagatcgaacacactgccagccagagtagatgtccaattaatatttacctaatgactaatttttttagcctttgtcctagatgtctgggacagtgaatgggaacaggcataggtgacaagagtccagcctcaaaaaagcccttgaatctgactttgatatctaatcatctgtcttttttttttttccacaagtggaggacagccaaaacaaagcaaactagttatttgttcaggtaatggggaatcaagatggaggtccaaaggtctgaacattacatgattccatgaagctcttgaggggagaccacagagcttacctttctgaggtctcaggggagcaagcaattgtttagaagcagctgtccattttaaggaaactgttggttttcccttctttattttcaacccctcagctcttccgcaaataagacttctcactccatccttgcagagaacttcttctctagggggcaacaatgaagtccttgttgcttggaggtcacaattctactagcactggtcacaaatgcagcgaggtgtggctaaaagaactcaagctgttattcaggggacccgagagctagtcccagacctaccattaacttgctataagagggcatacatctttacaattatctatgccttcattttcctgtctatcaaatgggaatgatatgaattccaccaaactccatagtattcctgtgaccaaagtagggggcaagtgcttctttaacttaaaatgcttttgaaatggaagattgttttagcaacactggtgagttcattaacctgtcatccaggtaagtgaattcttccagccatgactcaatacgtattagttccctgcctgctgagctctaatccatcttttgagcgcatacaaaaatgtctcctcctctatgaaaccttagcactaccatttatttagcagcctaccttatgcaaatcacactacatacttcatctcatataatcctcaaagcaaccctgtatggcaggctctattatgattcccattttatagatgatgaaaccaaagcacagagtggttaaggaattgggccaagggcacagagtttataagtagcagagccaggaatatattatattatatataatatatatattataatataatataatatatataatattatatattataatataatataatatatataatattatatatattataatataatataatatatataatattatatatattatattatatattatatattatatatatataatatatataatattatatattatatataatatatatataatatatataatattatatattatatataatatatatataatattatatatataatattatatataatatatatataatattatatatatcatatataatatatatgatatataatatattatatattatatatgatatatattatatatcatatatattatatatgatatatattatatatcatatatattatatatgatatataatatatttaatatatataatatataatataatataatataatatatttaatatatattaaatttatttacctaaatatatttaatatatatattaaatataatatatattatattataatatatattatattataatataatatatatatattatattcctggctgcgtgaattattccctgctcctatagcactttgtttttacctggtctgtggtccttaacccagtctgtctctcccttactagaccgtgagctcttggaggacagtagccatgtcttcttattcatctgacataaagctagtagtgaacgtcagaaaactgaatgcattggagtggaatagaatagaatagaatagaatagaatagaatagaatagaatagaatagaatagaggagaaggggagataactggatgaagtaactggctggcctgggatttccagttctggagtgccttgtctttccagacaattccacaagacttccacccacctcttctggtcactgccatcagagagttatttgccatgagagaatatgaggaatagagagtgtctttgcttcctgtcttaggacaaagactgctatcacgattcaggagacattctgcgaatacctttggaagctgatgaattgttaagtaaaaggacttatttttcccgtaagaagctgcctccaaatttctctcaactcaacaagtggcccagagtgccaaaaggagagactattcatggattttctcctaaaaaatagaagccgtggaacatcagagggggagacaagatggaacaaggaaattctcttagcacaaaatagagcacataattataagattttccagctcaagtcaggttagagtggctcaaaagttaaatggctgtaaaaataataataatcactagaaaaaagtaatatttactgagtacttactgtgtaccaggtgctgtgcaaagttctttgaatgtattatcctggttaattctcacaaaagccctataaggtagtcactactgtggttcctatttttacaatataagaaaattgaggtttagagagcttaaccagtttgttcaaggttacacagacatagaagagctggggttggaagccaggctagtgtgataactaagttttaatcagtatattttatggcaacatattttaattatatctgaaataagaccaggtgggagacaggcattgcttgactgttgaatgaggatgttctcagtagagtcttggatattaccctcatgcactgcagcatctgtttcccaagagacattgctgtctgagtggccctgcacaaggagtcctggagatttacattcattccttccattcattctctcattcttggggtctgagacagccacccagtccccctacactgccctaccaagctcctgcccagcccttgggtctcttagattcccaaacctaggtgcaaggcttgggggtctcaaattgaaatagatgtccctgtgagccaaagtaaggctgcagatggaaacccagaccattagtgaggctaaagagaaaagtaacttcatcactgaacttgtgttaagatttattggtccgttctcaccactttttacttcttccactttcatccccatcaacagctatcagttagtgatcattttcatctaagactggcagactcagtcttctaatggcagagctgagagggcagtgagatctgttataccaagccataatctcagccacttagacaggaaaattgtttttagggttttacactgccatttctgttcaccctttaatgaatgctttctgtccataaatgaagcagggatggaagaaggggtgaataagtgctaacataaattgcagtgggtcaaccacaaatacaggctttcaaaaaaaaagatttttaaaaaaattttttagtgtgggttaaggtgcttcctgatttctaaagtacttcctgagttggattggtatgccagatgcatcaaaattgcttttgcaaacctttattttgtgatctatacatcaaagtggaaggtctttttcaaaaaaaagataaaaataaaaatataatgtgtgcttttcatcattatatgtctcttactgactcaccagtcacatgctaggtaatagatattgcaattgaaataggcaggctctgaaagctatggttgacctttacttttagtttttgggcacataagtttcttcttaggtatgattcatagctacaagggaaaactggcaaatggtgggaaaaatacttttattgtacatgctgtatttgtgtaagtaacagctgcatgtggctttagcaccaatacctttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagttttttcttttatcctgaatcatatgaaggggctggaatgattgtgtggtcagcctgactgtcatcccacatactatgtatgccatattgctttgcagctcggctttggatcgttccttggaatcattggatcaaaccttattgagaacaaaaggcagatggtaagttttcatcccttatagagtcaagttcttcctctaaaaaagcacaacatttatgtggataagtaacacatttcttaagtttgtgtgatttggtcataaaaggaactgctactttgccgtttctcctaaacctctagggaatgtgttttactgtgaccctgtgatatgggattggttctcatcttgcttgatgctccctcactggcctagctagattccttatgccaaagggatagaatattctggatcttgccctttgctttcctccttactcccaaaggagtgctccaacctatccaatcaggctatggtcctcacctagaatgcttttgcttacatttctgttactacagccctggattattggtggccgtcacatctttctctctgatacataatcttttgggcaagttttcacagagagttcctgccttttaggagattacaatatagcagactttgatttaatgagcaagtgtacttgtggcacacacaaaaaaagataaaataaaattataaagccatcctaaagtatctccattacccatagttcaaagctaagcatgttgtaagattgaaaggaaggacaagcatataacagaaggtgaagcttctatgtcttaacaggggcccacaagggcaagctgttatactttcctggttcaatctgaaaaggctccctcaagggtaaaggtagaagatatagactgaattgcaagcatattgcagttttatagagttgtaaatcaagatgcctggtgagtggtcagatggtgattgggctccccctgtacagtctctgtggcactgaaactttgacaatggggtctatttcacagcaagtttaatcagataacgtaatagctccaaggacagagaactctaaccatatgttttcccccagcgatatggggaatcaccctcaagggagttctaatagtttttttcttccatttcacctgggctgcctccttgccagttgtgtttgcactttaggcttaaattattcaaaataatgggggaattttaattgtagagctgatcatagcatagctaataatgtcaatttcatgacattgttcatacattatttaccaattctctgtaacactataaagtgagaattatggggagaggtttctgaacaactcccaaaggagataagtatttcctcctagcctgttgaggtgggagaaccctagggtggccttgattttttttttttcgagatggagtcttgctctgtcgcccaggctggagtggagtggcaccatctcggctcactgcaacctctgtctcccgggttcaagccactctcctgcctcagcctcccgagtagctgggattacaggtgcatatcaccatgcctggctaattttttgtatttttagtagagatgaggttttaccatgttggccaggctggtcttgagctcctgacctcaagtgatccacccgccccagcctcccaaagtactgggattacaggcgtgatccactgcgccctgggtggccttgattttgattttctccttctccctggagagcagcttgatgccatgtgatctccccctcttttcttccaaaaacctcagggaaaaaaagtgctgattccatctagttctgagggtcaacacaggcaggcggtcagctcaggtagcatctatctctgcccctggaaaagccttgaaattcctattttcccccacatttggttgtagtagcatctttgtaatagtagacaaattattaggaaaatttctgttatctaacacaattagagaatagggtagcctggttctagcaaacatttgtcttacttgaaagtttttatatgtaccatactggctgtgcatagtggctcacacttgtaattccagcactttgggaggctgaggcaggaggattgctgttctcaggagtttgagaccactctaggcaacataggagacctgtctctaaaaaaatttaaaaattttaaaaatatgtatcatacaacgttgattcagagacttcaatcctttgtaaaatgtccttgacatgtaagtcttaagttgaatgtcctgtttcttcagtgttgcagaaggtcatgtaaagttttgcaggaccccggaatcatcattgccttcatcagtgcccactatagcatcaagtagcagtgtgagggggtaaaaagaacactggattaggagttggtgagcaccaggcttttccacagactagatggagaccctgggcacaccatttcccctcactgtgcctccatttctacataaataaaatagaggattgaactacctaatgtcaaaagtccaacattatttctgagtccaaggatggaagggccgtgcagtcaaattccttcatggacagcatgctagataccagcaagcctcctcttcatttggtgctcacagagtgaatttcttagctttccctgaaaatgtaaaaattgcttcagttgcccattctctgcctcccctgcctacctcccttccactcatcctgcatgaccaaaaagagcattcccatggggtggtaggctagagttctgctttggctggaagtctcttggggattgcctggtccccagaggcagcaagtgcgaaaggctaacagacgcttttgttttattcccccctacagctggtggcttctatcgtgtttatcagctttggtgtgattgcggctttttgttgtgccatagttgacggggtctttgctgccagacacattgtgagtattttttcgtcctgagttaaagtaaataggcaatacaacaaggccccactgaatgtgtgctcgatgttcagtcctttgcttagtgtcatgagggttacatgagagggagaagacacagtcccttttctcaaggagttggcagtcaaggtgaagacaccaatggacacgcggacatctagagaatgaggtctaagctgggggaacaaactccaagtgccatagtggcttatcttggattccagaggtcagagaaggcattcagtggtggtagggctggagctaggcctttgacacgtgggtaagatttgagaaggcaaaggatcaggggaattgcttagaactagtattgggggcaacggggtagagagagagcaccaagaagccacatgacttatggtcaatgccgtcacccaaatagtctatgaaatggcatctgaagaaacaattcctgggcaaggagaaaaacaaggaatgccagagaaaggccctttgcctgattttctttcaggaccaggaatataaatgtaggcccctctaccagatccatcccttctgattttagctgagatcagccatctttttcatcatctttttcttcttataaagcaaatgacacatcagtaactttaaacatccataattctaccaccctaacttgacaatttttattgtttttgcatattagctgctgagtatatacctatttttgtagcatagttgcagtcaatcatagtatgcatactattttgtattcaacagaagccatcttaataacaataattccttgttttgtgtagtgcatttagcttttcaatgtgacttcacatctattacctcatttgaaacccacagtaatcctgtgatatatatagggcaggcattattatccccatttgacaaacagtattcactctgaggcagtctccatggcaacataggcctagtggctaagaagcctgcagtagattttgatggcagcatgagctaaaatggcttccttttttcccctcttcccctcattcctaatgttgtttaatagctttattgagatataattcacatcccatacaattcacccatttaatgtgtataattcaatgatttttaatatatttagtatgtatcagttatttatgtgcaaccatcaccacagtcaattttagattttcatcatcttgaaaagaaatcccataccctttagctttcacctccacattcccacattctccccagacccaagcaaccactaatatactttctttgtgtaaggtatccctattctagacatttcatattaatagaataatataatatatatattctcttgtgattggtttctttcagttagtataatgttttcaagattcgttcatgttgtatcaagtacttcattccgttttatggactaataacattccgttgtatgggtataccacattttctttgtccgttcactagttggtgtacatttgagttgtttccactttttggttattatgaataattctactgtaaacatttatgtacaaatttatgcatggatatatgttttcattttcattttcattttctttctacctaagagtataactgctggatcatatagtaagtatgtttatttgtttgaggaactgccagagtattttccaaagtggctgcactattttacattcccaccagagtgtttgatgggtttgattttgctacatactcatcaactctcattattatctgactttttgattccagccatcctagtgggtatgaagcagtatctcattatggttttgatttgcattttcctgacattccaatgtttttgatcattggctccagtcaaaggcaatgggcaaaaattcaaattatatttactggaagtttcctctaatgaccactacttgcctctgagtccaggccctctgtacctcctgctgctggtgacctgcagtacagcatttgactcaagtatttgggggtacgactggatgaatatttaagaaaatctttctgcttatactatacctgccctaagacattggctagtcctcattgacacccagagagctttgaggaaggaggctttattaatctatgatggtatctgttggccaacttaaatgaaaggcacatttggaccctagcacagcttggatgggtgagagccagctgtcctattgttgaggccctttaacatcatctttccctgttcctttgacttgggtgaatctgaacttcctctcaagacctaccaccttctcactcacccttctctatgtgtcttgtgccatttctcttttgtctcatatttctttcctttcccctctccctagtatagccattaactagcttggaaaatcactttaccttcttgtaccatagttttcttttcttctaaatggatatagtagtaacctacctttcagggttagcatgaacgtgaaattaaataatgggaatggatatgccctaagagggcctggcatagagcagacactcaacataaaacaatttccttttctaccccttcatgccatagttggtagcccttcagattacagaggttgccaagccctggctgagtgaccttttcttgcctcccaattgccttgttcttgttactcttctgggcctcaatgaagagtatcagccagaggcagcaaatgggcaactatcacacgtctgtcttcatgtagggcacttggtgcctgaatgctttttgcaaaaccaggaggtgagaagggctgtgaccagcacattaagcctcctcttcagcaggataattatgataattattctgccactacccaaacaccaaacatggacaataagcccttccaggtgtgagcatgaacaccctcattcctttccagctagactccaagctaagctaacagggcaaggtactttcagaacattgagcaggcaggagtttcatgtagaagtagctagctgatggaaagtcctagaaccttaatggggaggccggctaaaaggcaggaggcatttgagtgccaagtacaaaagacgctaaatcacatgtgtggggaaaagcagccactgagatgatcgtaaatggtgaaagaagtgggggcagaagggaaggagacaatacataaattccctctgcctgggtacttctgccaaaccccaaggtcaatttgcataagttgtttgtcctgtcctaaggtgcctttggaagaagccccctaccactcaggggaggtttagcatcagtccggaaagtgaacagcagctcctgcctgcaagcttccaggcagccctggcttgtgtctattggttctaccccaacccccatgcatgagagctctctctcatcaggaagctggccaagccagcagagtaaatcgactgtccttgagccccatgttagttttctgagacttgaacagtgtttttggagttcactgattttatctaatctatgcagttgggtgaaaatggctcacagttcaattgagttaaaatctacagcagcctcaggagctgcccctcctcctgaggcttgcttcctgagctcttccttctgaaaatgatgcggaaatgacagcaagaggtacaagtcagccaaccatagtcctgtccccaggtgataatgaaacctcattgttggacttgagctctctctgcttgaaagtgtcatttcataataacctggagttttgcatcttgttccctgaggactgtttacaagaagacaaaggccagaagtaaaagaaaaccagagaggaaatttcaagaagcccatttctcaatcagtttcataatttctcattaaccaagtagtctaatagaaagtaatttttaaagtatttttgtctaatcttcactcagtctccctagacaggtgactttcagaaattaacccaatctactgcctgcctgcttctgtgtgtgtgtgtgtgtgtgtgtgtgtgtattcaaaccttttattaccaagtacaacacttgctgttttattttccaaagtcaaaacccctttgttttggtgtttcccttttcaggatctgaaaccactctacgctaaccggtgccattatgttcccaagacatcacagaaggaagctgaggaggtgagccagaatgaggctgcatgtctttacctcctgggaaagtcccctgttctgcctgaaacaccctttcttttactccttttcatgggcctaagttttatttctaggtatgtatagctgatttgttcagtgggtcagagcacattgctaatgaggccatggtcataggttggagcctcatgaggcctaatcagttttactttgttctgtggccacaggctgaccctctgaccccagccgggagcctccccatatgtggctttgatcctcagggggacaaatgagagtacagaggccacaggacatgaccctcccccatctctgtggatgatggttcagttgcctgaactcagtgctcagttggaataaaagtggaagccccaccagggcactaggcctgaactacggaggcagagcctgagttccacacataggatgggtctggaagccaaatgagggtaactgagaagccagatccacctttatgctctggggaggctgggactgtcagcctggcccctctcataacacctccaagaggccagcctaataatgcttgagcatgcacagatgagtctctcttctgccccaaacagctctccttatgttccatgttgcctcaagcagagctagatgcaatgcgtagtgaggcaaagtatgactccaggtcatttttggagagctttcatttcagtatacaataatcccttcccaacccagggatttctccatatgaaactgtacctaggcttccaggaatcttgacaattttgtactctattaacctcacattgaaagtcaatcattcccaaatagttagaaaaatggtaaactttcagttgggaagagaaaaggaaggcaattggatgtaaaatggccactgcattgcacagcttcaggggaagccattttacataaaatacaatgtgaatgggtgcccttggagtaaggcaaagcagtcctgctccaaaggcaccatggcaaatactttgattatgtctctgccatccacttgactcctttttcttttaacaaccataaatttactatttctctcactgttctcaggttagataggaggaatagaaatgcatatatgataacagcttatctgaaaggcagtaagcatttggatgaaggacccaatatagaaaaaaatgcccatttgctatgaatattctctataacaaagcaagacaaatttagcagcacttcattgcatctggatgggggagagagctggacaatttcttgctaacaagagatggtaaatgaaattcttttccgtttttaaaacctttttgctaactcaaaatgtgtaaaatgtcattgctgttctctagattttgttgtgatagctttcttgcgttaatttggtgactgtaaaaatattaataatgacttccataggttcacttgtaaccctggtccccctaaccctatttttcctacataaggtcataagttcctcaaccaaaaattctccttccacgagggttatgaggaaccttacccaggcagctagagaggtactattgtacttcagagtgcatgcgccggctcctctgtcttccttcccaccttatcttctttcctcctgtaccctgattttgcctgccctcatattctcatttccttcagtccatttgttcttccgtctgtccttccatctgtccttccttctctccatctccaccattcagggatggggcactgagggctgtggcagaggctggacatgagcccagctacacagtgacttgcctcatgcacaagttcggccagctccccatccagccccatccttcccacacattgggtgttcatttcaaagccatccttactgtctccatcagtcactaactcgcatttccaatcccagagggtcctgcttcctatccaatgccagctcatctcctcactgttatataccgtcaggttaactgccctcacctcagccgtgaattctgcacacctcgcatccggggcaacacctgcttctgctgtgacctctacaactgtggcaagtaagtgttgaggcccagacacaggaataatggtctgaccacaacggacactagaagggctgaggttaaggaagggtgcattgtgggaattagggaagtggaagacattgatctgttaacagattttggctaacagacattacttgccttctctgtgccaggcatcatgctaggtactttcacatacttgatctcatttaattcttacttatgatgtatgcagagtaatcctcattttatagatgaggagagtgaagttcaaaggaaacagacaactagcccaaggttacacagaacttgaaaataatatgtataggattcaaactcagctctgtctatatccaagtttaacaatgttcaataaatagttactgagtaccttctcggtgcctggctctgttctagacactgaaggttcagcagccaacaaaacagaagtcctttcccctgtggagcttatattctagtaggggagacagtcaacaaatacagaaatatataatataatgccaggtggtgatcagagctctgaagaaaaatgaagcaggagaggtagatagtgatgaggggtgtgtgtgtgtgtgtgtgtgcgtgcacgtgcacatgcacgcacactgtatgttagatagagtagccagggaaggcctctttgagcaggtgacatttgtgcagacctgaaagtagttgggggtgggtgggcaacccaggtagatacctggagaaagagtgcttcaagcagagggaatagcaagtgcaaaggttctgaggcaggagcagttttggtgctggttctgctacagccactctggctctgtgcactccaaattgctaaaacatcctttattctttctttcaaaatatatttgggcgctaggaatacagagattgccactgaagagctcgtagactagtaaagaggatggacatgtgaacaatcgattgcaatataatgtgataagtgcagtggggatcagtggatgtggtggggattctggaggcccaatgaatgaaagtcagagtttgccgggagggaaaagtgtcaaagagtaggtgatatgggagctgagacttacagaataagtagggaatcaggagacaaaccaaaagaagacagaggtgggaaggatattcctggtagttgtgaagaggtagtgggtggaggtagttacagaaggtgtggtaggaggtaagacagaggtgtagccagagatcagatgatagagagctcattggccataggaatgacttcagacttgaccctgtaggcaactgggggccattgaagggtacagcatggaagatggaattgagtggttgaggaatggaggcagctaggaggccattgcaagagcgcaggccatagagaatggagcctagatcaagttggagacaatgcaaagcggggaatcattttaagagcaatttagaaggtagaatcaatagggatgtgtgagtaggtgatgtgcacagtgagtgaacacctctccatgcagggtatgtcgaccaatgttcgtcatgcacgtatttccttcagaatcttagtgaaggcgaactgagggccacgggagggagggagtaaggggaggaacctgcagagtggggctggatggagctagattcagaggcagcaagtggatgcagccccctcatcactcacattccctactgtcggtattttggggtcagttactctggtttaaggattaagacttgccagactagagtcagggaggagaaggcagagaccatacaccagctctttaccttctttgcttgtgccagtcttgtttcattgaaaggtttggcagtggaggaagagaaatttacagattcaaatgaggtttagggattatctggggagttcaattatttatgttgtaataataaccatcacttgtaaaggacttccctccttagcagcaatgatggagagctggctataactgtacttcctcagcccatccttacaaaaatgatcaaagaaatgtaacacgggtcctaggggaattggggttattttactatctttcctcttgcctcccctcatccttccttccccgatctgtctttccctttgtttttatctcctccctcttctctccctcctcctgccatccttctccattttccttggtgctctcctctcctttcccatttcatggcctcctagggtggtgctgggagctggccagaactgggcctgagatctcaaggagagaggaggcccactgagagggttgataagtgattccttgcagacacacctttctctctgtgacagtgtgtttctgaaaaaggtttgaatacacaaaaccctactttaaattccatttagctgagtcctcaggtgaattgtttttgaaagtggaggctcaagtccattctatgttcctgtcaatctgaacttcataaaaattgacttccttactttcttaaagcaagttataccagaagagtcttcaaggaattttatgaggagctgtgctaaactatgcactccccaagggcagggagcatgacttaatcttatctatacttccctggccccagcacagggctgggcatgagtaaagagccgatgaaaagggagtgatatttgttgaaaaggaacaaaaagaagaactcccttttcactggggaaaataaaatattggactaggcaactgagaggggtcatgggaacagtcctactaaagatcttcaagcctagaaatgtctttcacctacctagtgcctggaagccagccccggacatctctcaaagccctttcccaagtctgtagtgctaagattccaagggcaaagccactagaaaaggacttccttagcttttcctgaggaaacagtcccaccaggccataaacccaggctgagactgaagaggcgagggtcccacaatagaggaaaatgttttttcttgacctggggctttttccacccagagccaaagagacctaaactcaaggcctaaatatagctagcaataagcattctgaggcttggagactttaattttgccaaatgtgtatttgttttcctcacacgaagcctatttttaatcaattgccagctcctccggtccatttcctggaaaggaggccaagaaaaaaaaagtgggaacaaaaacatcaggcagtcatttgtacagtgctacagaaacagagtctctactgtcccctcgaacccacaggccttctttgacgtcaggggtgttgaggttttaataccaaacatagattattctatttagcctcatgcaggaaggtggctttctctaggacacagctcctcagcagttgcctttcagagtacttcaggctttcacctactcactcatctttggaaaggtcaagtcaatatcactggttttcagcccgtaacctaaaggaaatgaagtgatttgtgaacagcatcagctggtaataaaatgaaagaagatagcctacttccattcactcttttcttcgacaaacttttcttgagctcctactatgtgctaggggctgttctaaaagaatgggcatcaataagacacagctttgcccttaaggaactcaatttgccagggagattgaagggaaggggacttaaacgtatatgcagaatgcatgcagcaggagagagacacatagaggctggccattgccactgcctgtccaccaagaattggtgagtgctccaggcccttatggaagagcagaaggatgccctcctgccttatctaagatcttctgctgcctactttgttaagtaggagactgaaacacagagaacttatccgtttctctaggtccacccagaacgttgagagcaagggggtaaaagcccacattgggtaatcaatctcatgatcaatacagtgattagtctttgcactcagttactcattcaccgagtatttattgacgacctttaatgtttctaccactgtgctaggcagtgagagagacacaaaggaatgttaagagacgaccctcgccctcaagaggttgcgattttgacagaaacatcatgtcggccttggccttgattgtaacattagcaccagcacagtatttagcactgatacgctaccaacacatattagattaaataaataactgaattattgatatatacaaagtgccaaactaagaggaatagactatgggagtccaaggaaaaagctaatgaatgggtagtggcgtctttgaagaaggcactattgaagctttgagcagtgagagagattaggataggcagagaacagaaagcaataccttcaatgcagggggagaaatctgagcaaaggtttggaattagtacccagcatagccagtgtggggcttctgtggactccagcctggctggagtgtatactccattttgaggctggactttggcagactgaggaatttgaacactcccctgaaggtactggggagccacagaagggttttgattaagtgaatgacatatttttaaaagtgttttaggaagagtaatcaggcagcagtggggtctggcaggacagccttacagtgatggaggcatgaggatgggagcagtgggaatgcaaaaggtgcaatttcagaggaagctctgcccagagactgaaccaaatggaatcctgaatctcaagcagaaaaaaaccacattaatttgctaaacccgaaccatatctaagaattagctttcttttccttcatggttcagtgaaaaaaaaaaattaaatggctgctggaaccactcaaactgaaaccaagtatatattatctaaaattattgaatattttaaaacaaactactatcctattcccatattgcggtttgtgcctacaaagtcttaatactggccagggacagtggctcatggctgtaatcccaggactttgggagcctgaaatgggaggatagattgagcctaggagttcgaggccagcctgggcaacatgtcagaaccgcatctctacaaaatttagctgggcatggcagtgtgagcctgcagtcccagttacttgggaggctgaggttggaggatcacttgagtcaaggaggttgaggctgcagtgagccatgaccataccactgcactccagcctgggtgacagagcaagaccccatcaaaaaaaaaaaaaaaaaaaaaaaagaaagaaaaggaaagaaaagaaggaaggaaaaaaaaagaaaaagaaaaaacccaaccaaccaaacaaacaaaaaacaaaataaagtgttaatacctttaagaacagggttcaaaggtttgaattgtgttgccagaggctggctcttagaaggaacaaaatgtagctacatattttagtggaggcttttattatatgttggagtactgctttcatgcctgttggcattacatcccccgggctcagagaagttaagtaaagtaagtaacctaagagtaagaaagtaagttgctagagtcagcatctggtgacagagcatagatgacagagccaggattcgaacacagtctgacttcagagtcagctatggcatactgcctgcctatatatactactagtccacccttggtgttttaggaggcaggcaaacataatttgggggatgtcagaagttgactcccaagctacaaaggtgctcctgcagttccacactcacccatacacacaggtctgtccttttcagagaatagtccttgtacagctgtccgtttttgggggcagtaaataatctgtgcatcctccctgccctgtccccagggcctagtacaatgccagctaataggagacaatgtatgcttatgcatgggctcttgagatatgctcctgaaaatactgaaatccaattcaaactctgattaattgaaactcccttaaaattccactatgggccaagtgtggtggctcacacctggaatcccagcactttgggaggctgatgtgggagtatctcttgatgccaggagttcaagaccagcctggccaatatagtaagactctgtctctacaaaaaatatttttttaaaaaattccactacggaagcttactattaaaaacagtgggtctcaaacattgatgaacttgttaacacagattcttgaccccatcaccagagattctaccagattcagtaggactggggctgggcctaggaatctgcatgtttaaccatctctctttctcaaagatacatgcacagatacacgcagagacacccacaggcacacacaaataatgcactgatacaaacaggcaggcacacatagacacaaacacagatgattctgatgcagtctgccctgtaaccacactgacttcacctccttagagaaacactgactttaaagaatctgaagataaattcatctgtaaagtttaagtcttttcatatgtgaatagtccctctctgattcattttggagatcagcctttgattgtttttctgttttcttttttgcattcttatagcaggggagtcacatgtaataatcatcctaatgccagggcgtttcgttgtgactttaagtgttttagattcgtgatgaactccagtggccaagttgtaaactagtttgtgacatccaggaggacaggaactttcatttaattaattccacaggtatttatgtagcaccaactgtgtgtcaagcacagcagtgagcaaaatgaaccagttcctgccctcatggagctcacgttcaagttggggaggcagacaataacgtagtagacacatcagtaagttattttcatatgggaatgaatgctacagagaaattagaaaagggtgatgtattgcttagctcgggctgccataacacgataccatagaccaggtggcttaaacaatagaaatgtacttatttctctcatttctggaggctggaagtctaagatcagggtgccaacatggtcgagctctggtgagggctctctacctggcttgtgccacttcccctctgtgctcacagtgacctttcctttcacattcaagtagggagggagagaacgaaagtcggggtcgggggtgggtgggggaggggcgtggagtagggaagtcaggggagaaggagggaaaaagaggaggaggaggaggagagcgagatcttccttttcttataaagccaccaatcctatccgattaggaccccacccttgtggcctcatttaactttaattatcttctaaaagccctatctaaaaatacagtcacattgggggatagggctttaacacatgaatttggagggacaaaattcattccatagcggataatgtgatagagagcgacagggctgggaaggggtgtctttggacagagtggtcaagaaaggcctccccacggaggcgactttcaggttttgtgtagcaactcagctttagttgtttaccaggacattggtttttatttgtttgtttttttgtttgttttgttttgagagggcacacactgaagtctttgaagcctgaattcaggtcccagttctaccacttacgacttgggcaagttctttaacttctctgtgcttcactttcttcatctgtaaaatgtgcatggtgatagtccctatttgataggatactgtgaggatttgcagaactttctgcaatgatggaaatgttctgtaacctgctctgtccagtatagtaaacactagccacatgtgactattgagcacttgaaatgtggctggtgagacttaccaactgaatttttctttttacttaattttacttaatttaaatttaaatagccacatgtggctagtagctaccacattaaacagcacagatgcaatgaattcacacatgtgaaatgcttagcactgtgcctggtacatagcaagtgtcaataagtgctatctaggattagtgttagtggtggttacaagtatttttctggcaggtaggagttttttttcggggagtggggataaacaatcacactttgatttattatagtacatggctatgatgtctcttactgtagctccccacctgcccacctgtcttttcactgagctgtatggtagcccaatcccagagttggggagggggctggggaggacagcctgctccctggggactgactggagcatgctcctccctgtccagccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatggtaaggaaagaattgactttgcatttcacagtggcccctgttggacatagggggaaggctaggcagttgggggaaatgcagacacatattttgaagggaagaatcagaagcaattgcttcaaggatgtagctgccttcaaatgtctcaagttgaaggagccaggtaatgtcatcagtctgcaaatatttcttgttatacacaaattacctgtgttctggaggcaccttctaggggtggggggtgaaaggaggaaggggtgttctcagttcccccattcgcactggttatgtaaacatagtcttttatagccccaccccacacttttagtaaaattttttgggaatagttttcccctaacaaactttgggagagatggaaggaaaggttattctagctataggtaggattaatgctagtcttcccctccccaggtatttcatagtgaagtttcttcagaaagagcatctgggctcttttctgtttgcattcgcagagccagctctaggctaagttgcttgccaggtcttgccttcaacttggacctcaacctcagcctccccactttccattcttcccttccaaatcttttctatttgtgtgtgtgtgtctgcaaaggcacagcaggactcagcattcagtaggtactccatatagtaggcttctttttttcctttccttctaaggcatttctaagcatttatttgtttatttgataaatctagatctctaattatggagataatagctttgagttatggttatcaacctggcttcatataagaatcacctgcccagcatggtggctcatgcttgtaatctcagccctttgggaggccaagacaggaggattgactaagcccaggggtttgagactaggctgagcaacagcccctgtctctattaagaaaaaacaactttttttaattagctgggtgtagtggcacatatctgtagtcccagctacttgggaggctgaagtgggaggatcacttgagcccaggaggttgaggttgcagtaagccatgattgcaccactgcactccagcctgggtgacagagtaagaccctgtctctaaaaaaaaaaaaaaaaaaaaaaaaatgcttgggctccttctctaaagattctgatttaattggtctaaactgaagcccaggcatcaggttttgttttttggttttttggttttttttttttaagctcccaggtaattctgatctgcagccatgattgaataccactgctttaaatgaacatcccacatctgtttatggaattattttgtgcctaagagggactttcctttgaccccagaaattagctcctaggcccttggctgtttctgtcagattttggggtccctgaagaacagaacctgaaaggcagtttgtaatttgatcctggacggtcaaaaggatgaatgttggaaagtgaaaggtggggtaggacaagggaaaagaaagaaactctgtcgttttggattgcaagtctccagcagtactgggctgactggaactattaagtgttcctgctagtgactctaagtcaagagaaatcctttcctgcccatctgcactctctctttcttctttctctccctctctcatccgcacatttctcttcccagcttccctccccagactctggaatgcccaagcactaacaagtaggggaagcatcaacaaaggtggagccccaggagggaaaaggatttcctgtaaatttggccttgaggaagcttttaggttagagagctgcaaaaaaagctgtttctgggttggggcttctttggagaaaagaatgccctttgttcttggagaatttccccagggggcagatgaaagtacaggtattgtgtggaatctcagcagctttggctggaagagaagctcccaggtttggcgagttgaggagatgggacctcaggatgagtgttaagagttctctaaattgtccctagagctttcaggcttggatggcagagataccttgatgcacaaatggagtaggtggtagctacttggtaggctctgtggggtgcctgtaaggcttccccctctccaattttaccctactgtgggcgctgaaactgccaccatgttttattccttactttaagataagcattgtcctttttctccttgtccactttcaagatgcgtgtattaaacaaaggaataggctagtaggccacagaggtgtttatactttgagttactagtctctcagtgtgaaggatttgataagacccttttccatggtgatggaaagaattggattttgaaggcaaagggcatctgaggaagacagggagagtggctagatggacactttcaagaaatttctggaagttggaaagaagggaggaataggaagatgatatgctaaggaacacaaccctgccaagcttttagccttagctttagtcccgttttccctcactgtccccctttaaaaaaaattgaggtggaagtcacaaacataaaattgatcacttcaaagtgtacaattcagtggcatttagtacactcacaatgttgtgcaatcatcatttctgtctagttctagaactttttcattacctgaaacctgtacccattaaacaatcactccttgttgccccttccctgaggccccagcaacccctaatctgctgtctgtccctatggatttacctattacaggtattttctataaatggaatcatgcaatattcgaacttctgggtctggctcctttcacttatcatattttttttgtttttaaaattcatctaccttgtagcatatatcagtgcttcatttctttttatggctgaataatattccattgtatggatagaccacgttttgtttagttttttatccattgatatacatttgggttgttttcatgttttagctactgagaatagtgccttcatgaacaatcacttacaagtacttgtttgattacctgcttccaattctttttccacctatgggtggaattgctgggtcatttggtaattctatgtttaactttttgaggagctgccaaactgttttccacagcagctgtgtcattttacgttcctacctgcagtgtgtgagggttccaatttctccacatcctcaccaacactttctcaaaaaaaattataaacattctagtgggcacaaagtggtatcttgttgtggttttgatttgtacttccctgctgaccagtgatgttgggcatctttttatatgtttgtgtgcaatttgtatgtatatcttctttggagaaatatctatcaagtttttgcagatttttttattttccaaacaatattcaagattgttaaacaaaattttaaagtattataaaatgtttaattttcattagctttaaggtttatgttacccccaaattttgtatataactgaagtttcaaatctactaacactcactgaattgataccactctggattctaaggcatcagtttcttcttaccaatttttctttgcttcttctaacatttcttgtgtttcatcttgagaatggctaatgaaaacatcaccaatttgataaggtatcattaagcagtcatcatctgcaagcatgatgtcattgcaaacaacttctaaattgtggagttgtttccttttaacttctgtttcttccttcagctctgtgattctactcatattccttgcaaatttgtttacctaatgttgatcttcaaaagtagcgttgaaattttctgcagcctgtaaacaacagcactagtagcacctacctgtggacttgtgagggctgatgtgataacccaggtaaagtgcatgtattagtccattctcacactgctataaagaactgcccggccgggtgcagtggctcacacctgtaatcccagccctttaggaggccgaggtgggcagatcacgaggtcaggagtttgaaactagcctggccaacatggtgaaacgctgtctctactaaaaatacaaaaattagccgggcatggtggtgcatgcctgtaatcccagctactcgggaggctgaggcaggagaatcacttgaacctgggaggtggaggttgcagtgagccgagatcgtgccattgcactccagcctgggcaatagagtgagactgcgtctcaaaaaaaaaaaaaaaaaaatagcccaagactgggtaatttataaagaagagaggtttaattgactcagctctgcatgactgagaaggcctcaggaaacttacaatcatggcagaaggagaagcaggcacatcttacatggcaacaggtgagagtgcatgtgaaggaagcaaagggggaagagccccttataaaagcatcagatctcgtgagaactcattcactatcatcagaacagcagcatggaggaaccacccccacgattcaatcacctcccaccaggtctctccctcaacacctggggattacagggattacagttcaagaggagacttgggtggggacacaaatccaaaccgtatcagtgcatcaagtgcgtaaaagccaacctcagtcaatgggaccttcagtttcccataccctaaggacaaggcctgggctgcagggtcctcatgctccccagaggcaccctcagtactgagagaggtgcccagagccctccatggattccggcctggggaccccctgcctcaacaagccaggtgactaagcaaatgctcagggccctaggtgcagacagggctccccacagagcagctgtaagggctgggggcctcagtcttgggccccacactgagcttcagagctgggcacccccagcatcccacaccctccactcccctgctatagctgagacctggccactgaccaagaatcctgcccatttttaaatctgttttgttgttgttgagttgtaagagttctttataaatagcggatactagagcattatcaaatatgtgatttgcaagtacttcctcccatgctgtgagttgtcttttcactttcttgataatggcctttgaagcacaaaagtttttaattttgatgaagtgtcatttatctatcttttcttttgttgcttgtgcttttagtgttatatctaagaatctattgccaagctcaaggtcatgatttccacatttttgcctaagaattttatagttttagctgttacatttagggctttgaaacattttgatttaatttttatatctagtataagttaggggctcagtttcattctttttcatgtggatatccagttttcccagcacatctgttgaagacactgctctttccctactttatgatcctagcaaccttgtcaaaaatcaattaactgcagatatatagatttgtttctgcgttcttaatttcactgttatctttgatctcctgaggaaaaaatgggtttgctgatggtctgtcttgatagcggcaataatggcccctaaccctctgcaaagtgcttttgcacagttaatcttcactattactactttgtgaggtaggtattactgtctctgtttaacaggtgaggaaacaggccaagaggggtcaagtgacttgcccagagctgagtagcagaactgggactggagcccagatttgccaaatgccagagcctttgctctttctatttcatcccagctgcccctgactaacatttgggtagccctttctggttctatgagtgttttaacatatattacctcctttgtttagttgatttaattaaaaaattaaaagcaagttgtttccacctgttgggagcttctttgacagtacggaaggagagcaagggaagtaccgagcattatcaaatgtgaatcccgggaactctatcaaggaccagggcagaaaaaaaatgaaagcaaagatctggggagaagatctttgattcatgagattagagaaccagtgggggcacagataaggataccaaggaggaatcattgcctagatcactctattaaaataagaccatggtgtaaaaagtccaggaacatcattcaggtgagcctaagtacaatccttggcctacatccaagtgtggttggtgacttgtgatgtgcctctccctgagtagagtccccggggtctgcagggaggcccgggggtgctggctgatgaaagccgtttgcagagagtgaggacaggagccgagggctgtgagctggcagtcttcaatggaatcagctaggaaccaccatttccaaagttgtgggatcctgaaaggaaccctgacaagaggtgcttggtgaaaaagatcttaaagaaatgtttgaagaagtgcttgttgaccaaagatatgaggatttgagatgaatttttaaaaagtgaatatatctttccattttctcctaattggtatcgctggtttagagtaaactggagagggaaaaaaagtagcattctttccaaagtccacaatcattgtctcagaatagactcagttttgtccaggcaagattgctttcaccatttgctgtgctacctagtaaccttttgtgttactggagctcggaatgctactgatcaataatgggggggcagggcgggcgtctcacaacgtaagccccagaattctaacagaaatacacatacacacacacacacacaaacacacactcctatacgtgcacacaaatagaaacagggcccaaatttattgtaaaatcagatttattgatttaaaatataaccagaccactattttggcccatctcttttgccccatccctgactaagtcttcactccattccccatttcctcttcttccttctcttgctggcttgtccattttctctatatcctctacccctgactgtcttctcttcagagactttcctatacccatttaatcttactctcatgtttcttctgtgctgccttctctaaatagtcaacttcctttcaaatattgtctagacccttggccttgctgaacacacaaaaacttttatatagtttacattgtatgattgtttctccacagttaggcttaatttatttagatagaagagctggtttcattttgcgagagctggagggtgtgtttttaattgacagtatgccaagggaacatgatttctggtacttccccagagacagaatttctttaaagaattctgggggagaggtaagggcatttctgagtaaatgtaaagcaagccagcccttggaatggtcaagatctcagccctctttcacacattaaagaggctgacaaacatttatctggctgtctgtgagctgtattatgactgaggtttgtagctcttcaaacctcctagagatgtaaacagtaacccactccaaggaagagagcaacagaactgtgttgaaacttgctggaagggagtttccccctgccaacaccctaacatggttgcctttgtgactgccaaagcctgcctacacattttcatcacttgagaggaagcttctgcttctctgttaatgtgctgtagctatgttccaaaaggaagacacattgatttttcagacagctctcaattatacacatgaatgggggaggtatcaatgacatagaagatggaaaaatcatttaccccacaccttgatccatgtggcacaaagcacagtcctacttgggaactaatgagtagtggtaacttcctttagcagtgctttggctctgatgagagcagggcctccattctggacaaggttagctttaacccttgaagggctacacacaccaccatgttgtgaaaaggatataaaattatgtctgcatcgttttatttgcaaaaaaaaaaaaggtggggggatcaatatatttttcttggtctttcatggcttctgtgcactgctaggattttgcctctactctacagggctgatgagaaatcaatacccttcatgtcttcaggagacccccttagcaaggttgggatctctaagaatccttacaacttttacaaattctttgtgattgaacacactctgtcacagcaagaacactagctggttcggccttctctatttgatgttttgcattttgagtcttattttttctttttaattcttgtttttaaaaatcacacaaatgatttcaacttttctataggtttaaatttttcaagttaaaaagtttggggaaaatgacacaatacaaattagttgtaaacattttgacatatatagtagaaagttaagaatccctatatacctcctaattctactctgctccccagagataaaccacagttaatagtttgctatgcatccttccaggttaatttctttgcatttacaaacatacatacatgtataattttgggggtctttttttaaaacataaattgggatcatgttatattaatgtaacataatggcttttaaaacataaaaatatatcctggacaaccttctctaaataggtccacatcattgtttatcaatagctgcatggtattccatagtatagatgtactaagtttatttaaccattctcctagtgatgactgtttatgttgtttctaatttgtgtttttctacagaacccaactctcccagcactgaactgttctgttgaaaatacccatccaacagtttcttactatgctcatccccaagtggcatcctacaatacctactaccatagccctcctcacctgccaccatattctgcttatgactttcaggtatgttttgggagaaaaaagaactctgtattacccttgttctcactcatgctctcttgttctctccctaaattcaattatggaacctttccattgtctgcatatgtatgaggtagccatgcatctccctaatggccagcagcctgtggttgccagcttaaggactatgtaggcaggcaacgatggcagagatgggcgggtggaagctgcgcaagagaagaaacagagagatggaagaaaaagggagagagggaggtaggatcaaggtatcccaaattgccttaaactacaccaaggagaagataagctagttgggaaatggcagctcattagtacactaccatggacccctgtgcaacagtggctttttccattcccctgatatggggagaggcctaatcctgctccttaacacaagggcattctgagccacacaagggtttgaatcaaacctgtaatgaggaagaagtcccattctttttctccaggcctcctaactaggactacacagagcaatacacagagtatttttataacacccctcccccttttgccctgttatcacgtaagtcagaaatagtgttaacaaatttgcactttccccttttccttttgaactgtgactactagtagaaaaccagacccaaaaaaggcacttacttaaaaggaattcattgcatgcagaacactgaactagacactttgggcaaacaagtgaaatggtcctttaggtatgtataacgattataaacccttgaccatagaagagcaaggttacactaaaatctagttaattcaaactttagagaccaaaggaaataccttttaaggaagggaaactcataataaatttgcttctattgatcaagagaccatgaatgttccatggggacataaaagtacaactatctgggggtacttccaactaaccagccagtttggcaatacaaagcccttgggcaacctaatttcaacttcagtttggcaaaataactgaaacttaaaaatctgattaagttgaataaagtgttgttgtggttggtttagataccgttcagagaggtctgtggctccataatgcaataataatacatatagtgtgcacatgtacttgttcacttttataaaatatagtactagttcaaaaaggtatccattaacccattgatgccagaggttgcaaatttttttgtgaaaaatcagaccttggcgatgaccttgagcaggaggatataaataactcccacaagcttagcgttccaataatgggacactaggcataaatgggttaaagcttagaaaatataatgataaaattcgttctaaagcctactgtgtacacaggtagacaactcaggtaacttgttacccaaataggtggtatagactggaaaacaaaaatatgttcaagaagggcatagataatttcaatagtgaccgaggcaacaaggaattcttcaagagaatgcagggatgttgaagctaaaacaaggaaggtcatcattctcttggggtccctataataaaaagtcatccttaaatagaggagccacacatgggtctagcccaagaggcctcctctacttttatatcaaagtaaattacattgatttcaggaatttgcactttataatgaaccctttaagtagggacaataatacatctggtgatggttaccacaaattataagataggaaacctctcttttgggtatggagccatcattcctcattcaaatcctaccccagaaatgaaagcaagattgagaatgccaacggtgacttggattgttggtttcagttcaatcaatgtttactctgtgttccatgtgccacgcattgagccaggagctgtggaaatagaaattaaatgagacagtccctgcgttagtctagggacttgggggtggggggtcaggggacagtagtggggacaaaaaagtaaagaaaacattacccagaatgctatggaaacagcatacctaacccagaaaagggatccagatttagctacctagtccaaacctatactatgggcttgtagcagagactttggggattgttagaagcctctcctttttttttttttttgagacagagtcttgccctgtcgctcaggctggagtgcaatggcacaatcttggctcactgcaacctccacctcctggggtcaagcgattctcctgcctcagcctcccgagtagctgggattacaggtgcgtgccaccatgcccggctatttttttttttttttttgtatcttttgtagagacagggtttcaccatgttggccaggctggtctcaaactcctgacctcgtgattcacccgcctcggcctcccaaagtgctgggattacaggcatgagccaccgtgcctggcccacccttactttttaataacagctactattcactgagtacttactatgtactaagcattgtgctaagtgctttacatatatcatcattcaatcatttacctctttaagagaagtactcttgcaattgccatttttaagataagatgactgaatcatggagagattaagtgacttcaccaaagtcacagaggtggtaagtgaaagagtaaggatttatatctagggctgactgattccagagattgggttgggggatttttgaagttgtgaatctaagcggagcacagctctttccccagttaattttgggatatttatactttctactggatatttatactttctactggactcatggtcctcagaaagggtctctttactcttgatccccactgaaaaaggattcccttccttcatgcattcctcagaggggaattcaggggctgcttggacactttttatatgtctcccacttctttccctaggctcaagatgtctttagtatttcctgtttgaagactttataattgtatagcctaagtcttgagggggtaagattttaagtgatttctctctagaacttaaatggtttcattttagtattttagtttagctttcttttgctcaccaagtttcattcccttatagtttcataggcgaaaataccattctttacacaagaaagtcagccaggcgcggtggctcacgcctgtaatcccagcattttgggaggccaaggcgggcgatcacctgaggtcgggagttcgagaccagcctgaccaacacggagaaaccccatctctactaaaaatacaaaattagctaggcatggtggtgcatgcctgtaatcacagctactcaggaggctgaggcaggagaatcacttgaacccaggaggtggaggttgtggtgagccgagatcacgccattgcactccagcctgggcaacaagagagaagcgctgtataaaaaaaaaaaaaaaaggaaagtcaagagggcaggaaacgtctgcttatattcccagataaataaaaaggagtcagcaaatgcactccagatctgacaataaaaccacctgaagcacagacccacccccaaaaggccagagctccctcatgctcttctgattgtaaaatgacctaagttacagccagaaaatggacctttctagactttcttctgaatgacttcccattttggttatttccaagtaggactatttctgtgactttgggtttggtgatttcaacttccttttgaccctgaggctaataggaggatgaggaaaaaagacttataatgttttgttttaacccctcaaagtcatacccttattgggtagctgtccagtgaggaagcttgggaaacacttcttgtggtcagacatgagcaaggatttgggtctgatcagctggccctgaggaagttttgagtgctgagcttagagaaactggattctttcaaacactgggctccagggtgtccttgcttctcaggaactcctcatactccaaagcaggaaggatataagctgagactacctttgcctcctcgctcatctgtccaacactcatttctcttgtcctttgcactatttccccaccaccccttcagctttagccaagtagtccaaaatctgtagggtacaaagcatcagttttcacttctgctgggaaattaaacccagctatttataaacccctcaaggttcccagcaatatttcccagtctggcatactgggccagtacccctactttactctaaccatggaatggtccctttcctatccatttggtgaccagccaagtttaagcttaaaacgaaagtctcaacctatgcaattcaaaagtgcctctatttttcctctttatttaatcacgagggtacactaggtttcaccctagccactaaaagttactcattataaattgggcccatttattaaaaggattgctttgatcctaggagggtacagtttatggcacaggttgctgagagccttagaaggctgttgttgctatcactcaactttttcttccccccgccacccgcccgccaccccgctgtcaagtctttcctttcgtcccctcctttcccttgttcctgactcatccttttttttttcctctttcttttacccactcttctctccatctccctagcctttgcttccaggggcagaacagagagggaatgcacaataccgacagatgctgggattttacccttgggacacagtgtctttaactagtaattatcaccagccagttcctgggctctttgtgaagtcactgtcccacaaggctcctggagagaagcatgccctgacggaaatgcgcattgatcttgaagggtgtgggtcagccatcaggcaggcaggaggcaggctaaggtggaagaggaaagccatctgtgtccctgaaagggtggtgctcctcttcaagcaccatcagcctgttggccaccccagcctctaagaagccgctcaggaagctggagctgactaggcccagcagtaggctatttagatgctcttcgtgcttggtggtgcacaaggattcaaagttctgttctcctgagctgcccacagcattattaaagtcacactctcaggcaggaaccagaatacaccaggccaactccctggctgcgacaaagccagatctttcccaaggtgcctgcctgttgctaggaaactatgcactggtactatgggccttttcccccgctaaaccccaagggtgtgtggactgcagccagttagctccctagctctgccaggaacccttcagctttatccttaagactcccagcatcctcaaagggaagtgagaatcatgaccccctccccccatacttctcaaacacaaaactaagaagtgaaaacccaagggccgttgtaccacccccttttattatcaaagtgtacaactgccacccacagcagctgctgcccacagaagccttttaatgcctctcaggacagaactgcctttagcttcacttcaggaaacttgcctctcccttctgtggctgggaacacctaaaactggcctgctgcctctcatgtcatctctgtagtgggatttagagaggcagtgagtgccatatgcccaggcacagagattctttgccctggtgggtctttgttcccctctctggttaagaggagagagttcttagttgaggaaagcaacagaacaggagggagggagaggaggaggaagggagagtttgaagggtgcaagatggaaaatcaggaaatcactataccgatgtttttaacaaagggtatcttcttggagggaggaggaaaattgagtttttaagaaggaatctagattgtcttgagtccactgcctcaggttgttttgcctttaagggctctccaggttctacgaccctgccatttctttggagtgaaataatggatgggatttgggaggcaggggatgatggcagctagcatctcttctcagtcttaacattatgtggtaaggaagatttttctgtgtctcaagcaaggcttagaaatctggacataggttttatttatttatttatttattttcgagacggagtctcactctgtcacccaagctggagtgcagtggcgtgatctgagctcactggaacctctgcctcccaggttcaagcgattctcgtgactcagcctcctgagtagccgggattacgggcacccaccaccactcccagctaatttttgtatttttagtagagatggggtttcgccatgttggccaggctggtctcaaactcctgacctcaggtgctccacccacctcagcctcctacagtgctgggattacaggcgttagccaccgcgcccggcctagattttattttttaaaagcatgccaagttcatctactatgctcctgaagttgtattcactcattcaagatttattgagcacctattacttggcaagtactgttctgagctctggaggatacagcaacaaacacaacaggccacctctccttcagcagggaaatcactagagtcaaggatatacgtgggccagggagagaaaggggcaaatgactcctgccaattcactgcatattttaaaaaattcatttccattcctttcccaaagtaagacaacacaaagtaaaactgaatactcagtgtctctgcaacctgacatattgctcctcattctcacctccatgcctttgttactctttgctctccaacctactctgcacttggggatgagggggcagcagttaaggtggagtagaaaatgttggacttggagtcagaagactccagatccgagcaagctatttcacctctctgaccttagtttcttgtctatgagaggggctcctgaccactgtactacctctctgtgatatactcttttagcaaagactttcccagggatcactggcttaatatcattaaatgttctcaaagccaaaaattaccttttgaagactagttgggacattgttgccatagcttaagggagaggtattggaggcttgagttataaatgtaaaaaaggtagtgatggattcaagagacaacacagaagtagaagcaacaggatttggcaattgattggatgtgggctgcaaggggttgcagaggaggattccctatttctgcaggtggcttgtagcctgagtgactgagagaaccacctgttccaggctcattaactctgtgaggtttgggagctctctgttcttccaaatagaaaaaaagctttggcccatattcatttttaaatagtaatgactgttcagggaattgcaaactcactgcctaaactaacgttttctttttatcacacagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgt

SEQ ID NO: 4980 - DNA, 52886 bp, human
aatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggtaagtctagcggcccttccttcgggcggcggcagcaggggttgagtgccctggcctctggactgtgaacgccccagctgccccaaaagccggagagcgggaaacggggcatggatggggtggtcttcgcgccccagcgtctgggtggtggaccagagtcccaggggagcggcctggctgcagcgggagcgacgtgcggagatcggagcgccaagcttgcgtcggagtatctctgccccggagtgcgggtgtgtgcctgtttgtgtgcgtgtgtctacagacttgcagtcggtggtaaatcccagcaatctgaggatcaaaacacttccctgcaacctgcgccttcgctttccattcgacactccctctttgcaaagtcctggtcacttctaagagctcacgactaacgacaattagaagcagggtcctcgccccctcccaactctcttgaagctgccctgaaatttagagatgcagttgggtgggggcctgacttgcacctcgctgattggggggggggggcgggttgcgcaactctgggggatgggcgggggtgagaagaaagggggggatgaggggaggggaattcctgaggaatcactcaagacagcccagccctgccctctgcagcggcgggatcaacattctttgaatttgattgttactctgctccaaatgcacggaatgtgcatgagtgtgaaaagggagtcaggggcaggagtgagagcgcgagaaagaaacatccagcgcgagcccgcgcatcttctgaagtcgcgcttttcctcgcagggcggaatggagggggaggggcacccttcgactcctttccttatagaaactgggggacagctaccttcgggcaccaacttggctgcccctcgaagctgctttttggtagttacaaaaaaaaacaaacccagtccccctcagctgttaggcaccttcccaagccctgtgatttcactgggcggagaaattaatttggagccctggagagcgggaggggattgtaaaatcatgatcccacctaatcttttaaaattcgcctcggatacacttcaatcaaatcgaattctctctttccaacatactttacattctgcaaaatccctctgtcccgcagttcctgccatcagtctgctcaggtcttctccgatgaatttgcgggaacatctcgagtggagggggcagggagaagatcgaaccccctatataatctccctactgcccgcagaagactcagtgtcaacaaaactcgttcaccggaggggccccagaaagtgttatctcctggatggtggaaagatccgtatcctcaatggttttgcatattcagtataagaatttgctttttcatttttaagggcgtagttatttacaacggggtacaaatgaggccaaggacttggtccgaatcccgagcccagcagtaccagactcccccttactcccagctcgcgcgcgcgcactctttctccaacacacacaccacgcgcacacacatacagagggagagggagagagagagagcgcgagagcgagagagagcgacagcgagagcgagagagagagagacagagaggtgggaatgcactgcttaccttggccagctgtggcgccaacaacgcagccctggctccccgacgccaagctgttgcgcttcgcgagggagggcagagtggaagagtgctggggttccgcagcgtccattcccgctgcggacgacaaccacctaaccacctgcaaatcaagccacagcgccccgggcccgtctgccttcggggagtgggctggttggtggcccagggcttaaagagtcgctacttggcgcactgctctgtgggttggggaacaagatgaagagctttctttcttgggctcccaggggccctcagcgatcttgtgtttctcgaaaggtctgcgcaacaaacagctgagtgggcttcgcccagcccagtctccacactgcgggaaaggaatcataaatcccagatagaagcggagccggcgccacgcattccactttttgaagtccgcagaccgacggcactggcaaattcctgagtccagtgctaacgctgggtttccacagtttggacaggggagtctccccggagttccctggccctggtcccgcacagtccgggcctgaatcagcgtctaggctacttaggagctactcccacttagctctggcaacaccaccttcccttgcgtggggggaagaggacagtgggtaggtaggttagtgtttcagcctccaagggcagcatttctgaggggactccctttattgtcaagacacaaccgcaaccaaaacaataaaatttaaaacacgcagacacactgcaccaaggtgcctgcactctacgcttgctggctgcctgggaatagagcagtgcgtccaaggctcagagtggagcaggcgctttgcaattaagaagatggtaatttgactccagtgtccccccatcccctcccagcaacccccttctcccttttggcaacaccgcccccaggcgcaaaggcacctctactacagtagggcattccttcctcccaaataacacatttgtaattcgcgggcggcctcggatgttctccattcagagaactgtctaaagtggggagggatggatttcagcgcctttaaggaaatgtttgggagattggcagggtcttgaggcccttgtgtgggcagccacttgtttctagggatactcaaggctgggatatccggggacccaccctgtgtggcaaagctgactcaggtaagcaaatcctaatcggttcaaaagatcaacccagagaactagccaggcatcaacaacaccgtgtacaggacaggatactgggttcccaacttttctgtgcccaataaagattatacaccttatctactctcttgggagaggataatcaagaacgtgtgcaaggtaaaacaaagtaacagagacagcatcctaccttctagcaactcacatcttggttccctcagatacacaatcctgggactggcagatatcatatgggttgtggaccagacccacggttacaattgtaatggtaccagttacaattaatatacttattgagtaaggtacctgggaatttagggacatgaataagtgattaattttgatcaagaaaaactttttggaggaggggaattttgagcatgtttcaaaggaagggaggcacccaggttcaaagaccgcaatgcagatgggggctctgaccagggggaatacccggatgagagaaaagctggttgtttttggaagggtggagatagcaaataattgggtgcttctagagctaagcatcctggtcatcaggaatctggggtggaggtggggcactgcagagagggagggctgcagtagttctgcagggaggctgctgaggaggggcaggcaaggccaatgaaaagatttcagactctctcactgctgttggttgcagaggtggttgttgtttaagcagaaatatactgggtgccaaggagacagagtagtgagagatattgtagttttcacactagttagccagaaggcttttaatttgagggaaccctcaggtgtaccctacattaaaaaatcaattctatgagactagcccatatttattcacacaattcctcccacatccttcttgattaaaagggaaacaattctgagatgttgcctcttgtttattcaacaagtaccgattgtttattaggtatcaaacactaggtataaatcgtaataggcatgattttcatatacctgctgctttatttaagtacctcctggtgcctgagtttttttacgtgtcactttactaaacaaaatcagaataagatggtcctgtgtttacagaaacatctaaggcaagccccaaattgtaccagaataagaacacggctgtacttctcccttctaaaataaaacaaccaccaggaaaatgtcctaagcagacacaataaactgccttttaggagcctgggccacaccttcagaaaatgggtatatcttgctctaagtagatgtgaattttattgagtcgaattgacactaaagataaattgaggggtgattcttcattttcaaaacgagtcaccctgggagggggttttcttaaaacagtcaattccccaagtgcaactagaaataatttcatgttacacaattatggtccttataaaataagtggtgacagggaaggacgctcgtgaggggacagagattagatattcgacctggtgatcagagagttttcttaggaattttatccaaagcaaatcctatctggagtcaaggcccctgtggggctgtgggatatttgcctgggttgctcaagtgactgaattttcaattcaggttctaaagcaggaaaaaagattttcaaatgacactatgtggtttgctgagtcacttttctgacctggctcttcctgcgcttttaaaagttagagtgatatttgcaaagaagacccaagagctgtgaataagattaaaggccagctggtggggaaggagcaggcaaatgaaacaaacaaacaaacaaaccaaaattaaaaagaccatgcatgcacacacacttctccaatttagtctgtcaggttacatgttttctgggtaaggtgttgagacacttccatatcacaaagatatccgtggtgtatccaaatgttctctcactctcttttgccagtttggggcaggggagggctagagattgtgtgagtgacaaaagagaagggaagacaagaatgggaggcaatgttggtaagtttatgttagagcccctctgtagaaccaactcacagattcactgagaagtatctatcatcaaataaacttaggcaccctggtttagagactaatttagggtccctcaaaatcaagaggaaggataactaaacttcaggtaaccagaagaaataaatcctggccttcccccaaccctctactattcctttcccagtaccatgcagtccagagctcccggctttgctcctgtgtttaccattagtcagctcccatttgcatccctaatagccctgtcatgaaagggccccgatgttacaggtgtctctagtgggcctttatgtttttgtcccatggaggctggactcaggtctctttaaagatgagtctcatttgccaactcttcttacctcttccccagggtgagacatggtgctttagcattgtagatgcctataaacgttcaaaccacttctacatttcaacgaaaaatagtcttagattagtcccatattagaaatgaccctgatgagtcacatccctcattttcgaagctgacgtcaggggagaccgcctgcccctcccacctcccttggagacttcagcagggacagtactggggaagacaggatggatggtggggttaagcccgggtgatactcccagtgcttttcttccatacaggaggggatatctgcagtggactgcaaggccagccacaacccctcccgtctcaccaccaccttgcctcctgggtctcgcttcgtttccttgacctcgtcccccttcctccatcccctctcccctccctctatcccctctcccctccctccccatggagcagtctgcatggcttctctcaacaactgcttcctgaggctgcagtgaggtctcccagaatgacagggtcttatggacagactcaagtgatctctttagggccataaatgacagtcaagccacgtgggtgggcgactccatcagggctcctcactgcttcatcctcctcatgctccaaacctccactagagagctagactcttctcatttgcttatttttttttttttgagaactcctaggtagtaactctcccctggttatttcctgttgaaggccctctccctatgcctgagaaatccctgcagagtgtgagacagtgctcggttcctttaaaaaaaaataaattaaaaagtgagcctagataccatttttctgtctgacttaataatcctgttttcaaaaaaatattggtttgcactatcatgtctgataagccctgagtgggagaatgggtttctcatcatttatgtttatgtcaccctcacataagcctaaatgtgtataagttataatcctccccacctaactcccccgatacatatctttgtggactaatggcctccaaacactcactttattacacacatttgttatgtgacaaatcttgccaatacaccattttaaagtttatacatgaggtggcaaatgtcagaaataaatgaaaaaaaaatcccagtaacttggcttggctgtgatatttacactgaaaatgaaatttcatatctctagcttatgaaaaaaatctttttagttggatattggctttaaaatgttttcatttaataccccctcccccacacacacacttcccatttatcatatgccttctaatttggtctaaaaaaccactctactaagtagttgtgacacatctcttacagagtgccaggagcacaaaaattcgttttgtttttacgtaactggtgaaatttcttctgttgtttattttcaaattggaaatacatattttattataaaagtggcacctgatgactacaaaaaataatgctctatcccttccccacaaccccccacccgtcaccaccaaagataacttcagttaccggtaggaataggaaaggaaaaccttcttagtgtttttttctttaagtcaatcctttccccagctgaaatgagcaattttaatttctctctgtgctttcaggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattgtaagtatagaaggcacaggtaggtcgcagtagcttgctgtctacagaaattctggctctgctctgatagttttcaattctgtttgagtgtctagtgtttgctcagatttcctcctttgtatctctgtatatttatgtggagaggcaactctgggcccgctaagaagagcactggactgagaatcagaagaatccagcaccatccctatctaacagtgtgatcctgagcaagtcatctcactctttaatacctcaggtttctggtttaggagatgttaccagcagtgttaaccttaggctaaggtcctttctctccgggcatctgcattcccatatataatagaggtcatctgatctcacctgaaatctgaggatcctggcagcttgacactctgaccaacagcactgatctccaaagtgatcctgcactcctatcagaaaaagctgtggaagatatgttcctaaaatatgtatatttattcacttataaattatatatatacatgttcataaaacttatataaaaatgaacattcaaaaattagataaaaataagtatacaataacttttaatatcttcatgtgaacacaaactaaaatgtcaccagataatatgcacttagtgtgaagcttgtcattaaagacagtggctttaaatccttatttcaaatggcccactagataattgtgaatatttttggctgccttcttatcccatatgattagactgtcattggagtcatgtttttaaatgtcaatatcacaatttggctgccaaaaatctaccctgggagttagaagtattaaactctgccattttcttgttgcttacgtttgcttacattattagggtcatcttcaacttctggtttctcaagaggaatcttttcaagcctcttatccattttgttgagactagtttcgttaaaattggataatacaatccaggcacacataaaatgccccaccatcaaccgtttgttgcttggaacttgccctcctccagaaggatagttcacctgatcacctgacattcacacggacagagggtgccagtgacagtctgtttattaaatattagtaatgtttggtttcttattattttagataaacaataaataggaaacagccgtattccagtggattgttttatctaccctagggtgcatgcagttccctttggagactgctaaactagttgcattagaaaaaccaaaacctaatttgagtctacgtacactgctgttgaacccaaaaacctaactctagaggtgagatcatattttaaacaccaattaaatggctcctcaattgttagagagcagaaggacctttaggacaattcagttaagaaatattttagtacagcaaagaggtcagatgtattttttgttgttgttttgtttcatttctctttgaaatgaaatgagagagagagagagaggtggggattggagagagaagcaaagcgagaggggagattaaagatgatgccttggacaagccagagctataagtgaccaagcctggagcctgttgcctaggtcactgatttcattccacagtcagcctcctcaatagctcttgagaagctgggacctaaagtgggctgcaggctatgccttcctggagctgaaggctgctgggggaagtgcctccacagctccagggcaggcagggctcctcccagctgagggcaggtgacccacagacactgtttggtgccctgtgttaaacatgtgatgtgagaactcacccagtgcacttcctgtggtgaggcaagaaaaccagtcgtcagcagaattgggttttatttttaaacacaagcaaagccggtggggggtcggggggtgggtgtgcagggaggaacagagggggtaagatagcatttcggtggcttggaaaagcaatttatagggtctgcttgactttgtgtatttcaggtagctgcattagtaaaatatttctgactgatgagcaaatgctgaagccaagatttagagtctctgtgggtgaggggaaggtattttccatgttatttaagagtatgaactcctattcataaacagtggctgtgaaccttctctgtggaatatcttactgtgggtggctaggttggaatacgttaacaaaggaaggagggtgcctgattgctgttattcaagtacctgatgttcagctagcactagaagttgaagcagtgggggcgtgtgtttgcgtgtgagtggttcactaagagctaatatggaagtgttaataggaaagccatccctaacggacactgtgcccccatgatttaacctttaaaaatgtgctctcatagttcctggagattgcttctttaaaatgcattttaattacataaaataaaggggaaaagacagcagattgaatagcagaaaaatccatttgagtttataggtcagatcacgttgtaacaaatacaattacgactcatacctcagaaacagtaaacgcctgagaatccagatttgtctgggaatggggtactttcattaactgaatagcttggttattagggagttactatagaaactccaaaccagtggtttccccactctgatgtgaataagaatgaccttgtgaacctgcaaaaaatgcagatctctactccctagcccaagagattctgattcagttggtctgcatgggccctggcaatctgaattttcttttcataaactaacctttgattgaaaaagtaataaatgttgaatccacctgaggggaaagaatccgtggggggtggggggagtctaattcaggtggactagcaaccacctggagaattaacacacagtaaaatatgcttagcaataaaaccagaaggatcataatgtgtcatctggagattctgcactgtcaaagtggtcactttaaatataaattactaatgtatagaactgtgaaaaagtttcagcttatttagaactctgctgttttagactctgattaaatgtgttaacaatccatgagaatttaaattttcaaaacagacaaattagggagaagttattagattaaaagaagacttaccatacaaatcatttaaatattgtgatctcaggtacttaaaatataactcaatttgcataattctaagtcacgtgaagctttttgggagcatctttattttgccaaatgagatatctttgtacagtgaggtgcattatcatggcatgttagctactctacctgagctagcatgtggtatcatcgttctaagagacatacgcacacatgcctctgtaaagatgtgctagtctgtacagtctgaactgtaaagttttaaaaaaactaaaaccaggctgggcacggtggcacatgcttgtaatcacagcacttagggaggctgaggtgggaggatagcttgaggccaggagttcaagtccagcctgggcaacgtggtgagacgccatctctacaaaaagtatatatataaaaaattagccaagtatggtggtgcacgcctctggtcccagctactcgacaggatgaggtaagaggatctcttgagctcaggaggttaaggctgcagtgaaccatgatcactcaccccactgggctccagcctgggccacaaagcaagactgtctcaaataaataaataaataaaatttaaaaactaaaaacggccaggtgcggtggctcacacttgtaatcccagcattttgagaggctgaagcaggcggatcacttgagcccaggagtttgagaccagcctagacaacatgacaaagccccatctctacaaaaaaaaaaaaaaaaaaaaattagcctggccctgtggcatgagcctgtagtcccagttacgtgggaggctaaggtggaaggatcgcttgagcctaggagatggaagttgcagtgagctgagatcgcgccacttcactccagcctgggtgacagatcgaggtcctgtctcaaaaaaacaaaacaaaacaaaacagaaacaaaaaccgaacaccaacaaacaaagacaaactggattaagaattttactgtcctcaaatattcaaggcattttatttcaggagggttcagatgagctttctactctgaaggcctaaaaacccaagagcttcatttgttgcctgaagctgaaagagacaggggagggtgattgctgcttcccggtacacctcctcttaccttagatgcaggaaaaagaggcctctaaatgtgtttcccaagcaacccacaagatggagttggtcccctggatagtgagacaagcctttcattcttgcaccctctcctcagctgctatattgatactattagggcgcatactagcctgagtcttctttcaggaaagagagcaagaatttctgccccctttcccagggagtgggtaggagagtcagttaattgaaaatcatttcagagttactgtgggatattaggagatggggacaacagggatcattcaaaacaatcaagatcccagaaaccttctttaggtcagtgtggcctcagattcacatgtaaagactccttggaaaagtccaaagaaattttgattaacatgaatgctcagaaaacataaggagctctggatagtgggattttgtagtaaatagtgaattaggcagaaagattttcaacaggaggtgaaaaagtttctacctcttgtttgaaaatgtttctaaaatctaagttcattctaaaatataagtccctcacttactaagtacatttttaaaatggcacctgggctgggtacagtggctcatgcctgtaatcccatcactttgggaggccgaggcaggaagatcatttgaggccaggcattcgagaccagtctgggcaacaaagtgagacccccatctctataagaaattttaaaattagccaggtgtggtggtgcacacctgtagtcccagctacttaggaggctgaggcaagggggttccttgagcccaggaggtcgaggccggctgcaatgagctaggatctcaccactgctctccagcctgggcaacatagcaaaactttgtctctataaaaaaattaagaattagctaggtacagtggctcaggcctgtagtcccagctactcaggaagcttaggcaggaggattgcctgagcccaggagttcgaggctagagtgagccttgtttgcaccactgaattccagactgggtgacagagtgagatcctgtctctaaataaataaatacatttgaatcttgatttgctggataagacttttataataccacaaggttctcaccttcattggctccctgttgcttccttggcatgtcattcagagctctccatagatgccctcagcctagtctctcattacttctcttttgcaaaaattgccaattcacagtcctctgaacacgacttgggcttttctgccttggggccgtcataacattttttcctcatgcctagaatatcctccctgatctctctctctctctctctctctctctctaggtgctctgttctatcccaacttaaaaacacagcagaaacatgtctcaaatactgaggtccacagtggtgtctacatctttgaactccctactgtagattcctcctattcatggttgctggaaaacacttgtgtcctgctttgtggcatctgttgggctatattctcatttagctttgtttatataggccctcaatcccttctctgaacccttgggtcagatgggattcagaatttagacttcttattttagaaaaattatacaatacatataccacatattatctaacaaccaagtagagccttgagaagcatcccataatcaagcacctcatgtttctataataaaacatggatttttaaactaagtgagataaagatgataatataacctcacatcagttcaagatcaggttttgccaccaagttagttacattcaagaaaaaaaaacacttttttattttaagaactttgtggatttcaggattatggaaagggattgtggactggtttacctaattgtagtatgagctcctttagcctgagtggtcttgatcataccccatcccacctcctggcctccaaattacagatcgaacacactgccagccagagtagatgtccaattaatatttacctaatgactaatttttttagcctttgtcctagatgtctgggacagtgaatgggaacaggcataggtgacaagagtccagcctcaaaaaagcccttgaatctgactttgatatctaatcatctgtcttttttttttttccacaagtggaggacagccaaaacaaagcaaactagttatttgttcaggtaatggggaatcaagatggaggtccaaaggtctgaacattacatgattccatgaagctcttgaggggagaccacagagcttacctttctgaggtctcaggggagcaagcaattgtttagaagcagctgtccattttaaggaaactgttggttttcccttctttattttcaacccctcagctcttccgcaaataagacttctcactccatccttgcagagaacttcttctctagggggcaacaatgaagtccttgttgcttggaggtcacaattctactagcactggtcacaaatgcagcgaggtgtggctaaaagaactcaagctgttattcaggggacccgagagctagtcccagacctaccattaacttgctataagagggcatacatctttacaattatctatgccttcattttcctgtctatcaaatgggaatgatatgaattccaccaaactccatagtattcctgtgaccaaagtagggggcaagtgcttctttaacttaaaatgcttttgaaatggaagattgttttagcaacactggtgagttcattaacctgtcatccaggtaagtgaattcttccagccatgactcaatacgtattagttccctgcctgctgagctctaatccatcttttgagcgcatacaaaaatgtctcctcctctatgaaaccttagcactaccatttatttagcagcctaccttatgcaaatcacactacatacttcatctcatataatcctcaaagcaaccctgtatggcaggctctattatgattcccattttatagatgatgaaaccaaagcacagagtggttaaggaattgggccaagggcacagagtttataagtagcagagccaggaatatattatattatatataatatatatattataatataatataatatatataatattatatattataatataatataatatatataatattatatatattataatataatataatatatataatattatatatattatattatatattatatattatatatatataatatatataatattatatattatatataatatatatataatatatataatattatatattatatataatatatatataatattatatatataatattatatataatatatatataatattatatatatcatatataatatatatgatatataatatattatatattatatatgatatatattatatatcatatatattatatatgatatatattatatatcatatatattatatatgatatataatatatttaatatatataatatataatataatataatataatatatttaatatatattaaatttatttacctaaatatatttaatatatatattaaatataatatatattatattataatatatattatattataatataatatatatatattatattcctggctgcgtgaattattccctgctcctatagcactttgtttttacctggtctgtggtccttaacccagtctgtctctcccttactagaccgtgagctcttggaggacagtagccatgtcttcttattcatctgacataaagctagtagtgaacgtcagaaaactgaatgcattggagtggaatagaatagaatagaatagaatagaatagaatagaatagaatagaatagaatagaggagaaggggagataactggatgaagtaactggctggcctgggatttccagttctggagtgccttgtctttccagacaattccacaagacttccacccacctcttctggtcactgccatcagagagttatttgccatgagagaatatgaggaatagagagtgtctttgcttcctgtcttaggacaaagactgctatcacgattcaggagacattctgcgaatacctttggaagctgatgaattgttaagtaaaaggacttatttttcccgtaagaagctgcctccaaatttctctcaactcaacaagtggcccagagtgccaaaaggagagactattcatggattttctcctaaaaaatagaagccgtggaacatcagagggggagacaagatggaacaaggaaattctcttagcacaaaatagagcacataattataagattttccagctcaagtcaggttagagtggctcaaaagttaaatggctgtaaaaataataataatcactagaaaaaagtaatatttactgagtacttactgtgtaccaggtgctgtgcaaagttctttgaatgtattatcctggttaattctcacaaaagccctataaggtagtcactactgtggttcctatttttacaatataagaaaattgaggtttagagagcttaaccagtttgttcaaggttacacagacatagaagagctggggttggaagccaggctagtgtgataactaagttttaatcagtatattttatggcaacatattttaattatatctgaaataagaccaggtgggagacaggcattgcttgactgttgaatgaggatgttctcagtagagtcttggatattaccctcatgcactgcagcatctgtttcccaagagacattgctgtctgagtggccctgcacaaggagtcctggagatttacattcattccttccattcattctctcattcttggggtctgagacagccacccagtccccctacactgccctaccaagctcctgcccagcccttgggtctcttagattcccaaacctaggtgcaaggcttgggggtctcaaattgaaatagatgtccctgtgagccaaagtaaggctgcagatggaaacccagaccattagtgaggctaaagagaaaagtaacttcatcactgaacttgtgttaagatttattggtccgttctcaccactttttacttcttccactttcatccccatcaacagctatcagttagtgatcattttcatctaagactggcagactcagtcttctaatggcagagctgagagggcagtgagatctgttataccaagccataatctcagccacttagacaggaaaattgtttttagggttttacactgccatttctgttcaccctttaatgaatgctttctgtccataaatgaagcagggatggaagaaggggtgaataagtgctaacataaattgcagtgggtcaaccacaaatacaggctttcaaaaaaaaagatttttaaaaaaattttttagtgtgggttaaggtgcttcctgatttctaaagtacttcctgagttggattggtatgccagatgcatcaaaattgcttttgcaaacctttattttgtgatctatacatcaaagtggaaggtctttttcaaaaaaaagataaaaataaaaatataatgtgtgcttttcatcattatatgtctcttactgactcaccagtcacatgctaggtaatagatattgcaattgaaataggcaggctctgaaagctatggttgacctttacttttagtttttgggcacataagtttcttcttaggtatgattcatagctacaagggaaaactggcaaatggtgggaaaaatacttttattgtacatgctgtatttgtgtaagtaacagctgcatgtggctttagcaccaatacctttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagttttttcttttatcctgaatcatatgaaggggctggaatgattgtgtggtcagcctgactgtcatcccacatactatgtatgccatattgctttgcagctcggctttggatcgttccttggaatcattggatcaaaccttattgagaacaaaaggcagatggtaagttttcatcccttatagagtcaagttcttcctctaaaaaagcacaacatttatgtggataagtaacacatttcttaagtttgtgtgatttggtcataaaaggaactgctactttgccgtttctcctaaacctctagggaatgtgttttactgtgaccctgtgatatgggattggttctcatcttgcttgatgctccctcactggcctagctagattccttatgccaaagggatagaatattctggatcttgccctttgctttcctccttactcccaaaggagtgctccaacctatccaatcaggctatggtcctcacctagaatgcttttgcttacatttctgttactacagccctggattattggtggccgtcacatctttctctctgatacataatcttttgggcaagttttcacagagagttcctgccttttaggagattacaatatagcagactttgatttaatgagcaagtgtacttgtggcacacacaaaaaaagataaaataaaattataaagccatcctaaagtatctccattacccatagttcaaagctaagcatgttgtaagattgaaaggaaggacaagcatataacagaaggtgaagcttctatgtcttaacaggggcccacaagggcaagctgttatactttcctggttcaatctgaaaaggctccctcaagggtaaaggtagaagatatagactgaattgcaagcatattgcagttttatagagttgtaaatcaagatgcctggtgagtggtcagatggtgattgggctccccctgtacagtctctgtggcactgaaactttgacaatggggtctatttcacagcaagtttaatcagataacgtaatagctccaaggacagagaactctaaccatatgttttcccccagcgatatggggaatcaccctcaagggagttctaatagtttttttcttccatttcacctgggctgcctccttgccagttgtgtttgcactttaggcttaaattattcaaaataatgggggaattttaattgtagagctgatcatagcatagctaataatgtcaatttcatgacattgttcatacattatttaccaattctctgtaacactataaagtgagaattatggggagaggtttctgaacaactcccaaaggagataagtatttcctcctagcctgttgaggtgggagaaccctagggtggccttgattttttttttttcgagatggagtcttgctctgtcgcccaggctggagtggagtggcaccatctcggctcactgcaacctctgtctcccgggttcaagccactctcctgcctcagcctcccgagtagctgggattacaggtgcatatcaccatgcctggctaattttttgtatttttagtagagatgaggttttaccatgttggccaggctggtcttgagctcctgacctcaagtgatccacccgccccagcctcccaaagtactgggattacaggcgtgatccactgcgccctgggtggccttgattttgattttctccttctccctggagagcagcttgatgccatgtgatctccccctcttttcttccaaaaacctcagggaaaaaaagtgctgattccatctagttctgagggtcaacacaggcaggcggtcagctcaggtagcatctatctctgcccctggaaaagccttgaaattcctattttcccccacatttggttgtagtagcatctttgtaatagtagacaaattattaggaaaatttctgttatctaacacaattagagaatagggtagcctggttctagcaaacatttgtcttacttgaaagtttttatatgtaccatactggctgtgcatagtggctcacacttgtaattccagcactttgggaggctgaggcaggaggattgctgttctcaggagtttgagaccactctaggcaacataggagacctgtctctaaaaaaatttaaaaattttaaaaatatgtatcatacaacgttgattcagagacttcaatcctttgtaaaatgtccttgacatgtaagtcttaagttgaatgtcctgtttcttcagtgttgcagaaggtcatgtaaagttttgcaggaccccggaatcatcattgccttcatcagtgcccactatagcatcaagtagcagtgtgagggggtaaaaagaacactggattaggagttggtgagcaccaggcttttccacagactagatggagaccctgggcacaccatttcccctcactgtgcctccatttctacataaataaaatagaggattgaactacctaatgtcaaaagtccaacattatttctgagtccaaggatggaagggccgtgcagtcaaattccttcatggacagcatgctagataccagcaagcctcctcttcatttggtgctcacagagtgaatttcttagctttccctgaaaatgtaaaaattgcttcagttgcccattctctgcctcccctgcctacctcccttccactcatcctgcatgaccaaaaagagcattcccatggggtggtaggctagagttctgctttggctggaagtctcttggggattgcctggtccccagaggcagcaagtgcgaaaggctaacagacgcttttgttttattcccccctacagctggtggcttctatcgtgtttatcagctttggtgtgattgcggctttttgttgtgccatagttgacggggtctttgctgccagacacattgtgagtattttttcgtcctgagttaaagtaaataggcaatacaacaaggccccactgaatgtgtgctcgatgttcagtcctttgcttagtgtcatgagggttacatgagagggagaagacacagtcccttttctcaaggagttggcagtcaaggtgaagacaccaatggacacgcggacatctagagaatgaggtctaagctgggggaacaaactccaagtgccatagtggcttatcttggattccagaggtcagagaaggcattcagtggtggtagggctggagctaggcctttgacacgtgggtaagatttgagaaggcaaaggatcaggggaattgcttagaactagtattgggggcaacggggtagagagagagcaccaagaagccacatgacttatggtcaatgccgtcacccaaatagtctatgaaatggcatctgaagaaacaattcctgggcaaggagaaaaacaaggaatgccagagaaaggccctttgcctgattttctttcaggaccaggaatataaatgtaggcccctctaccagatccatcccttctgattttagctgagatcagccatctttttcatcatctttttcttcttataaagcaaatgacacatcagtaactttaaacatccataattctaccaccctaacttgacaatttttattgtttttgcatattagctgctgagtatatacctatttttgtagcatagttgcagtcaatcatagtatgcatactattttgtattcaacagaagccatcttaataacaataattccttgttttgtgtagtgcatttagcttttcaatgtgacttcacatctattacctcatttgaaacccacagtaatcctgtgatatatatagggcaggcattattatccccatttgacaaacagtattcactctgaggcagtctccatggcaacataggcctagtggctaagaagcctgcagtagattttgatggcagcatgagctaaaatggcttccttttttcccctcttcccctcattcctaatgttgtttaatagctttattgagatataattcacatcccatacaattcacccatttaatgtgtataattcaatgatttttaatatatttagtatgtatcagttatttatgtgcaaccatcaccacagtcaattttagattttcatcatcttgaaaagaaatcccataccctttagctttcacctccacattcccacattctccccagacccaagcaaccactaatatactttctttgtgtaaggtatccctattctagacatttcatattaatagaataatataatatatatattctcttgtgattggtttctttcagttagtataatgttttcaagattcgttcatgttgtatcaagtacttcattccgttttatggactaataacattccgttgtatgggtataccacattttctttgtccgttcactagttggtgtacatttgagttgtttccactttttggttattatgaataattctactgtaaacatttatgtacaaatttatgcatggatatatgttttcattttcattttcattttctttctacctaagagtataactgctggatcatatagtaagtatgtttatttgtttgaggaactgccagagtattttccaaagtggctgcactattttacattcccaccagagtgtttgatgggtttgattttgctacatactcatcaactctcattattatctgactttttgattccagccatcctagtgggtatgaagcagtatctcattatggttttgatttgcattttcctgacattccaatgtttttgatcattggctccagtcaaaggcaatgggcaaaaattcaaattatatttactggaagtttcctctaatgaccactacttgcctctgagtccaggccctctgtacctcctgctgctggtgacctgcagtacagcatttgactcaagtatttgggggtacgactggatgaatatttaagaaaatctttctgcttatactatacctgccctaagacattggctagtcctcattgacacccagagagctttgaggaaggaggctttattaatctatgatggtatctgttggccaacttaaatgaaaggcacatttggaccctagcacagcttggatgggtgagagccagctgtcctattgttgaggccctttaacatcatctttccctgttcctttgacttgggtgaatctgaacttcctctcaagacctaccaccttctcactcacccttctctatgtgtcttgtgccatttctcttttgtctcatatttctttcctttcccctctccctagtatagccattaactagcttggaaaatcactttaccttcttgtaccatagttttcttttcttctaaatggatatagtagtaacctacctttcagggttagcatgaacgtgaaattaaataatgggaatggatatgccctaagagggcctggcatagagcagacactcaacataaaacaatttccttttctaccccttcatgccatagttggtagcccttcagattacagaggttgccaagccctggctgagtgaccttttcttgcctcccaattgccttgttcttgttactcttctgggcctcaatgaagagtatcagccagaggcagcaaatgggcaactatcacacgtctgtcttcatgtagggcacttggtgcctgaatgctttttgcaaaaccaggaggtgagaagggctgtgaccagcacattaagcctcctcttcagcaggataattatgataattattctgccactacccaaacaccaaacatggacaataagcccttccaggtgtgagcatgaacaccctcattcctttccagctagactccaagctaagctaacagggcaaggtactttcagaacattgagcaggcaggagtttcatgtagaagtagctagctgatggaaagtcctagaaccttaatggggaggccggctaaaaggcaggaggcatttgagtgccaagtacaaaagacgctaaatcacatgtgtggggaaaagcagccactgagatgatcgtaaatggtgaaagaagtgggggcagaagggaaggagacaatacataaattccctctgcctgggtacttctgccaaaccccaaggtcaatttgcataagttgtttgtcctgtcctaaggtgcctttggaagaagccccctaccactcaggggaggtttagcatcagtccggaaagtgaacagcagctcctgcctgcaagcttccaggcagccctggcttgtgtctattggttctaccccaacccccatgcatgagagctctctctcatcaggaagctggccaagccagcagagtaaatcgactgtccttgagccccatgttagttttctgagacttgaacagtgtttttggagttcactgattttatctaatctatgcagttgggtgaaaatggctcacagttcaattgagttaaaatctacagcagcctcaggagctgcccctcctcctgaggcttgcttcctgagctcttccttctgaaaatgatgcggaaatgacagcaagaggtacaagtcagccaaccatagtcctgtccccaggtgataatgaaacctcattgttggacttgagctctctctgcttgaaagtgtcatttcataataacctggagttttgcatcttgttccctgaggactgtttacaagaagacaaaggccagaagtaaaagaaaaccagagaggaaatttcaagaagcccatttctcaatcagtttcataatttctcattaaccaagtagtctaatagaaagtaatttttaaagtatttttgtctaatcttcactcagtctccctagacaggtgactttcagaaattaacccaatctactgcctgcctgcttctgtgtgtgtgtgtgtgtgtgtgtgtgtgtattcaaaccttttattaccaagtacaacacttgctgttttattttccaaagtcaaaacccctttgttttggtgtttcccttttcaggatctgaaaccactctacgctaaccggtgccattatgttcccaagacatcacagaaggaagctgaggaggtgagccagaatgaggctgcatgtctttacctcctgggaaagtcccctgttctgcctgaaacaccctttcttttactccttttcatgggcctaagttttatttctaggtatgtatagctgatttgttcagtgggtcagagcacattgctaatgaggccatggtcataggttggagcctcatgaggcctaatcagttttactttgttctgtggccacaggctgaccctctgaccccagccgggagcctccccatatgtggctttgatcctcagggggacaaatgagagtacagaggccacaggacatgaccctcccccatctctgtggatgatggttcagttgcctgaactcagtgctcagttggaataaaagtggaagccccaccagggcactaggcctgaactacggaggcagagcctgagttccacacataggatgggtctggaagccaaatgagggtaactgagaagccagatccacctttatgctctggggaggctgggactgtcagcctggcccctctcataacacctccaagaggccagcctaataatgcttgagcatgcacagatgagtctctcttctgccccaaacagctctccttatgttccatgttgcctcaagcagagctagatgcaatgcgtagtgaggcaaagtatgactccaggtcatttttggagagctttcatttcagtatacaataatcccttcccaacccagggatttctccatatgaaactgtacctaggcttccaggaatcttgacaattttgtactctattaacctcacattgaaagtcaatcattcccaaatagttagaaaaatggtaaactttcagttgggaagagaaaaggaaggcaattggatgtaaaatggccactgcattgcacagcttcaggggaagccattttacataaaatacaatgtgaatgggtgcccttggagtaaggcaaagcagtcctgctccaaaggcaccatggcaaatactttgattatgtctctgccatccacttgactcctttttcttttaacaaccataaatttactatttctctcactgttctcaggttagataggaggaatagaaatgcatatatgataacagcttatctgaaaggcagtaagcatttggatgaaggacccaatatagaaaaaaatgcccatttgctatgaatattctctataacaaagcaagacaaatttagcagcacttcattgcatctggatgggggagagagctggacaatttcttgctaacaagagatggtaaatgaaattcttttccgtttttaaaacctttttgctaactcaaaatgtgtaaaatgtcattgctgttctctagattttgttgtgatagctttcttgcgttaatttggtgactgtaaaaatattaataatgacttccataggttcacttgtaaccctggtccccctaaccctatttttcctacataaggtcataagttcctcaaccaaaaattctccttccacgagggttatgaggaaccttacccaggcagctagagaggtactattgtacttcagagtgcatgcgccggctcctctgtcttccttcccaccttatcttctttcctcctgtaccctgattttgcctgccctcatattctcatttccttcagtccatttgttcttccgtctgtccttccatctgtccttccttctctccatctccaccattcagggatggggcactgagggctgtggcagaggctggacatgagcccagctacacagtgacttgcctcatgcacaagttcggccagctccccatccagccccatccttcccacacattgggtgttcatttcaaagccatccttactgtctccatcagtcactaactcgcatttccaatcccagagggtcctgcttcctatccaatgccagctcatctcctcactgttatataccgtcaggttaactgccctcacctcagccgtgaattctgcacacctcgcatccggggcaacacctgcttctgctgtgacctctacaactgtggcaagtaagtgttgaggcccagacacaggaataatggtctgaccacaacggacactagaagggctgaggttaaggaagggtgcattgtgggaattagggaagtggaagacattgatctgttaacagattttggctaacagacattacttgccttctctgtgccaggcatcatgctaggtactttcacatacttgatctcatttaattcttacttatgatgtatgcagagtaatcctcattttatagatgaggagagtgaagttcaaaggaaacagacaactagcccaaggttacacagaacttgaaaataatatgtataggattcaaactcagctctgtctatatccaagtttaacaatgttcaataaatagttactgagtaccttctcggtgcctggctctgttctagacactgaaggttcagcagccaacaaaacagaagtcctttcccctgtggagcttatattctagtaggggagacagtcaacaaatacagaaatatataatataatgccaggtggtgatcagagctctgaagaaaaatgaagcaggagaggtagatagtgatgaggggtgtgtgtgtgtgtgtgtgtgcgtgcacgtgcacatgcacgcacactgtatgttagatagagtagccagggaaggcctctttgagcaggtgacatttgtgcagacctgaaagtagttgggggtgggtgggcaacccaggtagatacctggagaaagagtgcttcaagcagagggaatagcaagtgcaaaggttctgaggcaggagcagttttggtgctggttctgctacagccactctggctctgtgcactccaaattgctaaaacatcctttattctttctttcaaaatatatttgggcgctaggaatacagagattgccactgaagagctcgtagactagtaaagaggatggacatgtgaacaatcgattgcaatataatgtgataagtgcagtggggatcagtggatgtggtggggattctggaggcccaatgaatgaaagtcagagtttgccgggagggaaaagtgtcaaagagtaggtgatatgggagctgagacttacagaataagtagggaatcaggagacaaaccaaaagaagacagaggtgggaaggatattcctggtagttgtgaagaggtagtgggtggaggtagttacagaaggtgtggtaggaggtaagacagaggtgtagccagagatcagatgatagagagctcattggccataggaatgacttcagacttgaccctgtaggcaactgggggccattgaagggtacagcatggaagatggaattgagtggttgaggaatggaggcagctaggaggccattgcaagagcgcaggccatagagaatggagcctagatcaagttggagacaatgcaaagcggggaatcattttaagagcaatttagaaggtagaatcaatagggatgtgtgagtaggtgatgtgcacagtgagtgaacacctctccatgcagggtatgtcgaccaatgttcgtcatgcacgtatttccttcagaatcttagtgaaggcgaactgagggccacgggagggagggagtaaggggaggaacctgcagagtggggctggatggagctagattcagaggcagcaagtggatgcagccccctcatcactcacattccctactgtcggtattttggggtcagttactctggtttaaggattaagacttgccagactagagtcagggaggagaaggcagagaccatacaccagctctttaccttctttgcttgtgccagtcttgtttcattgaaaggtttggcagtggaggaagagaaatttacagattcaaatgaggtttagggattatctggggagttcaattatttatgttgtaataataaccatcacttgtaaaggacttccctccttagcagcaatgatggagagctggctataactgtacttcctcagcccatccttacaaaaatgatcaaagaaatgtaacacgggtcctaggggaattggggttattttactatctttcctcttgcctcccctcatccttccttccccgatctgtctttccctttgtttttatctcctccctcttctctccctcctcctgccatccttctccattttccttggtgctctcctctcctttcccatttcatggcctcctagggtggtgctgggagctggccagaactgggcctgagatctcaaggagagaggaggcccactgagagggttgataagtgattccttgcagacacacctttctctctgtgacagtgtgtttctgaaaaaggtttgaatacacaaaaccctactttaaattccatttagctgagtcctcaggtgaattgtttttgaaagtggaggctcaagtccattctatgttcctgtcaatctgaacttcataaaaattgacttccttactttcttaaagcaagttataccagaagagtcttcaaggaattttatgaggagctgtgctaaactatgcactccccaagggcagggagcatgacttaatcttatctatacttccctggccccagcacagggctgggcatgagtaaagagccgatgaaaagggagtgatatttgttgaaaaggaacaaaaagaagaactcccttttcactggggaaaataaaatattggactaggcaactgagaggggtcatgggaacagtcctactaaagatcttcaagcctagaaatgtctttcacctacctagtgcctggaagccagccccggacatctctcaaagccctttcccaagtctgtagtgctaagattccaagggcaaagccactagaaaaggacttccttagcttttcctgaggaaacagtcccaccaggccataaacccaggctgagactgaagaggcgagggtcccacaatagaggaaaatgttttttcttgacctggggctttttccacccagagccaaagagacctaaactcaaggcctaaatatagctagcaataagcattctgaggcttggagactttaattttgccaaatgtgtatttgttttcctcacacgaagcctatttttaatcaattgccagctcctccggtccatttcctggaaaggaggccaagaaaaaaaaagtgggaacaaaaacatcaggcagtcatttgtacagtgctacagaaacagagtctctactgtcccctcgaacccacaggccttctttgacgtcaggggtgttgaggttttaataccaaacatagattattctatttagcctcatgcaggaaggtggctttctctaggacacagctcctcagcagttgcctttcagagtacttcaggctttcacctactcactcatctttggaaaggtcaagtcaatatcactggttttcagcccgtaacctaaaggaaatgaagtgatttgtgaacagcatcagctggtaataaaatgaaagaagatagcctacttccattcactcttttcttcgacaaacttttcttgagctcctactatgtgctaggggctgttctaaaagaatgggcatcaataagacacagctttgcccttaaggaactcaatttgccagggagattgaagggaaggggacttaaacgtatatgcagaatgcatgcagcaggagagagacacatagaggctggccattgccactgcctgtccaccaagaattggtgagtgctccaggcccttatggaagagcagaaggatgccctcctgccttatctaagatcttctgctgcctactttgttaagtaggagactgaaacacagagaacttatccgtttctctaggtccacccagaacgttgagagcaagggggtaaaagcccacattgggtaatcaatctcatgatcaatacagtgattagtctttgcactcagttactcattcaccgagtatttattgacgacctttaatgtttctaccactgtgctaggcagtgagagagacacaaaggaatgttaagagacgaccctcgccctcaagaggttgcgattttgacagaaacatcatgtcggccttggccttgattgtaacattagcaccagcacagtatttagcactgatacgctaccaacacatattagattaaataaataactgaattattgatatatacaaagtgccaaactaagaggaatagactatgggagtccaaggaaaaagctaatgaatgggtagtggcgtctttgaagaaggcactattgaagctttgagcagtgagagagattaggataggcagagaacagaaagcaataccttcaatgcagggggagaaatctgagcaaaggtttggaattagtacccagcatagccagtgtggggcttctgtggactccagcctggctggagtgtatactccattttgaggctggactttggcagactgaggaatttgaacactcccctgaaggtactggggagccacagaagggttttgattaagtgaatgacatatttttaaaagtgttttaggaagagtaatcaggcagcagtggggtctggcaggacagccttacagtgatggaggcatgaggatgggagcagtgggaatgcaaaaggtgcaatttcagaggaagctctgcccagagactgaaccaaatggaatcctgaatctcaagcagaaaaaaaccacattaatttgctaaacccgaaccatatctaagaattagctttcttttccttcatggttcagtgaaaaaaaaaaattaaatggctgctggaaccactcaaactgaaaccaagtatatattatctaaaattattgaatattttaaaacaaactactatcctattcccatattgcggtttgtgcctacaaagtcttaatactggccagggacagtggctcatggctgtaatcccaggactttgggagcctgaaatgggaggatagattgagcctaggagttcgaggccagcctgggcaacatgtcagaaccgcatctctacaaaatttagctgggcatggcagtgtgagcctgcagtcccagttacttgggaggctgaggttggaggatcacttgagtcaaggaggttgaggctgcagtgagccatgaccataccactgcactccagcctgggtgacagagcaagaccccatcaaaaaaaaaaaaaaaaaaaaaaaagaaagaaaaggaaagaaaagaaggaaggaaaaaaaaagaaaaagaaaaaacccaaccaaccaaacaaacaaaaaacaaaataaagtgttaatacctttaagaacagggttcaaaggtttgaattgtgttgccagaggctggctcttagaaggaacaaaatgtagctacatattttagtggaggcttttattatatgttggagtactgctttcatgcctgttggcattacatcccccgggctcagagaagttaagtaaagtaagtaacctaagagtaagaaagtaagttgctagagtcagcatctggtgacagagcatagatgacagagccaggattcgaacacagtctgacttcagagtcagctatggcatactgcctgcctatatatactactagtccacccttggtgttttaggaggcaggcaaacataatttgggggatgtcagaagttgactcccaagctacaaaggtgctcctgcagttccacactcacccatacacacaggtctgtccttttcagagaatagtccttgtacagctgtccgtttttgggggcagtaaataatctgtgcatcctccctgccctgtccccagggcctagtacaatgccagctaataggagacaatgtatgcttatgcatgggctcttgagatatgctcctgaaaatactgaaatccaattcaaactctgattaattgaaactcccttaaaattccactatgggccaagtgtggtggctcacacctggaatcccagcactttgggaggctgatgtgggagtatctcttgatgccaggagttcaagaccagcctggccaatatagtaagactctgtctctacaaaaaatatttttttaaaaaattccactacggaagcttactattaaaaacagtgggtctcaaacattgatgaacttgttaacacagattcttgaccccatcaccagagattctaccagattcagtaggactggggctgggcctaggaatctgcatgtttaaccatctctctttctcaaagatacatgcacagatacacgcagagacacccacaggcacacacaaataatgcactgatacaaacaggcaggcacacatagacacaaacacagatgattctgatgcagtctgccctgtaaccacactgacttcacctccttagagaaacactgactttaaagaatctgaagataaattcatctgtaaagtttaagtcttttcatatgtgaatagtccctctctgattcattttggagatcagcctttgattgtttttctgttttcttttttgcattcttatagcaggggagtcacatgtaataatcatcctaatgccagggcgtttcgttgtgactttaagtgttttagattcgtgatgaactccagtggccaagttgtaaactagtttgtgacatccaggaggacaggaactttcatttaattaattccacaggtatttatgtagcaccaactgtgtgtcaagcacagcagtgagcaaaatgaaccagttcctgccctcatggagctcacgttcaagttggggaggcagacaataacgtagtagacacatcagtaagttattttcatatgggaatgaatgctacagagaaattagaaaagggtgatgtattgcttagctcgggctgccataacacgataccatagaccaggtggcttaaacaatagaaatgtacttatttctctcatttctggaggctggaagtctaagatcagggtgccaacatggtcgagctctggtgagggctctctacctggcttgtgccacttcccctctgtgctcacagtgacctttcctttcacattcaagtagggagggagagaacgaaagtcggggtcgggggtgggtgggggaggggcgtggagtagggaagtcaggggagaaggagggaaaaagaggaggaggaggaggagagcgagatcttccttttcttataaagccaccaatcctatccgattaggaccccacccttgtggcctcatttaactttaattatcttctaaaagccctatctaaaaatacagtcacattgggggatagggctttaacacatgaatttggagggacaaaattcattccatagcggataatgtgatagagagcgacagggctgggaaggggtgtctttggacagagtggtcaagaaaggcctccccacggaggcgactttcaggttttgtgtagcaactcagctttagttgtttaccaggacattggtttttatttgtttgtttttttgtttgttttgttttgagagggcacacactgaagtctttgaagcctgaattcaggtcccagttctaccacttacgacttgggcaagttctttaacttctctgtgcttcactttcttcatctgtaaaatgtgcatggtgatagtccctatttgataggatactgtgaggatttgcagaactttctgcaatgatggaaatgttctgtaacctgctctgtccagtatagtaaacactagccacatgtgactattgagcacttgaaatgtggctggtgagacttaccaactgaatttttctttttacttaattttacttaatttaaatttaaatagccacatgtggctagtagctaccacattaaacagcacagatgcaatgaattcacacatgtgaaatgcttagcactgtgcctggtacatagcaagtgtcaataagtgctatctaggattagtgttagtggtggttacaagtatttttctggcaggtaggagttttttttcggggagtggggataaacaatcacactttgatttattatagtacatggctatgatgtctcttactgtagctccccacctgcccacctgtcttttcactgagctgtatggtagcccaatcccagagttggggagggggctggggaggacagcctgctccctggggactgactggagcatgctcctccctgtccagccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatggtaaggaaagaattgactttgcatttcacagtggcccctgttggacatagggggaaggctaggcagttgggggaaatgcagacacatattttgaagggaagaatcagaagcaattgcttcaaggatgtagctgccttcaaatgtctcaagttgaaggagccaggtaatgtcatcagtctgcaaatatttcttgttatacacaaattacctgtgttctggaggcaccttctaggggtggggggtgaaaggaggaaggggtgttctcagttcccccattcgcactggttatgtaaacatagtcttttatagccccaccccacacttttagtaaaattttttgggaatagttttcccctaacaaactttgggagagatggaaggaaaggttattctagctataggtaggattaatgctagtcttcccctccccaggtatttcatagtgaagtttcttcagaaagagcatctgggctcttttctgtttgcattcgcagagccagctctaggctaagttgcttgccaggtcttgccttcaacttggacctcaacctcagcctccccactttccattcttcccttccaaatcttttctatttgtgtgtgtgtgtctgcaaaggcacagcaggactcagcattcagtaggtactccatatagtaggcttctttttttcctttccttctaaggcatttctaagcatttatttgtttatttgataaatctagatctctaattatggagataatagctttgagttatggttatcaacctggcttcatataagaatcacctgcccagcatggtggctcatgcttgtaatctcagccctttgggaggccaagacaggaggattgactaagcccaggggtttgagactaggctgagcaacagcccctgtctctattaagaaaaaacaactttttttaattagctgggtgtagtggcacatatctgtagtcccagctacttgggaggctgaagtgggaggatcacttgagcccaggaggttgaggttgcagtaagccatgattgcaccactgcactccagcctgggtgacagagtaagaccctgtctctaaaaaaaaaaaaaaaaaaaaaaaaatgcttgggctccttctctaaagattctgatttaattggtctaaactgaagcccaggcatcaggttttgttttttggttttttggttttttttttttaagctcccaggtaattctgatctgcagccatgattgaataccactgctttaaatgaacatcccacatctgtttatggaattattttgtgcctaagagggactttcctttgaccccagaaattagctcctaggcccttggctgtttctgtcagattttggggtccctgaagaacagaacctgaaaggcagtttgtaatttgatcctggacggtcaaaaggatgaatgttggaaagtgaaaggtggggtaggacaagggaaaagaaagaaactctgtcgttttggattgcaagtctccagcagtactgggctgactggaactattaagtgttcctgctagtgactctaagtcaagagaaatcctttcctgcccatctgcactctctctttcttctttctctccctctctcatccgcacatttctcttcccagcttccctccccagactctggaatgcccaagcactaacaagtaggggaagcatcaacaaaggtggagccccaggagggaaaaggatttcctgtaaatttggccttgaggaagcttttaggttagagagctgcaaaaaaagctgtttctgggttggggcttctttggagaaaagaatgccctttgttcttggagaatttccccagggggcagatgaaagtacaggtattgtgtggaatctcagcagctttggctggaagagaagctcccaggtttggcgagttgaggagatgggacctcaggatgagtgttaagagttctctaaattgtccctagagctttcaggcttggatggcagagataccttgatgcacaaatggagtaggtggtagctacttggtaggctctgtggggtgcctgtaaggcttccccctctccaattttaccctactgtgggcgctgaaactgccaccatgttttattccttactttaagataagcattgtcctttttctccttgtccactttcaagatgcgtgtattaaacaaaggaataggctagtaggccacagaggtgtttatactttgagttactagtctctcagtgtgaaggatttgataagacccttttccatggtgatggaaagaattggattttgaaggcaaagggcatctgaggaagacagggagagtggctagatggacactttcaagaaatttctggaagttggaaagaagggaggaataggaagatgatatgctaaggaacacaaccctgccaagcttttagccttagctttagtcccgttttccctcactgtccccctttaaaaaaaattgaggtggaagtcacaaacataaaattgatcacttcaaagtgtacaattcagtggcatttagtacactcacaatgttgtgcaatcatcatttctgtctagttctagaactttttcattacctgaaacctgtacccattaaacaatcactccttgttgccccttccctgaggccccagcaacccctaatctgctgtctgtccctatggatttacctattacaggtattttctataaatggaatcatgcaatattcgaacttctgggtctggctcctttcacttatcatattttttttgtttttaaaattcatctaccttgtagcatatatcagtgcttcatttctttttatggctgaataatattccattgtatggatagaccacgttttgtttagttttttatccattgatatacatttgggttgttttcatgttttagctactgagaatagtgccttcatgaacaatcacttacaagtacttgtttgattacctgcttccaattctttttccacctatgggtggaattgctgggtcatttggtaattctatgtttaactttttgaggagctgccaaactgttttccacagcagctgtgtcattttacgttcctacctgcagtgtgtgagggttccaatttctccacatcctcaccaacactttctcaaaaaaaattataaacattctagtgggcacaaagtggtatcttgttgtggttttgatttgtacttccctgctgaccagtgatgttgggcatctttttatatgtttgtgtgcaatttgtatgtatatcttctttggagaaatatctatcaagtttttgcagatttttttattttccaaacaatattcaagattgttaaacaaaattttaaagtattataaaatgtttaattttcattagctttaaggtttatgttacccccaaattttgtatataactgaagtttcaaatctactaacactcactgaattgataccactctggattctaaggcatcagtttcttcttaccaatttttctttgcttcttctaacatttcttgtgtttcatcttgagaatggctaatgaaaacatcaccaatttgataaggtatcattaagcagtcatcatctgcaagcatgatgtcattgcaaacaacttctaaattgtggagttgtttccttttaacttctgtttcttccttcagctctgtgattctactcatattccttgcaaatttgtttacctaatgttgatcttcaaaagtagcgttgaaattttctgcagcctgtaaacaacagcactagtagcacctacctgtggacttgtgagggctgatgtgataacccaggtaaagtgcatgtattagtccattctcacactgctataaagaactgcccggccgggtgcagtggctcacacctgtaatcccagccctttaggaggccgaggtgggcagatcacgaggtcaggagtttgaaactagcctggccaacatggtgaaacgctgtctctactaaaaatacaaaaattagccgggcatggtggtgcatgcctgtaatcccagctactcgggaggctgaggcaggagaatcacttgaacctgggaggtggaggttgcagtgagccgagatcgtgccattgcactccagcctgggcaatagagtgagactgcgtctcaaaaaaaaaaaaaaaaaaatagcccaagactgggtaatttataaagaagagaggtttaattgactcagctctgcatgactgagaaggcctcaggaaacttacaatcatggcagaaggagaagcaggcacatcttacatggcaacaggtgagagtgcatgtgaaggaagcaaagggggaagagccccttataaaagcatcagatctcgtgagaactcattcactatcatcagaacagcagcatggaggaaccacccccacgattcaatcacctcccaccaggtctctccctcaacacctggggattacagggattacagttcaagaggagacttgggtggggacacaaatccaaaccgtatcagtgcatcaagtgcgtaaaagccaacctcagtcaatgggaccttcagtttcccataccctaaggacaaggcctgggctgcagggtcctcatgctccccagaggcaccctcagtactgagagaggtgcccagagccctccatggattccggcctggggaccccctgcctcaacaagccaggtgactaagcaaatgctcagggccctaggtgcagacagggctccccacagagcagctgtaagggctgggggcctcagtcttgggccccacactgagcttcagagctgggcacccccagcatcccacaccctccactcccctgctatagctgagacctggccactgaccaagaatcctgcccatttttaaatctgttttgttgttgttgagttgtaagagttctttataaatagcggatactagagcattatcaaatatgtgatttgcaagtacttcctcccatgctgtgagttgtcttttcactttcttgataatggcctttgaagcacaaaagtttttaattttgatgaagtgtcatttatctatcttttcttttgttgcttgtgcttttagtgttatatctaagaatctattgccaagctcaaggtcatgatttccacatttttgcctaagaattttatagttttagctgttacatttagggctttgaaacattttgatttaatttttatatctagtataagttaggggctcagtttcattctttttcatgtggatatccagttttcccagcacatctgttgaagacactgctctttccctactttatgatcctagcaaccttgtcaaaaatcaattaactgcagatatatagatttgtttctgcgttcttaatttcactgttatctttgatctcctgaggaaaaaatgggtttgctgatggtctgtcttgatagcggcaataatggcccctaaccctctgcaaagtgcttttgcacagttaatcttcactattactactttgtgaggtaggtattactgtctctgtttaacaggtgaggaaacaggccaagaggggtcaagtgacttgcccagagctgagtagcagaactgggactggagcccagatttgccaaatgccagagcctttgctctttctatttcatcccagctgcccctgactaacatttgggtagccctttctggttctatgagtgttttaacatatattacctcctttgtttagttgatttaattaaaaaattaaaagcaagttgtttccacctgttgggagcttctttgacagtacggaaggagagcaagggaagtaccgagcattatcaaatgtgaatcccgggaactctatcaaggaccagggcagaaaaaaaatgaaagcaaagatctggggagaagatctttgattcatgagattagagaaccagtgggggcacagataaggataccaaggaggaatcattgcctagatcactctattaaaataagaccatggtgtaaaaagtccaggaacatcattcaggtgagcctaagtacaatccttggcctacatccaagtgtggttggtgacttgtgatgtgcctctccctgagtagagtccccggggtctgcagggaggcccgggggtgctggctgatgaaagccgtttgcagagagtgaggacaggagccgagggctgtgagctggcagtcttcaatggaatcagctaggaaccaccatttccaaagttgtgggatcctgaaaggaaccctgacaagaggtgcttggtgaaaaagatcttaaagaaatgtttgaagaagtgcttgttgaccaaagatatgaggatttgagatgaatttttaaaaagtgaatatatctttccattttctcctaattggtatcgctggtttagagtaaactggagagggaaaaaaagtagcattctttccaaagtccacaatcattgtctcagaatagactcagttttgtccaggcaagattgctttcaccatttgctgtgctacctagtaaccttttgtgttactggagctcggaatgctactgatcaataatgggggggcagggcgggcgtctcacaacgtaagccccagaattctaacagaaatacacatacacacacacacacacaaacacacactcctatacgtgcacacaaatagaaacagggcccaaatttattgtaaaatcagatttattgatttaaaatataaccagaccactattttggcccatctcttttgccccatccctgactaagtcttcactccattccccatttcctcttcttccttctcttgctggcttgtccattttctctatatcctctacccctgactgtcttctcttcagagactttcctatacccatttaatcttactctcatgtttcttctgtgctgccttctctaaatagtcaacttcctttcaaatattgtctagacccttggccttgctgaacacacaaaaacttttatatagtttacattgtatgattgtttctccacagttaggcttaatttatttagatagaagagctggtttcattttgcgagagctggagggtgtgtttttaattgacagtatgccaagggaacatgatttctggtacttccccagagacagaatttctttaaagaattctgggggagaggtaagggcatttctgagtaaatgtaaagcaagccagcccttggaatggtcaagatctcagccctctttcacacattaaagaggctgacaaacatttatctggctgtctgtgagctgtattatgactgaggtttgtagctcttcaaacctcctagagatgtaaacagtaacccactccaaggaagagagcaacagaactgtgttgaaacttgctggaagggagtttccccctgccaacaccctaacatggttgcctttgtgactgccaaagcctgcctacacattttcatcacttgagaggaagcttctgcttctctgttaatgtgctgtagctatgttccaaaaggaagacacattgatttttcagacagctctcaattatacacatgaatgggggaggtatcaatgacatagaagatggaaaaatcatttaccccacaccttgatccatgtggcacaaagcacagtcctacttgggaactaatgagtagtggtaacttcctttagcagtgctttggctctgatgagagcagggcctccattctggacaaggttagctttaacccttgaagggctacacacaccaccatgttgtgaaaaggatataaaattatgtctgcatcgttttatttgcaaaaaaaaaaaaggtggggggatcaatatatttttcttggtctttcatggcttctgtgcactgctaggattttgcctctactctacagggctgatgagaaatcaatacccttcatgtcttcaggagacccccttagcaaggttgggatctctaagaatccttacaacttttacaaattctttgtgattgaacacactctgtcacagcaagaacactagctggttcggccttctctatttgatgttttgcattttgagtcttattttttctttttaattcttgtttttaaaaatcacacaaatgatttcaacttttctataggtttaaatttttcaagttaaaaagtttggggaaaatgacacaatacaaattagttgtaaacattttgacatatatagtagaaagttaagaatccctatatacctcctaattctactctgctccccagagataaaccacagttaatagtttgctatgcatccttccaggttaatttctttgcatttacaaacatacatacatgtataattttgggggtctttttttaaaacataaattgggatcatgttatattaatgtaacataatggcttttaaaacataaaaatatatcctggacaaccttctctaaataggtccacatcattgtttatcaatagctgcatggtattccatagtatagatgtactaagtttatttaaccattctcctagtgatgactgtttatgttgtttctaatttgtgtttttctacagaacccaactctcccagcactgaactgttctgttgaaaatacccatccaacagtttcttactatgctcatccccaagtggcatcctacaatacctactaccatagccctcctcacctgccaccatattctgcttatgactttcaggtatgttttgggagaaaaaagaactctgtattacccttgttctcactcatgctctcttgttctctccctaaattcaattatggaacctttccattgtctgcatatgtatgaggtagccatgcatctccctaatggccagcagcctgtggttgccagcttaaggactatgtaggcaggcaacgatggcagagatgggcgggtggaagctgcgcaagagaagaaacagagagatggaagaaaaagggagagagggaggtaggatcaaggtatcccaaattgccttaaactacaccaaggagaagataagctagttgggaaatggcagctcattagtacactaccatggacccctgtgcaacagtggctttttccattcccctgatatggggagaggcctaatcctgctccttaacacaagggcattctgagccacacaagggtttgaatcaaacctgtaatgaggaagaagtcccattctttttctccaggcctcctaactaggactacacagagcaatacacagagtatttttataacacccctcccccttttgccctgttatcacgtaagtcagaaatagtgttaacaaatttgcactttccccttttccttttgaactgtgactactagtagaaaaccagacccaaaaaaggcacttacttaaaaggaattcattgcatgcagaacactgaactagacactttgggcaaacaagtgaaatggtcctttaggtatgtataacgattataaacccttgaccatagaagagcaaggttacactaaaatctagttaattcaaactttagagaccaaaggaaataccttttaaggaagggaaactcataataaatttgcttctattgatcaagagaccatgaatgttccatggggacataaaagtacaactatctgggggtacttccaactaaccagccagtttggcaatacaaagcccttgggcaacctaatttcaacttcagtttggcaaaataactgaaacttaaaaatctgattaagttgaataaagtgttgttgtggttggtttagataccgttcagagaggtctgtggctccataatgcaataataatacatatagtgtgcacatgtacttgttcacttttataaaatatagtactagttcaaaaaggtatccattaacccattgatgccagaggttgcaaatttttttgtgaaaaatcagaccttggcgatgaccttgagcaggaggatataaataactcccacaagcttagcgttccaataatgggacactaggcataaatgggttaaagcttagaaaatataatgataaaattcgttctaaagcctactgtgtacacaggtagacaactcaggtaacttgttacccaaataggtggtatagactggaaaacaaaaatatgttcaagaagggcatagataatttcaatagtgaccgaggcaacaaggaattcttcaagagaatgcagggatgttgaagctaaaacaaggaaggtcatcattctcttggggtccctataataaaaagtcatccttaaatagaggagccacacatgggtctagcccaagaggcctcctctacttttatatcaaagtaaattacattgatttcaggaatttgcactttataatgaaccctttaagtagggacaataatacatctggtgatggttaccacaaattataagataggaaacctctcttttgggtatggagccatcattcctcattcaaatcctaccccagaaatgaaagcaagattgagaatgccaacggtgacttggattgttggtttcagttcaatcaatgtttactctgtgttccatgtgccacgcattgagccaggagctgtggaaatagaaattaaatgagacagtccctgcgttagtctagggacttgggggtggggggtcaggggacagtagtggggacaaaaaagtaaagaaaacattacccagaatgctatggaaacagcatacctaacccagaaaagggatccagatttagctacctagtccaaacctatactatgggcttgtagcagagactttggggattgttagaagcctctcctttttttttttttttgagacagagtcttgccctgtcgctcaggctggagtgcaatggcacaatcttggctcactgcaacctccacctcctggggtcaagcgattctcctgcctcagcctcccgagtagctgggattacaggtgcgtgccaccatgcccggctatttttttttttttttttgtatcttttgtagagacagggtttcaccatgttggccaggctggtctcaaactcctgacctcgtgattcacccgcctcggcctcccaaagtgctgggattacaggcatgagccaccgtgcctggcccacccttactttttaataacagctactattcactgagtacttactatgtactaagcattgtgctaagtgctttacatatatcatcattcaatcatttacctctttaagagaagtactcttgcaattgccatttttaagataagatgactgaatcatggagagattaagtgacttcaccaaagtcacagaggtggtaagtgaaagagtaaggatttatatctagggctgactgattccagagattgggttgggggatttttgaagttgtgaatctaagcggagcacagctctttccccagttaattttgggatatttatactttctactggatatttatactttctactggactcatggtcctcagaaagggtctctttactcttgatccccactgaaaaaggattcccttccttcatgcattcctcagaggggaattcaggggctgcttggacactttttatatgtctcccacttctttccctaggctcaagatgtctttagtatttcctgtttgaagactttataattgtatagcctaagtcttgagggggtaagattttaagtgatttctctctagaacttaaatggtttcattttagtattttagtttagctttcttttgctcaccaagtttcattcccttatagtttcataggcgaaaataccattctttacacaagaaagtcagccaggcgcggtggctcacgcctgtaatcccagcattttgggaggccaaggcgggcgatcacctgaggtcgggagttcgagaccagcctgaccaacacggagaaaccccatctctactaaaaatacaaaattagctaggcatggtggtgcatgcctgtaatcacagctactcaggaggctgaggcaggagaatcacttgaacccaggaggtggaggttgtggtgagccgagatcacgccattgcactccagcctgggcaacaagagagaagcgctgtataaaaaaaaaaaaaaaaggaaagtcaagagggcaggaaacgtctgcttatattcccagataaataaaaaggagtcagcaaatgcactccagatctgacaataaaaccacctgaagcacagacccacccccaaaaggccagagctccctcatgctcttctgattgtaaaatgacctaagttacagccagaaaatggacctttctagactttcttctgaatgacttcccattttggttatttccaagtaggactatttctgtgactttgggtttggtgatttcaacttccttttgaccctgaggctaataggaggatgaggaaaaaagacttataatgttttgttttaacccctcaaagtcatacccttattgggtagctgtccagtgaggaagcttgggaaacacttcttgtggtcagacatgagcaaggatttgggtctgatcagctggccctgaggaagttttgagtgctgagcttagagaaactggattctttcaaacactgggctccagggtgtccttgcttctcaggaactcctcatactccaaagcaggaaggatataagctgagactacctttgcctcctcgctcatctgtccaacactcatttctcttgtcctttgcactatttccccaccaccccttcagctttagccaagtagtccaaaatctgtagggtacaaagcatcagttttcacttctgctgggaaattaaacccagctatttataaacccctcaaggttcccagcaatatttcccagtctggcatactgggccagtacccctactttactctaaccatggaatggtccctttcctatccatttggtgaccagccaagtttaagcttaaaacgaaagtctcaacctatgcaattcaaaagtgcctctatttttcctctttatttaatcacgagggtacactaggtttcaccctagccactaaaagttactcattataaattgggcccatttattaaaaggattgctttgatcctaggagggtacagtttatggcacaggttgctgagagccttagaaggctgttgttgctatcactcaactttttcttccccccgccacccgcccgccaccccgctgtcaagtctttcctttcgtcccctcctttcccttgttcctgactcatccttttttttttcctctttcttttacccactcttctctccatctccctagcctttgcttccaggggcagaacagagagggaatgcacaataccgacagatgctgggattttacccttgggacacagtgtctttaactagtaattatcaccagccagttcctgggctctttgtgaagtcactgtcccacaaggctcctggagagaagcatgccctgacggaaatgcgcattgatcttgaagggtgtgggtcagccatcaggcaggcaggaggcaggctaaggtggaagaggaaagccatctgtgtccctgaaagggtggtgctcctcttcaagcaccatcagcctgttggccaccccagcctctaagaagccgctcaggaagctggagctgactaggcccagcagtaggctatttagatgctcttcgtgcttggtggtgcacaaggattcaaagttctgttctcctgagctgcccacagcattattaaagtcacactctcaggcaggaaccagaatacaccaggccaactccctggctgcgacaaagccagatctttcccaaggtgcctgcctgttgctaggaaactatgcactggtactatgggccttttcccccgctaaaccccaagggtgtgtggactgcagccagttagctccctagctctgccaggaacccttcagctttatccttaagactcccagcatcctcaaagggaagtgagaatcatgaccccctccccccatacttctcaaacacaaaactaagaagtgaaaacccaagggccgttgtaccacccccttttattatcaaagtgtacaactgccacccacagcagctgctgcccacagaagccttttaatgcctctcaggacagaactgcctttagcttcacttcaggaaacttgcctctcccttctgtggctgggaacacctaaaactggcctgctgcctctcatgtcatctctgtagtgggatttagagaggcagtgagtgccatatgcccaggcacagagattctttgccctggtgggtctttgttcccctctctggttaagaggagagagttcttagttgaggaaagcaacagaacaggagggagggagaggaggaggaagggagagtttgaagggtgcaagatggaaaatcaggaaatcactataccgatgtttttaacaaagggtatcttcttggagggaggaggaaaattgagtttttaagaaggaatctagattgtcttgagtccactgcctcaggttgttttgcctttaagggctctccaggttctacgaccctgccatttctttggagtgaaataatggatgggatttgggaggcaggggatgatggcagctagcatctcttctcagtcttaacattatgtggtaaggaagatttttctgtgtctcaagcaaggcttagaaatctggacataggttttatttatttatttatttattttcgagacggagtctcactctgtcacccaagctggagtgcagtggcgtgatctgagctcactggaacctctgcctcccaggttcaagcgattctcgtgactcagcctcctgagtagccgggattacgggcacccaccaccactcccagctaatttttgtatttttagtagagatggggtttcgccatgttggccaggctggtctcaaactcctgacctcaggtgctccacccacctcagcctcctacagtgctgggattacaggcgttagccaccgcgcccggcctagattttattttttaaaagcatgccaagttcatctactatgctcctgaagttgtattcactcattcaagatttattgagcacctattacttggcaagtactgttctgagctctggaggatacagcaacaaacacaacaggccacctctccttcagcagggaaatcactagagtcaaggatatacgtgggccagggagagaaaggggcaaatgactcctgccaattcactgcatattttaaaaaattcatttccattcctttcccaaagtaagacaacacaaagtaaaactgaatactcagtgtctctgcaacctgacatattgctcctcattctcacctccatgcctttgttactctttgctctccaacctactctgcacttggggatgagggggcagcagttaaggtggagtagaaaatgttggacttggagtcagaagactccagatccgagcaagctatttcacctctctgaccttagtttcttgtctatgagaggggctcctgaccactgtactacctctctgtgatatactcttttagcaaagactttcccagggatcactggcttaatatcattaaatgttctcaaagccaaaaattaccttttgaagactagttgggacattgttgccatagcttaagggagaggtattggaggcttgagttataaatgtaaaaaaggtagtgatggattcaagagacaacacagaagtagaagcaacaggatttggcaattgattggatgtgggctgcaaggggttgcagaggaggattccctatttctgcaggtggcttgtagcctgagtgactgagagaaccacctgttccaggctcattaactctgtgaggtttgggagctctctgttcttccaaatagaaaaaaagctttggcccatattcatttttaaatagtaatgactgttcagggaattgcaaactcactgcctaaactaacgttttctttttatcacacagcattccggtgtctttccatcctcccctccctctggactttctgatgagccccagtctgcctctccctcacccagctacatgtggtcctcaagtgcaccgccccgttactctccaccctactatccaccttttgaaaagccaccaccttacagtccctaaagaggaatgcctgctggctattgagattattgtggcttttgtatttctgcttcagtggaagtgtgtagggtacaaaatttaaagtgtgactcttatgcataaagttttacaatggcctgccaggctagggaaagatagggacgaagcttattcattattagtgcagagcaggggtggtcaggctgaacgcagcacagaagggcagctcacattctctaagcaagactggggagccagcccagcaagaagcttgtttggacttgcattaccctatgctccacctctgtattcagcagaagtgtggttgccatctttttcactttatgtaaaggagtgttgccctcgggcccttggcagattgccaccccagcacctaggttgaagcacctggtttataggccctatctttccctacccctaaagtcagtccctaaggacaatttcccagctgatggggctacacagtagttccaatacagagagttctggctaagattttgtttgcttgtgtctggatgttgaaaaagactgcccgtatctcttactccttccttctctgtgagtattgtaaaaatggctgttgtgatcactcagctcagcttttgttattggtacctcctaaagggaaaagtgcaatattcttgcatcttcagtagtggggaacaggatgtattgttccggaaacactgaaatacacagcaacatgtgagatgttttaagtagatcacttaggagacagtggttctactacatgttgcattattacaaaatacatttgctacaggagatataaatcttatggttgtaattcagagtttaaaaatgttataaattaggttcttgggtcgtgatatgaattgttactaatctttgtgactatttaatcttcaaatattgtgcttaaccccagcaatccgcacgtatcctgcaccccaccccaaaagagtcatctgtattttaatgccactggtcttatcggtccttttgtctgttgagaccagtcatgacagcattcaagattatgaaagtgttacaatgccgcttcaagtctgcaaaacctcaaacgtagccaacttgacaaatatttaagtgttacggcagatttaaaatccatctggcacaccgtggtaggtatttgtacagttcttttaattacacatagctttaaaccatcaacctgatgagtttaaagcttttgcacccatgccttcacttcagaatgaacaccttcattgtgatcttatgttaacctgagaattgatttaaaggaagattgataatcctatactttataacgtaaaaatacaggggctacaggagggtacctaattagacagttctccaaacacagaacacacactggaaaattttccggccaattttgctacctcccaacttgatggattagaggtagcgcaaatgctggtgctcccatctaccttgtagacacttagccatcaagaatcaaggcacaagaagtgcactctctcattaacagtaaatgtttgcaagatattcagtttaactttcagcatcatgaatgttcttatccagattttgaatccgaaaaactataatccttttatgttatacaaaattactatgattttttacagttctgagcatattaaaattctactggatttcaaaaagagactaatacccaactgactaactaaacaaatatcaacttgtaatactcaatgaatttttttgccatttacatttgaccgttggctttagtgaatgtccatatttaattttttaaggcaccattacacagtttatcctacatttatcacatttcttaaagtgttaagattctatggctcatttctatgtatttttcttactttacaaaataacctgaaacagtatagattttgtaacacttaatttgagcagcttttttattacattgaattatacaaagtgcatgttaccttagaaaaattaatatttgctgctttactcttttgcaaaacatttgctgtaatgaatggatttgtatttccaatatgtatcttgactgcattttgtaatatttactgctttattcctaattctgctttaaagtactgaactgggcatgaaacattaaaatattaatccagaaactgtataaactggatgttgcttaaaatctgtatcactgccatgttgaaaactcagactgcttttgtgatgtttcaaatgaataaaactatcctcccctcgtt

SEQ ID NO: 4981 - DNA, 43193 bp, human
acgcggctgcacggaccgccaatgctgctgcctcccagagcagagggaggcagaagaggagggagggagaagagtggaagggagggggaggcggcacttgggctgcagctcgcaaccagaggcagtgtctctcagctctcggaaggaccgagagaggcaaccgcggagtaggatgctctgcggggcgcccagagccgggggcgcttgaagcagcttcggggactggggcaaccgggcagttttcaccatgcatcagtccctgactcagcagcggtccagcgacatgtccctgcccgattccatgggtaagtctagcggcccttccttcgggcggcggcagcaggggttgagtgccctggcctctggactgtgaacgccccagctgccccaaaagccggagagcgggaaacggggcatggatggggtggtcttcgcgccccagcgtctgggtggtggaccagagtcccaggggagcggcctggctgcagcgggagcgacgtgcggagatcggagcgccaagcttgcgtcggagtatctctgccccggagtgcgggtgtgtgcctgtttgtgtgcgtgtgtctacagacttgcagtcggtggtaaatcccagcaatctgaggatcaaaacacttccctgcaacctgcgccttcgctttccattcgacactccctctttgcaaagtcctggtcacttctaagagctcacgactaacgacaattagaagcagggtcctcgccccctcccaactctcttgaagctgccctgaaatttagagatgcagttgggtgggggcctgacttgcacctcgctgattggggggggggggcgggttgcgcaactctgggggatgggcgggggtgagaagaaagggggggatgaggggaggggaattcctgaggaatcactcaagacagcccagccctgccctctgcagcggcgggatcaacattctttgaatttgattgttactctgctccaaatgcacggaatgtgcatgagtgtgaaaagggagtcaggggcaggagtgagagcgcgagaaagaaacatccagcgcgagcccgcgcatcttctgaagtcgcgcttttcctcgcagggcggaatggagggggaggggcacccttcgactcctttccttatagaaactgggggacagctaccttcgggcaccaacttggctgcccctcgaagctgctttttggtagttacaaaaaaaaacaaacccagtccccctcagctgttaggcaccttcccaagccctgtgatttcactgggcggagaaattaatttggagccctggagagcgggaggggattgtaaaatcatgatcccacctaatcttttaaaattcgcctcggatacacttcaatcaaatcgaattctctctttccaacatactttacattctgcaaaatccctctgtcccgcagttcctgccatcagtctgctcaggtcttctccgatgaatttgcgggaacatctcgagtggagggggcagggagaagatcgaaccccctatataatctccctactgcccgcagaagactcagtgtcaacaaaactcgttcaccggaggggccccagaaagtgttatctcctggatggtggaaagatccgtatcctcaatggttttgcatattcagtataagaatttgctttttcatttttaagggcgtagttatttacaacggggtacaaatgaggccaaggacttggtccgaatcccgagcccagcagtaccagactcccccttactcccagctcgcgcgcgcgcactctttctccaacacacacaccacgcgcacacacatacagagggagagggagagagagagagcgcgagagcgagagagagcgacagcgagagcgagagagagagagacagagaggtgggaatgcactgcttaccttggccagctgtggcgccaacaacgcagccctggctccccgacgccaagctgttgcgcttcgcgagggagggcagagtggaagagtgctggggttccgcagcgtccattcccgctgcggacgacaaccacctaaccacctgcaaatcaagccacagcgccccgggcccgtctgccttcggggagtgggctggttggtggcccagggcttaaagagtcgctacttggcgcactgctctgtgggttggggaacaagatgaagagctttctttcttgggctcccaggggccctcagcgatcttgtgtttctcgaaaggtctgcgcaacaaacagctgagtgggcttcgcccagcccagtctccacactgcgggaaaggaatcataaatcccagatagaagcggagccggcgccacgcattccactttttgaagtccgcagaccgacggcactggcaaattcctgagtccagtgctaacgctgggtttccacagtttggacaggggagtctccccggagttccctggccctggtcccgcacagtccgggcctgaatcagcgtctaggctacttaggagctactcccacttagctctggcaacaccaccttcccttgcgtggggggaagaggacagtgggtaggtaggttagtgtttcagcctccaagggcagcatttctgaggggactccctttattgtcaagacacaaccgcaaccaaaacaataaaatttaaaacacgcagacacactgcaccaaggtgcctgcactctacgcttgctggctgcctgggaatagagcagtgcgtccaaggctcagagtggagcaggcgctttgcaattaagaagatggtaatttgactccagtgtccccccatcccctcccagcaacccccttctcccttttggcaacaccgcccccaggcgcaaaggcacctctactacagtagggcattccttcctcccaaataacacatttgtaattcgcgggcggcctcggatgttctccattcagagaactgtctaaagtggggagggatggatttcagcgcctttaaggaaatgtttgggagattggcagggtcttgaggcccttgtgtgggcagccacttgtttctagggatactcaaggctgggatatccggggacccaccctgtgtggcaaagctgactcaggtaagcaaatcctaatcggttcaaaagatcaacccagagaactagccaggcatcaacaacaccgtgtacaggacaggatactgggttcccaacttttctgtgcccaataaagattatacaccttatctactctcttgggagaggataatcaagaacgtgtgcaaggtaaaacaaagtaacagagacagcatcctaccttctagcaactcacatcttggttccctcagatacacaatcctgggactggcagatatcatatgggttgtggaccagacccacggttacaattgtaatggtaccagttacaattaatatacttattgagtaaggtacctgggaatttagggacatgaataagtgattaattttgatcaagaaaaactttttggaggaggggaattttgagcatgtttcaaaggaagggaggcacccaggttcaaagaccgcaatgcagatgggggctctgaccagggggaatacccggatgagagaaaagctggttgtttttggaagggtggagatagcaaataattgggtgcttctagagctaagcatcctggtcatcaggaatctggggtggaggtggggcactgcagagagggagggctgcagtagttctgcagggaggctgctgaggaggggcaggcaaggccaatgaaaagatttcagactctctcactgctgttggttgcagaggtggttgttgtttaagcagaaatatactgggtgccaaggagacagagtagtgagagatattgtagttttcacactagttagccagaaggcttttaatttgagggaaccctcaggtgtaccctacattaaaaaatcaattctatgagactagcccatatttattcacacaattcctcccacatccttcttgattaaaagggaaacaattctgagatgttgcctcttgtttattcaacaagtaccgattgtttattaggtatcaaacactaggtataaatcgtaataggcatgattttcatatacctgctgctttatttaagtacctcctggtgcctgagtttttttacgtgtcactttactaaacaaaatcagaataagatggtcctgtgtttacagaaacatctaaggcaagccccaaattgtaccagaataagaacacggctgtacttctcccttctaaaataaaacaaccaccaggaaaatgtcctaagcagacacaataaactgccttttaggagcctgggccacaccttcagaaaatgggtatatcttgctctaagtagatgtgaattttattgagtcgaattgacactaaagataaattgaggggtgattcttcattttcaaaacgagtcaccctgggagggggttttcttaaaacagtcaattccccaagtgcaactagaaataatttcatgttacacaattatggtccttataaaataagtggtgacagggaaggacgctcgtgaggggacagagattagatattcgacctggtgatcagagagttttcttaggaattttatccaaagcaaatcctatctggagtcaaggcccctgtggggctgtgggatatttgcctgggttgctcaagtgactgaattttcaattcaggttctaaagcaggaaaaaagattttcaaatgacactatgtggtttgctgagtcacttttctgacctggctcttcctgcgcttttaaaagttagagtgatatttgcaaagaagacccaagagctgtgaataagattaaaggccagctggtggggaaggagcaggcaaatgaaacaaacaaacaaacaaaccaaaattaaaaagaccatgcatgcacacacacttctccaatttagtctgtcaggttacatgttttctgggtaaggtgttgagacacttccatatcacaaagatatccgtggtgtatccaaatgttctctcactctcttttgccagtttggggcaggggagggctagagattgtgtgagtgacaaaagagaagggaagacaagaatgggaggcaatgttggtaagtttatgttagagcccctctgtagaaccaactcacagattcactgagaagtatctatcatcaaataaacttaggcaccctggtttagagactaatttagggtccctcaaaatcaagaggaaggataactaaacttcaggtaaccagaagaaataaatcctggccttcccccaaccctctactattcctttcccagtaccatgcagtccagagctcccggctttgctcctgtgtttaccattagtcagctcccatttgcatccctaatagccctgtcatgaaagggccccgatgttacaggtgtctctagtgggcctttatgtttttgtcccatggaggctggactcaggtctctttaaagatgagtctcatttgccaactcttcttacctcttccccagggtgagacatggtgctttagcattgtagatgcctataaacgttcaaaccacttctacatttcaacgaaaaatagtcttagattagtcccatattagaaatgaccctgatgagtcacatccctcattttcgaagctgacgtcaggggagaccgcctgcccctcccacctcccttggagacttcagcagggacagtactggggaagacaggatggatggtggggttaagcccgggtgatactcccagtgcttttcttccatacaggaggggatatctgcagtggactgcaaggccagccacaacccctcccgtctcaccaccaccttgcctcctgggtctcgcttcgtttccttgacctcgtcccccttcctccatcccctctcccctccctctatcccctctcccctccctccccatggagcagtctgcatggcttctctcaacaactgcttcctgaggctgcagtgaggtctcccagaatgacagggtcttatggacagactcaagtgatctctttagggccataaatgacagtcaagccacgtgggtgggcgactccatcagggctcctcactgcttcatcctcctcatgctccaaacctccactagagagctagactcttctcatttgcttatttttttttttttgagaactcctaggtagtaactctcccctggttatttcctgttgaaggccctctccctatgcctgagaaatccctgcagagtgtgagacagtgctcggttcctttaaaaaaaaataaattaaaaagtgagcctagataccatttttctgtctgacttaataatcctgttttcaaaaaaatattggtttgcactatcatgtctgataagccctgagtgggagaatgggtttctcatcatttatgtttatgtcaccctcacataagcctaaatgtgtataagttataatcctccccacctaactcccccgatacatatctttgtggactaatggcctccaaacactcactttattacacacatttgttatgtgacaaatcttgccaatacaccattttaaagtttatacatgaggtggcaaatgtcagaaataaatgaaaaaaaaatcccagtaacttggcttggctgtgatatttacactgaaaatgaaatttcatatctctagcttatgaaaaaaatctttttagttggatattggctttaaaatgttttcatttaataccccctcccccacacacacacttcccatttatcatatgccttctaatttggtctaaaaaaccactctactaagtagttgtgacacatctcttacagagtgccaggagcacaaaaattcgttttgtttttacgtaactggtgaaatttcttctgttgtttattttcaaattggaaatacatattttattataaaagtggcacctgatgactacaaaaaataatgctctatcccttccccacaaccccccacccgtcaccaccaaagataacttcagttaccggtaggaataggaaaggaaaaccttcttagtgtttttttctttaagtcaatcctttccccagctgaaatgagcaattttaatttctctctgtgctttcaggagcattcaatcggaggaaacgaaactccatctatgtcaccgtgactttgcttattgtgtccgtgttaattctcacagtgggccttgctgcaaccaccaggacccagaatgtgactgtaggaggttattaccccggagttattgtaagtatagaaggcacaggtaggtcgcagtagcttgctgtctacagaaattctggctctgctctgatagttttcaattctgtttgagtgtctagtgtttgctcagatttcctcctttgtatctctgtatatttatgtggagaggcaactctgggcccgctaagaagagcactggactgagaatcagaagaatccagcaccatccctatctaacagtgtgatcctgagcaagtcatctcactctttaatacctcaggtttctggtttaggagatgttaccagcagtgttaaccttaggctaaggtcctttctctccgggcatctgcattcccatatataatagaggtcatctgatctcacctgaaatctgaggatcctggcagcttgacactctgaccaacagcactgatctccaaagtgatcctgcactcctatcagaaaaagctgtggaagatatgttcctaaaatatgtatatttattcacttataaattatatatatacatgttcataaaacttatataaaaatgaacattcaaaaattagataaaaataagtatacaataacttttaatatcttcatgtgaacacaaactaaaatgtcaccagataatatgcacttagtgtgaagcttgtcattaaagacagtggctttaaatccttatttcaaatggcccactagataattgtgaatatttttggctgccttcttatcccatatgattagactgtcattggagtcatgtttttaaatgtcaatatcacaatttggctgccaaaaatctaccctgggagttagaagtattaaactctgccattttcttgttgcttacgtttgcttacattattagggtcatcttcaacttctggtttctcaagaggaatcttttcaagcctcttatccattttgttgagactagtttcgttaaaattggataatacaatccaggcacacataaaatgccccaccatcaaccgtttgttgcttggaacttgccctcctccagaaggatagttcacctgatcacctgacattcacacggacagagggtgccagtgacagtctgtttattaaatattagtaatgtttggtttcttattattttagataaacaataaataggaaacagccgtattccagtggattgttttatctaccctagggtgcatgcagttccctttggagactgctaaactagttgcattagaaaaaccaaaacctaatttgagtctacgtacactgctgttgaacccaaaaacctaactctagaggtgagatcatattttaaacaccaattaaatggctcctcaattgttagagagcagaaggacctttaggacaattcagttaagaaatattttagtacagcaaagaggtcagatgtattttttgttgttgttttgtttcatttctctttgaaatgaaatgagagagagagagagaggtggggattggagagagaagcaaagcgagaggggagattaaagatgatgccttggacaagccagagctataagtgaccaagcctggagcctgttgcctaggtcactgatttcattccacagtcagcctcctcaatagctcttgagaagctgggacctaaagtgggctgcaggctatgccttcctggagctgaaggctgctgggggaagtgcctccacagctccagggcaggcagggctcctcccagctgagggcaggtgacccacagacactgtttggtgccctgtgttaaacatgtgatgtgagaactcacccagtgcacttcctgtggtgaggcaagaaaaccagtcgtcagcagaattgggttttatttttaaacacaagcaaagccggtggggggtcggggggtgggtgtgcagggaggaacagagggggtaagatagcatttcggtggcttggaaaagcaatttatagggtctgcttgactttgtgtatttcaggtagctgcattagtaaaatatttctgactgatgagcaaatgctgaagccaagatttagagtctctgtgggtgaggggaaggtattttccatgttatttaagagtatgaactcctattcataaacagtggctgtgaaccttctctgtggaatatcttactgtgggtggctaggttggaatacgttaacaaaggaaggagggtgcctgattgctgttattcaagtacctgatgttcagctagcactagaagttgaagcagtgggggcgtgtgtttgcgtgtgagtggttcactaagagctaatatggaagtgttaataggaaagccatccctaacggacactgtgcccccatgatttaacctttaaaaatgtgctctcatagttcctggagattgcttctttaaaatgcattttaattacataaaataaaggggaaaagacagcagattgaatagcagaaaaatccatttgagtttataggtcagatcacgttgtaacaaatacaattacgactcatacctcagaaacagtaaacgcctgagaatccagatttgtctgggaatggggtactttcattaactgaatagcttggttattagggagttactatagaaactccaaaccagtggtttccccactctgatgtgaataagaatgaccttgtgaacctgcaaaaaatgcagatctctactccctagcccaagagattctgattcagttggtctgcatgggccctggcaatctgaattttcttttcataaactaacctttgattgaaaaagtaataaatgttgaatccacctgaggggaaagaatccgtggggggtggggggagtctaattcaggtggactagcaaccacctggagaattaacacacagtaaaatatgcttagcaataaaaccagaaggatcataatgtgtcatctggagattctgcactgtcaaagtggtcactttaaatataaattactaatgtatagaactgtgaaaaagtttcagcttatttagaactctgctgttttagactctgattaaatgtgttaacaatccatgagaatttaaattttcaaaacagacaaattagggagaagttattagattaaaagaagacttaccatacaaatcatttaaatattgtgatctcaggtacttaaaatataactcaatttgcataattctaagtcacgtgaagctttttgggagcatctttattttgccaaatgagatatctttgtacagtgaggtgcattatcatggcatgttagctactctacctgagctagcatgtggtatcatcgttctaagagacatacgcacacatgcctctgtaaagatgtgctagtctgtacagtctgaactgtaaagttttaaaaaaactaaaaccaggctgggcacggtggcacatgcttgtaatcacagcacttagggaggctgaggtgggaggatagcttgaggccaggagttcaagtccagcctgggcaacgtggtgagacgccatctctacaaaaagtatatatataaaaaattagccaagtatggtggtgcacgcctctggtcccagctactcgacaggatgaggtaagaggatctcttgagctcaggaggttaaggctgcagtgaaccatgatcactcaccccactgggctccagcctgggccacaaagcaagactgtctcaaataaataaataaataaaatttaaaaactaaaaacggccaggtgcggtggctcacacttgtaatcccagcattttgagaggctgaagcaggcggatcacttgagcccaggagtttgagaccagcctagacaacatgacaaagccccatctctacaaaaaaaaaaaaaaaaaaaaattagcctggccctgtggcatgagcctgtagtcccagttacgtgggaggctaaggtggaaggatcgcttgagcctaggagatggaagttgcagtgagctgagatcgcgccacttcactccagcctgggtgacagatcgaggtcctgtctcaaaaaaacaaaacaaaacaaaacagaaacaaaaaccgaacaccaacaaacaaagacaaactggattaagaattttactgtcctcaaatattcaaggcattttatttcaggagggttcagatgagctttctactctgaaggcctaaaaacccaagagcttcatttgttgcctgaagctgaaagagacaggggagggtgattgctgcttcccggtacacctcctcttaccttagatgcaggaaaaagaggcctctaaatgtgtttcccaagcaacccacaagatggagttggtcccctggatagtgagacaagcctttcattcttgcaccctctcctcagctgctatattgatactattagggcgcatactagcctgagtcttctttcaggaaagagagcaagaatttctgccccctttcccagggagtgggtaggagagtcagttaattgaaaatcatttcagagttactgtgggatattaggagatggggacaacagggatcattcaaaacaatcaagatcccagaaaccttctttaggtcagtgtggcctcagattcacatgtaaagactccttggaaaagtccaaagaaattttgattaacatgaatgctcagaaaacataaggagctctggatagtgggattttgtagtaaatagtgaattaggcagaaagattttcaacaggaggtgaaaaagtttctacctcttgtttgaaaatgtttctaaaatctaagttcattctaaaatataagtccctcacttactaagtacatttttaaaatggcacctgggctgggtacagtggctcatgcctgtaatcccatcactttgggaggccgaggcaggaagatcatttgaggccaggcattcgagaccagtctgggcaacaaagtgagacccccatctctataagaaattttaaaattagccaggtgtggtggtgcacacctgtagtcccagctacttaggaggctgaggcaagggggttccttgagcccaggaggtcgaggccggctgcaatgagctaggatctcaccactgctctccagcctgggcaacatagcaaaactttgtctctataaaaaaattaagaattagctaggtacagtggctcaggcctgtagtcccagctactcaggaagcttaggcaggaggattgcctgagcccaggagttcgaggctagagtgagccttgtttgcaccactgaattccagactgggtgacagagtgagatcctgtctctaaataaataaatacatttgaatcttgatttgctggataagacttttataataccacaaggttctcaccttcattggctccctgttgcttccttggcatgtcattcagagctctccatagatgccctcagcctagtctctcattacttctcttttgcaaaaattgccaattcacagtcctctgaacacgacttgggcttttctgccttggggccgtcataacattttttcctcatgcctagaatatcctccctgatctctctctctctctctctctctctctctaggtgctctgttctatcccaacttaaaaacacagcagaaacatgtctcaaatactgaggtccacagtggtgtctacatctttgaactccctactgtagattcctcctattcatggttgctggaaaacacttgtgtcctgctttgtggcatctgttgggctatattctcatttagctttgtttatataggccctcaatcccttctctgaacccttgggtcagatgggattcagaatttagacttcttattttagaaaaattatacaatacatataccacatattatctaacaaccaagtagagccttgagaagcatcccataatcaagcacctcatgtttctataataaaacatggatttttaaactaagtgagataaagatgataatataacctcacatcagttcaagatcaggttttgccaccaagttagttacattcaagaaaaaaaaacacttttttattttaagaactttgtggatttcaggattatggaaagggattgtggactggtttacctaattgtagtatgagctcctttagcctgagtggtcttgatcataccccatcccacctcctggcctccaaattacagatcgaacacactgccagccagagtagatgtccaattaatatttacctaatgactaatttttttagcctttgtcctagatgtctgggacagtgaatgggaacaggcataggtgacaagagtccagcctcaaaaaagcccttgaatctgactttgatatctaatcatctgtcttttttttttttccacaagtggaggacagccaaaacaaagcaaactagttatttgttcaggtaatggggaatcaagatggaggtccaaaggtctgaacattacatgattccatgaagctcttgaggggagaccacagagcttacctttctgaggtctcaggggagcaagcaattgtttagaagcagctgtccattttaaggaaactgttggttttcccttctttattttcaacccctcagctcttccgcaaataagacttctcactccatccttgcagagaacttcttctctagggggcaacaatgaagtccttgttgcttggaggtcacaattctactagcactggtcacaaatgcagcgaggtgtggctaaaagaactcaagctgttattcaggggacccgagagctagtcccagacctaccattaacttgctataagagggcatacatctttacaattatctatgccttcattttcctgtctatcaaatgggaatgatatgaattccaccaaactccatagtattcctgtgaccaaagtagggggcaagtgcttctttaacttaaaatgcttttgaaatggaagattgttttagcaacactggtgagttcattaacctgtcatccaggtaagtgaattcttccagccatgactcaatacgtattagttccctgcctgctgagctctaatccatcttttgagcgcatacaaaaatgtctcctcctctatgaaaccttagcactaccatttatttagcagcctaccttatgcaaatcacactacatacttcatctcatataatcctcaaagcaaccctgtatggcaggctctattatgattcccattttatagatgatgaaaccaaagcacagagtggttaaggaattgggccaagggcacagagtttataagtagcagagccaggaatatattatattatatataatatatatattataatataatataatatatataatattatatattataatataatataatatatataatattatatatattataatataatataatatatataatattatatatattatattatatattatatattatatatatataatatatataatattatatattatatataatatatatataatatatataatattatatattatatataatatatatataatattatatatataatattatatataatatatatataatattatatatatcatatataatatatatgatatataatatattatatattatatatgatatatattatatatcatatatattatatatgatatatattatatatcatatatattatatatgatatataatatatttaatatatataatatataatataatataatataatatatttaatatatattaaatttatttacctaaatatatttaatatatatattaaatataatatatattatattataatatatattatattataatataatatatatatattatattcctggctgcgtgaattattccctgctcctatagcactttgtttttacctggtctgtggtccttaacccagtctgtctctcccttactagaccgtgagctcttggaggacagtagccatgtcttcttattcatctgacataaagctagtagtgaacgtcagaaaactgaatgcattggagtggaatagaatagaatagaatagaatagaatagaatagaatagaatagaatagaatagaggagaaggggagataactggatgaagtaactggctggcctgggatttccagttctggagtgccttgtctttccagacaattccacaagacttccacccacctcttctggtcactgccatcagagagttatttgccatgagagaatatgaggaatagagagtgtctttgcttcctgtcttaggacaaagactgctatcacgattcaggagacattctgcgaatacctttggaagctgatgaattgttaagtaaaaggacttatttttcccgtaagaagctgcctccaaatttctctcaactcaacaagtggcccagagtgccaaaaggagagactattcatggattttctcctaaaaaatagaagccgtggaacatcagagggggagacaagatggaacaaggaaattctcttagcacaaaatagagcacataattataagattttccagctcaagtcaggttagagtggctcaaaagttaaatggctgtaaaaataataataatcactagaaaaaagtaatatttactgagtacttactgtgtaccaggtgctgtgcaaagttctttgaatgtattatcctggttaattctcacaaaagccctataaggtagtcactactgtggttcctatttttacaatataagaaaattgaggtttagagagcttaaccagtttgttcaaggttacacagacatagaagagctggggttggaagccaggctagtgtgataactaagttttaatcagtatattttatggcaacatattttaattatatctgaaataagaccaggtgggagacaggcattgcttgactgttgaatgaggatgttctcagtagagtcttggatattaccctcatgcactgcagcatctgtttcccaagagacattgctgtctgagtggccctgcacaaggagtcctggagatttacattcattccttccattcattctctcattcttggggtctgagacagccacccagtccccctacactgccctaccaagctcctgcccagcccttgggtctcttagattcccaaacctaggtgcaaggcttgggggtctcaaattgaaatagatgtccctgtgagccaaagtaaggctgcagatggaaacccagaccattagtgaggctaaagagaaaagtaacttcatcactgaacttgtgttaagatttattggtccgttctcaccactttttacttcttccactttcatccccatcaacagctatcagttagtgatcattttcatctaagactggcagactcagtcttctaatggcagagctgagagggcagtgagatctgttataccaagccataatctcagccacttagacaggaaaattgtttttagggttttacactgccatttctgttcaccctttaatgaatgctttctgtccataaatgaagcagggatggaagaaggggtgaataagtgctaacataaattgcagtgggtcaaccacaaatacaggctttcaaaaaaaaagatttttaaaaaaattttttagtgtgggttaaggtgcttcctgatttctaaagtacttcctgagttggattggtatgccagatgcatcaaaattgcttttgcaaacctttattttgtgatctatacatcaaagtggaaggtctttttcaaaaaaaagataaaaataaaaatataatgtgtgcttttcatcattatatgtctcttactgactcaccagtcacatgctaggtaatagatattgcaattgaaataggcaggctctgaaagctatggttgacctttacttttagtttttgggcacataagtttcttcttaggtatgattcatagctacaagggaaaactggcaaatggtgggaaaaatacttttattgtacatgctgtatttgtgtaagtaacagctgcatgtggctttagcaccaatacctttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagttttttcttttatcctgaatcatatgaaggggctggaatgattgtgtggtcagcctgactgtcatcccacatactatgtatgccatattgctttgcagctcggctttggatcgttccttggaatcattggatcaaaccttattgagaacaaaaggcagatggtaagttttcatcccttatagagtcaagttcttcctctaaaaaagcacaacatttatgtggataagtaacacatttcttaagtttgtgtgatttggtcataaaaggaactgctactttgccgtttctcctaaacctctagggaatgtgttttactgtgaccctgtgatatgggattggttctcatcttgcttgatgctccctcactggcctagctagattccttatgccaaagggatagaatattctggatcttgccctttgctttcctccttactcccaaaggagtgctccaacctatccaatcaggctatggtcctcacctagaatgcttttgcttacatttctgttactacagccctggattattggtggccgtcacatctttctctctgatacataatcttttgggcaagttttcacagagagttcctgccttttaggagattacaatatagcagactttgatttaatgagcaagtgtacttgtggcacacacaaaaaaagataaaataaaattataaagccatcctaaagtatctccattacccatagttcaaagctaagcatgttgtaagattgaaaggaaggacaagcatataacagaaggtgaagcttctatgtcttaacaggggcccacaagggcaagctgttatactttcctggttcaatctgaaaaggctccctcaagggtaaaggtagaagatatagactgaattgcaagcatattgcagttttatagagttgtaaatcaagatgcctggtgagtggtcagatggtgattgggctccccctgtacagtctctgtggcactgaaactttgacaatggggtctatttcacagcaagtttaatcagataacgtaatagctccaaggacagagaactctaaccatatgttttcccccagcgatatggggaatcaccctcaagggagttctaatagtttttttcttccatttcacctgggctgcctccttgccagttgtgtttgcactttaggcttaaattattcaaaataatgggggaattttaattgtagagctgatcatagcatagctaataatgtcaatttcatgacattgttcatacattatttaccaattctctgtaacactataaagtgagaattatggggagaggtttctgaacaactcccaaaggagataagtatttcctcctagcctgttgaggtgggagaaccctagggtggccttgattttttttttttcgagatggagtcttgctctgtcgcccaggctggagtggagtggcaccatctcggctcactgcaacctctgtctcccgggttcaagccactctcctgcctcagcctcccgagtagctgggattacaggtgcatatcaccatgcctggctaattttttgtatttttagtagagatgaggttttaccatgttggccaggctggtcttgagctcctgacctcaagtgatccacccgccccagcctcccaaagtactgggattacaggcgtgatccactgcgccctgggtggccttgattttgattttctccttctccctggagagcagcttgatgccatgtgatctccccctcttttcttccaaaaacctcagggaaaaaaagtgctgattccatctagttctgagggtcaacacaggcaggcggtcagctcaggtagcatctatctctgcccctggaaaagccttgaaattcctattttcccccacatttggttgtagtagcatctttgtaatagtagacaaattattaggaaaatttctgttatctaacacaattagagaatagggtagcctggttctagcaaacatttgtcttacttgaaagtttttatatgtaccatactggctgtgcatagtggctcacacttgtaattccagcactttgggaggctgaggcaggaggattgctgttctcaggagtttgagaccactctaggcaacataggagacctgtctctaaaaaaatttaaaaattttaaaaatatgtatcatacaacgttgattcagagacttcaatcctttgtaaaatgtccttgacatgtaagtcttaagttgaatgtcctgtttcttcagtgttgcagaaggtcatgtaaagttttgcaggaccccggaatcatcattgccttcatcagtgcccactatagcatcaagtagcagtgtgagggggtaaaaagaacactggattaggagttggtgagcaccaggcttttccacagactagatggagaccctgggcacaccatttcccctcactgtgcctccatttctacataaataaaatagaggattgaactacctaatgtcaaaagtccaacattatttctgagtccaaggatggaagggccgtgcagtcaaattccttcatggacagcatgctagataccagcaagcctcctcttcatttggtgctcacagagtgaatttcttagctttccctgaaaatgtaaaaattgcttcagttgcccattctctgcctcccctgcctacctcccttccactcatcctgcatgaccaaaaagagcattcccatggggtggtaggctagagttctgctttggctggaagtctcttggggattgcctggtccccagaggcagcaagtgcgaaaggctaacagacgcttttgttttattcccccctacagctggtggcttctatcgtgtttatcagctttggtgtgattgcggctttttgttgtgccatagttgacggggtctttgctgccagacacattgtgagtattttttcgtcctgagttaaagtaaataggcaatacaacaaggccccactgaatgtgtgctcgatgttcagtcctttgcttagtgtcatgagggttacatgagagggagaagacacagtcccttttctcaaggagttggcagtcaaggtgaagacaccaatggacacgcggacatctagagaatgaggtctaagctgggggaacaaactccaagtgccatagtggcttatcttggattccagaggtcagagaaggcattcagtggtggtagggctggagctaggcctttgacacgtgggtaagatttgagaaggcaaaggatcaggggaattgcttagaactagtattgggggcaacggggtagagagagagcaccaagaagccacatgacttatggtcaatgccgtcacccaaatagtctatgaaatggcatctgaagaaacaattcctgggcaaggagaaaaacaaggaatgccagagaaaggccctttgcctgattttctttcaggaccaggaatataaatgtaggcccctctaccagatccatcccttctgattttagctgagatcagccatctttttcatcatctttttcttcttataaagcaaatgacacatcagtaactttaaacatccataattctaccaccctaacttgacaatttttattgtttttgcatattagctgctgagtatatacctatttttgtagcatagttgcagtcaatcatagtatgcatactattttgtattcaacagaagccatcttaataacaataattccttgttttgtgtagtgcatttagcttttcaatgtgacttcacatctattacctcatttgaaacccacagtaatcctgtgatatatatagggcaggcattattatccccatttgacaaacagtattcactctgaggcagtctccatggcaacataggcctagtggctaagaagcctgcagtagattttgatggcagcatgagctaaaatggcttccttttttcccctcttcccctcattcctaatgttgtttaatagctttattgagatataattcacatcccatacaattcacccatttaatgtgtataattcaatgatttttaatatatttagtatgtatcagttatttatgtgcaaccatcaccacagtcaattttagattttcatcatcttgaaaagaaatcccataccctttagctttcacctccacattcccacattctccccagacccaagcaaccactaatatactttctttgtgtaaggtatccctattctagacatttcatattaatagaataatataatatatatattctcttgtgattggtttctttcagttagtataatgttttcaagattcgttcatgttgtatcaagtacttcattccgttttatggactaataacattccgttgtatgggtataccacattttctttgtccgttcactagttggtgtacatttgagttgtttccactttttggttattatgaataattctactgtaaacatttatgtacaaatttatgcatggatatatgttttcattttcattttcattttctttctacctaagagtataactgctggatcatatagtaagtatgtttatttgtttgaggaactgccagagtattttccaaagtggctgcactattttacattcccaccagagtgtttgatgggtttgattttgctacatactcatcaactctcattattatctgactttttgattccagccatcctagtgggtatgaagcagtatctcattatggttttgatttgcattttcctgacattccaatgtttttgatcattggctccagtcaaaggcaatgggcaaaaattcaaattatatttactggaagtttcctctaatgaccactacttgcctctgagtccaggccctctgtacctcctgctgctggtgacctgcagtacagcatttgactcaagtatttgggggtacgactggatgaatatttaagaaaatctttctgcttatactatacctgccctaagacattggctagtcctcattgacacccagagagctttgaggaaggaggctttattaatctatgatggtatctgttggccaacttaaatgaaaggcacatttggaccctagcacagcttggatgggtgagagccagctgtcctattgttgaggccctttaacatcatctttccctgttcctttgacttgggtgaatctgaacttcctctcaagacctaccaccttctcactcacccttctctatgtgtcttgtgccatttctcttttgtctcatatttctttcctttcccctctccctagtatagccattaactagcttggaaaatcactttaccttcttgtaccatagttttcttttcttctaaatggatatagtagtaacctacctttcagggttagcatgaacgtgaaattaaataatgggaatggatatgccctaagagggcctggcatagagcagacactcaacataaaacaatttccttttctaccccttcatgccatagttggtagcccttcagattacagaggttgccaagccctggctgagtgaccttttcttgcctcccaattgccttgttcttgttactcttctgggcctcaatgaagagtatcagccagaggcagcaaatgggcaactatcacacgtctgtcttcatgtagggcacttggtgcctgaatgctttttgcaaaaccaggaggtgagaagggctgtgaccagcacattaagcctcctcttcagcaggataattatgataattattctgccactacccaaacaccaaacatggacaataagcccttccaggtgtgagcatgaacaccctcattcctttccagctagactccaagctaagctaacagggcaaggtactttcagaacattgagcaggcaggagtttcatgtagaagtagctagctgatggaaagtcctagaaccttaatggggaggccggctaaaaggcaggaggcatttgagtgccaagtacaaaagacgctaaatcacatgtgtggggaaaagcagccactgagatgatcgtaaatggtgaaagaagtgggggcagaagggaaggagacaatacataaattccctctgcctgggtacttctgccaaaccccaaggtcaatttgcataagttgtttgtcctgtcctaaggtgcctttggaagaagccccctaccactcaggggaggtttagcatcagtccggaaagtgaacagcagctcctgcctgcaagcttccaggcagccctggcttgtgtctattggttctaccccaacccccatgcatgagagctctctctcatcaggaagctggccaagccagcagagtaaatcgactgtccttgagccccatgttagttttctgagacttgaacagtgtttttggagttcactgattttatctaatctatgcagttgggtgaaaatggctcacagttcaattgagttaaaatctacagcagcctcaggagctgcccctcctcctgaggcttgcttcctgagctcttccttctgaaaatgatgcggaaatgacagcaagaggtacaagtcagccaaccatagtcctgtccccaggtgataatgaaacctcattgttggacttgagctctctctgcttgaaagtgtcatttcataataacctggagttttgcatcttgttccctgaggactgtttacaagaagacaaaggccagaagtaaaagaaaaccagagaggaaatttcaagaagcccatttctcaatcagtttcataatttctcattaaccaagtagtctaatagaaagtaatttttaaagtatttttgtctaatcttcactcagtctccctagacaggtgactttcagaaattaacccaatctactgcctgcctgcttctgtgtgtgtgtgtgtgtgtgtgtgtgtgtattcaaaccttttattaccaagtacaacacttgctgttttattttccaaagtcaaaacccctttgttttggtgtttcccttttcaggatctgaaaccactctacgctaaccggtgccattatgttcccaagacatcacagaaggaagctgaggaggtgagccagaatgaggctgcatgtctttacctcctgggaaagtcccctgttctgcctgaaacaccctttcttttactccttttcatgggcctaagttttatttctaggtatgtatagctgatttgttcagtgggtcagagcacattgctaatgaggccatggtcataggttggagcctcatgaggcctaatcagttttactttgttctgtggccacaggctgaccctctgaccccagccgggagcctccccatatgtggctttgatcctcagggggacaaatgagagtacagaggccacaggacatgaccctcccccatctctgtggatgatggttcagttgcctgaactcagtgctcagttggaataaaagtggaagccccaccagggcactaggcctgaactacggaggcagagcctgagttccacacataggatgggtctggaagccaaatgagggtaactgagaagccagatccacctttatgctctggggaggctgggactgtcagcctggcccctctcataacacctccaagaggccagcctaataatgcttgagcatgcacagatgagtctctcttctgccccaaacagctctccttatgttccatgttgcctcaagcagagctagatgcaatgcgtagtgaggcaaagtatgactccaggtcatttttggagagctttcatttcagtatacaataatcccttcccaacccagggatttctccatatgaaactgtacctaggcttccaggaatcttgacaattttgtactctattaacctcacattgaaagtcaatcattcccaaatagttagaaaaatggtaaactttcagttgggaagagaaaaggaaggcaattggatgtaaaatggccactgcattgcacagcttcaggggaagccattttacataaaatacaatgtgaatgggtgcccttggagtaaggcaaagcagtcctgctccaaaggcaccatggcaaatactttgattatgtctctgccatccacttgactcctttttcttttaacaaccataaatttactatttctctcactgttctcaggttagataggaggaatagaaatgcatatatgataacagcttatctgaaaggcagtaagcatttggatgaaggacccaatatagaaaaaaatgcccatttgctatgaatattctctataacaaagcaagacaaatttagcagcacttcattgcatctggatgggggagagagctggacaatttcttgctaacaagagatggtaaatgaaattcttttccgtttttaaaacctttttgctaactcaaaatgtgtaaaatgtcattgctgttctctagattttgttgtgatagctttcttgcgttaatttggtgactgtaaaaatattaataatgacttccataggttcacttgtaaccctggtccccctaaccctatttttcctacataaggtcataagttcctcaaccaaaaattctccttccacgagggttatgaggaaccttacccaggcagctagagaggtactattgtacttcagagtgcatgcgccggctcctctgtcttccttcccaccttatcttctttcctcctgtaccctgattttgcctgccctcatattctcatttccttcagtccatttgttcttccgtctgtccttccatctgtccttccttctctccatctccaccattcagggatggggcactgagggctgtggcagaggctggacatgagcccagctacacagtgacttgcctcatgcacaagttcggccagctccccatccagccccatccttcccacacattgggtgttcatttcaaagccatccttactgtctccatcagtcactaactcgcatttccaatcccagagggtcctgcttcctatccaatgccagctcatctcctcactgttatataccgtcaggttaactgccctcacctcagccgtgaattctgcacacctcgcatccggggcaacacctgcttctgctgtgacctctacaactgtggcaagtaagtgttgaggcccagacacaggaataatggtctgaccacaacggacactagaagggctgaggttaaggaagggtgcattgtgggaattagggaagtggaagacattgatctgttaacagattttggctaacagacattacttgccttctctgtgccaggcatcatgctaggtactttcacatacttgatctcatttaattcttacttatgatgtatgcagagtaatcctcattttatagatgaggagagtgaagttcaaaggaaacagacaactagcccaaggttacacagaacttgaaaataatatgtataggattcaaactcagctctgtctatatccaagtttaacaatgttcaataaatagttactgagtaccttctcggtgcctggctctgttctagacactgaaggttcagcagccaacaaaacagaagtcctttcccctgtggagcttatattctagtaggggagacagtcaacaaatacagaaatatataatataatgccaggtggtgatcagagctctgaagaaaaatgaagcaggagaggtagatagtgatgaggggtgtgtgtgtgtgtgtgtgtgcgtgcacgtgcacatgcacgcacactgtatgttagatagagtagccagggaaggcctctttgagcaggtgacatttgtgcagacctgaaagtagttgggggtgggtgggcaacccaggtagatacctggagaaagagtgcttcaagcagagggaatagcaagtgcaaaggttctgaggcaggagcagttttggtgctggttctgctacagccactctggctctgtgcactccaaattgctaaaacatcctttattctttctttcaaaatatatttgggcgctaggaatacagagattgccactgaagagctcgtagactagtaaagaggatggacatgtgaacaatcgattgcaatataatgtgataagtgcagtggggatcagtggatgtggtggggattctggaggcccaatgaatgaaagtcagagtttgccgggagggaaaagtgtcaaagagtaggtgatatgggagctgagacttacagaataagtagggaatcaggagacaaaccaaaagaagacagaggtgggaaggatattcctggtagttgtgaagaggtagtgggtggaggtagttacagaaggtgtggtaggaggtaagacagaggtgtagccagagatcagatgatagagagctcattggccataggaatgacttcagacttgaccctgtaggcaactgggggccattgaagggtacagcatggaagatggaattgagtggttgaggaatggaggcagctaggaggccattgcaagagcgcaggccatagagaatggagcctagatcaagttggagacaatgcaaagcggggaatcattttaagagcaatttagaaggtagaatcaatagggatgtgtgagtaggtgatgtgcacagtgagtgaacacctctccatgcagggtatgtcgaccaatgttcgtcatgcacgtatttccttcagaatcttagtgaaggcgaactgagggccacgggagggagggagtaaggggaggaacctgcagagtggggctggatggagctagattcagaggcagcaagtggatgcagccccctcatcactcacattccctactgtcggtattttggggtcagttactctggtttaaggattaagacttgccagactagagtcagggaggagaaggcagagaccatacaccagctctttaccttctttgcttgtgccagtcttgtttcattgaaaggtttggcagtggaggaagagaaatttacagattcaaatgaggtttagggattatctggggagttcaattatttatgttgtaataataaccatcacttgtaaaggacttccctccttagcagcaatgatggagagctggctataactgtacttcctcagcccatccttacaaaaatgatcaaagaaatgtaacacgggtcctaggggaattggggttattttactatctttcctcttgcctcccctcatccttccttccccgatctgtctttccctttgtttttatctcctccctcttctctccctcctcctgccatccttctccattttccttggtgctctcctctcctttcccatttcatggcctcctagggtggtgctgggagctggccagaactgggcctgagatctcaaggagagaggaggcccactgagagggttgataagtgattccttgcagacacacctttctctctgtgacagtgtgtttctgaaaaaggtttgaatacacaaaaccctactttaaattccatttagctgagtcctcaggtgaattgtttttgaaagtggaggctcaagtccattctatgttcctgtcaatctgaacttcataaaaattgacttccttactttcttaaagcaagttataccagaagagtcttcaaggaattttatgaggagctgtgctaaactatgcactccccaagggcagggagcatgacttaatcttatctatacttccctggccccagcacagggctgggcatgagtaaagagccgatgaaaagggagtgatatttgttgaaaaggaacaaaaagaagaactcccttttcactggggaaaataaaatattggactaggcaactgagaggggtcatgggaacagtcctactaaagatcttcaagcctagaaatgtctttcacctacctagtgcctggaagccagccccggacatctctcaaagccctttcccaagtctgtagtgctaagattccaagggcaaagccactagaaaaggacttccttagcttttcctgaggaaacagtcccaccaggccataaacccaggctgagactgaagaggcgagggtcccacaatagaggaaaatgttttttcttgacctggggctttttccacccagagccaaagagacctaaactcaaggcctaaatatagctagcaataagcattctgaggcttggagactttaattttgccaaatgtgtatttgttttcctcacacgaagcctatttttaatcaattgccagctcctccggtccatttcctggaaaggaggccaagaaaaaaaaagtgggaacaaaaacatcaggcagtcatttgtacagtgctacagaaacagagtctctactgtcccctcgaacccacaggccttctttgacgtcaggggtgttgaggttttaataccaaacatagattattctatttagcctcatgcaggaaggtggctttctctaggacacagctcctcagcagttgcctttcagagtacttcaggctttcacctactcactcatctttggaaaggtcaagtcaatatcactggttttcagcccgtaacctaaaggaaatgaagtgatttgtgaacagcatcagctggtaataaaatgaaagaagatagcctacttccattcactcttttcttcgacaaacttttcttgagctcctactatgtgctaggggctgttctaaaagaatgggcatcaataagacacagctttgcccttaaggaactcaatttgccagggagattgaagggaaggggacttaaacgtatatgcagaatgcatgcagcaggagagagacacatagaggctggccattgccactgcctgtccaccaagaattggtgagtgctccaggcccttatggaagagcagaaggatgccctcctgccttatctaagatcttctgctgcctactttgttaagtaggagactgaaacacagagaacttatccgtttctctaggtccacccagaacgttgagagcaagggggtaaaagcccacattgggtaatcaatctcatgatcaatacagtgattagtctttgcactcagttactcattcaccgagtatttattgacgacctttaatgtttctaccactgtgctaggcagtgagagagacacaaaggaatgttaagagacgaccctcgccctcaagaggttgcgattttgacagaaacatcatgtcggccttggccttgattgtaacattagcaccagcacagtatttagcactgatacgctaccaacacatattagattaaataaataactgaattattgatatatacaaagtgccaaactaagaggaatagactatgggagtccaaggaaaaagctaatgaatgggtagtggcgtctttgaagaaggcactattgaagctttgagcagtgagagagattaggataggcagagaacagaaagcaataccttcaatgcagggggagaaatctgagcaaaggtttggaattagtacccagcatagccagtgtggggcttctgtggactccagcctggctggagtgtatactccattttgaggctggactttggcagactgaggaatttgaacactcccctgaaggtactggggagccacagaagggttttgattaagtgaatgacatatttttaaaagtgttttaggaagagtaatcaggcagcagtggggtctggcaggacagccttacagtgatggaggcatgaggatgggagcagtgggaatgcaaaaggtgcaatttcagaggaagctctgcccagagactgaaccaaatggaatcctgaatctcaagcagaaaaaaaccacattaatttgctaaacccgaaccatatctaagaattagctttcttttccttcatggttcagtgaaaaaaaaaaattaaatggctgctggaaccactcaaactgaaaccaagtatatattatctaaaattattgaatattttaaaacaaactactatcctattcccatattgcggtttgtgcctacaaagtcttaatactggccagggacagtggctcatggctgtaatcccaggactttgggagcctgaaatgggaggatagattgagcctaggagttcgaggccagcctgggcaacatgtcagaaccgcatctctacaaaatttagctgggcatggcagtgtgagcctgcagtcccagttacttgggaggctgaggttggaggatcacttgagtcaaggaggttgaggctgcagtgagccatgaccataccactgcactccagcctgggtgacagagcaagaccccatcaaaaaaaaaaaaaaaaaaaaaaaagaaagaaaaggaaagaaaagaaggaaggaaaaaaaaagaaaaagaaaaaacccaaccaaccaaacaaacaaaaaacaaaataaagtgttaatacctttaagaacagggttcaaaggtttgaattgtgttgccagaggctggctcttagaaggaacaaaatgtagctacatattttagtggaggcttttattatatgttggagtactgctttcatgcctgttggcattacatcccccgggctcagagaagttaagtaaagtaagtaacctaagagtaagaaagtaagttgctagagtcagcatctggtgacagagcatagatgacagagccaggattcgaacacagtctgacttcagagtcagctatggcatactgcctgcctatatatactactagtccacccttggtgttttaggaggcaggcaaacataatttgggggatgtcagaagttgactcccaagctacaaaggtgctcctgcagttccacactcacccatacacacaggtctgtccttttcagagaatagtccttgtacagctgtccgtttttgggggcagtaaataatctgtgcatcctccctgccctgtccccagggcctagtacaatgccagctaataggagacaatgtatgcttatgcatgggctcttgagatatgctcctgaaaatactgaaatccaattcaaactctgattaattgaaactcccttaaaattccactatgggccaagtgtggtggctcacacctggaatcccagcactttgggaggctgatgtgggagtatctcttgatgccaggagttcaagaccagcctggccaatatagtaagactctgtctctacaaaaaatatttttttaaaaaattccactacggaagcttactattaaaaacagtgggtctcaaacattgatgaacttgttaacacagattcttgaccccatcaccagagattctaccagattcagtaggactggggctgggcctaggaatctgcatgtttaaccatctctctttctcaaagatacatgcacagatacacgcagagacacccacaggcacacacaaataatgcactgatacaaacaggcaggcacacatagacacaaacacagatgattctgatgcagtctgccctgtaaccacactgacttcacctccttagagaaacactgactttaaagaatctgaagataaattcatctgtaaagtttaagtcttttcatatgtgaatagtccctctctgattcattttggagatcagcctttgattgtttttctgttttcttttttgcattcttatagcaggggagtcacatgtaataatcatcctaatgccagggcgtttcgttgtgactttaagtgttttagattcgtgatgaactccagtggccaagttgtaaactagtttgtgacatccaggaggacaggaactttcatttaattaattccacaggtatttatgtagcaccaactgtgtgtcaagcacagcagtgagcaaaatgaaccagttcctgccctcatggagctcacgttcaagttggggaggcagacaataacgtagtagacacatcagtaagttattttcatatgggaatgaatgctacagagaaattagaaaagggtgatgtattgcttagctcgggctgccataacacgataccatagaccaggtggcttaaacaatagaaatgtacttatttctctcatttctggaggctggaagtctaagatcagggtgccaacatggtcgagctctggtgagggctctctacctggcttgtgccacttcccctctgtgctcacagtgacctttcctttcacattcaagtagggagggagagaacgaaagtcggggtcgggggtgggtgggggaggggcgtggagtagggaagtcaggggagaaggagggaaaaagaggaggaggaggaggagagcgagatcttccttttcttataaagccaccaatcctatccgattaggaccccacccttgtggcctcatttaactttaattatcttctaaaagccctatctaaaaatacagtcacattgggggatagggctttaacacatgaatttggagggacaaaattcattccatagcggataatgtgatagagagcgacagggctgggaaggggtgtctttggacagagtggtcaagaaaggcctccccacggaggcgactttcaggttttgtgtagcaactcagctttagttgtttaccaggacattggtttttatttgtttgtttttttgtttgttttgttttgagagggcacacactgaagtctttgaagcctgaattcaggtcccagttctaccacttacgacttgggcaagttctttaacttctctgtgcttcactttcttcatctgtaaaatgtgcatggtgatagtccctatttgataggatactgtgaggatttgcagaactttctgcaatgatggaaatgttctgtaacctgctctgtccagtatagtaaacactagccacatgtgactattgagcacttgaaatgtggctggtgagacttaccaactgaatttttctttttacttaattttacttaatttaaatttaaatagccacatgtggctagtagctaccacattaaacagcacagatgcaatgaattcacacatgtgaaatgcttagcactgtgcctggtacatagcaagtgtcaataagtgctatctaggattagtgttagtggtggttacaagtatttttctggcaggtaggagttttttttcggggagtggggataaacaatcacactttgatttattatagtacatggctatgatgtctcttactgtagctccccacctgcccacctgtcttttcactgagctgtatggtagcccaatcccagagttggggagggggctggggaggacagcctgctccctggggactgactggagcatgctcctccctgtccagccgggtggagatcactggtgggtactacgaatacatcgatgtcagcagttgccaagatatcatccacctctaccacctgctctggtctgccaccatcctcaacattgttggcctgttcctgggcatcatcactgccgctgtccttggaggctttaaggacatggtaaggaaagaattgactttgcatttcacagtggcccctgttggacatagggggaaggctaggcagttgggggaaatgcagacacatattttgaagggaagaatcagaagcaattgcttcaaggatgtagctgccttcaaatgtctcaagttgaaggagccaggtaatgtcatcagtctgcaaatatttcttgttatacacaaattacctgtgttctggaggcaccttctaggggtggggggtgaaaggaggaaggggtgttctcagttcccccattcgcactggttatgtaaacatagtcttttatagccccaccccacacttttagtaaaattttttgggaatagttttcccctaacaaactttgggagagatggaaggaaaggttattctagctataggtaggattaatgctagtcttcccctccccaggtatttcatagtgaagtttcttcagaaagagcatctgggctcttttctgtttgcattcgcagagccagctctaggctaagttgcttgccaggtcttgccttcaacttggacctcaacctcagcctccccactttccattcttcccttccaaatcttttctatttgtgtgtgtgtgtctgcaaaggcacagcaggactcagcattcagtaggtactccatatagtaggcttctttttttcctttccttctaaggcatttctaagcatttatttgtttatttgataaatctagatctctaattatggagataatagctttgagttatggttatcaacctggcttcatataagaatcacctgcccagcatggtggctcatgcttgtaatctcagccctttgggaggccaagacaggaggattgactaagcccaggggtttgagactaggctgagcaacagcccctgtctctattaagaaaaaacaactttttttaattagctgggtgtagtggcacatatctgtagtcccagctacttgggaggctgaagtgggaggatcacttgagcccaggaggttgaggttgcagtaagccatgattgcaccactgcactccagcctgggtgacagagtaagaccctgtctctaaaaaaaaaaaaaaaaaaaaaaaaatgcttgggctccttctctaaagattctgatttaattggtctaaactgaagcccaggcatcaggttttgttttttggttttttggttttttttttttaagctcccaggtaattctgatctgcagccatgattgaataccactgctttaaatgaacatcccacatctgtttatggaattattttgtgcctaagagggactttcctttgaccccagaaattagctcctaggcccttggctgtttctgtcagattttggggtccctgaagaacagaacctgaaaggcagtttgtaatttgatcctggacggtcaaaaggatgaatgttggaaagtgaaaggtggggtaggacaagggaaaagaaagaaactctgtcgttttggattgcaagtctccagcagtactgggctgactggaactattaagtgttcctgctagtgactctaagtcaagagaaatcctttcctgcccatctgcactctctctttcttctttctctccctctctcatccgcacatttctcttcccagcttccctccccagactctggaatgcccaagcactaacaagtaggggaagcatcaacaaaggtggagccccaggagggaaaaggatttcctgtaaatttggccttgaggaagcttttaggttagagagctgcaaaaaaagctgtttctgggttggggcttctttggagaaaagaatgccctttgttcttggagaatttccccagggggcagatgaaagtacaggtattgtgtggaatctcagcagctttggctggaagagaagctcccaggtttggcgagttgaggagatgggacctcaggatgagtgttaagagttctctaaattgtccctagagctttcaggcttggatggcagagataccttgatgcacaaatggagtaggtggtagctacttggtaggctctgtggggtgcctgtaaggcttccccctctccaattttaccctactgtgggcgctgaaactgccaccatgttttattccttactttaagataagcattgtcctttttctccttgtccactttcaagatgcgtgtattaaacaaaggaataggctagtaggccacagaggtgtttatactttgagttactagtctctcagtgtgaaggatttgataagacccttttccatggtgatggaaagaattggattttgaaggcaaagggcatctgaggaagacagggagagtggctagatggacactttcaagaaatttctggaagttggaaagaagggaggaataggaagatgatatgctaaggaacacaaccctgccaagcttttagccttagctttagtcccgttttccctcactgtccccctttaaaaaaaattgaggtggaagtcacaaacataaaattgatcacttcaaagtgtacaattcagtggcatttagtacactcacaatgttgtgcaatcatcatttctgtctagttctagaactttttcattacctgaaacctgtacccattaaacaatcactccttgttgccccttccctgaggccccagcaacccctaatctgctgtctgtccctatggatttacctattacaggtattttctataaatggaatcatgcaatattcgaacttctgggtctggctcctttcacttatcatattttttttgtttttaaaattcatctaccttgtagcatatatcagtgcttcatttctttttatggctgaataatattccattgtatggatagaccacgttttgtttagttttttatccattgatatacatttgggttgttttcatgttttagctactgagaatagtgccttcatgaacaatcacttacaagtacttgtttgattacctgcttccaattctttttccacctatgggtggaattgctgggtcatttggtaattctatgtttaactttttgaggagctgccaaactgttttccacagcagctgtgtcattttacgttcctacctgcagtgtgtgagggttccaatttctccacatcctcaccaacactttctcaaaaaaaattataaacattctagtgggcacaaagtggtatcttgttgtggttttgatttgtacttccctgctgaccagtgatgttgggcatctttttatatgtttgtgtgcaatttgtatgtatatcttctttggagaaatatctatcaagtttttgcagatttttttattttccaaacaatattcaagattgttaaacaaaattttaaagtattataaaatgtttaattttcattagctttaaggtttatgttacccccaaattttgtatataactgaagtttcaaatctactaacactcactgaattgataccactctggattctaaggcatcagtttcttcttaccaatttttctttgcttcttctaacatttcttgtgtttcatcttgagaatggctaatgaaaacatcaccaatttgataaggtatcattaagcagtcatcatctgcaagcatgatgtcattgcaaacaacttctaaattgtggagttgtttccttttaacttctgtttcttccttcagctctgtgattctactcatattccttgcaaatttgtttacctaatgttgatcttcaaaagtagcgttgaaattttctgcagcctgtaaacaacagcactagtagcacctacctgtggacttgtgagggctgatgtgataacccaggtaaagtgcatgtattagtccattctcacactgctataaagaactgcccggccgggtgcagtggctcacacctgtaatcccagccctttaggaggccgaggtgggcagatcacgaggtcaggagtttgaaactagcctggccaacatggtgaaacgctgtctctactaaaaatacaaaaattagccgggcatggtggtgcatgcctgtaatcccagctactcgggaggctgaggcaggagaatcacttgaacctgggaggtggaggttgcagtgagccgagatcgtgccattgcactccagcctgggcaatagagtgagactgcgtctcaaaaaaaaaaaaaaaaaaatagcccaagactgggtaatttataaagaagagaggtttaattgactcagctctgcatgactgagaaggcctcaggaaacttacaatcatggcagaaggagaagcaggcacatcttacatggcaacaggtgagagtgcatgtgaaggaagcaaagggggaagagccccttataaaagcatcagatctcgtgagaactcattcactatcatcagaacagcagcatggaggaaccacccccacgattcaatcacctcccaccaggtctctccctcaacacctggggattacagggattacagttcaagaggagacttgggtggggacacaaatccaaaccgtatcagtgcatcaagtgcgtaaaagccaacctcagtcaatgggaccttcagtttcccataccctaaggacaaggcctgggctgcagggtcctcatgctccccagaggcaccctcagtactgagagaggtgcccagagccctccatggattccggcctggggaccccctgcctcaacaagccaggtgactaagcaaatgctcagggccctaggtgcagacagggctccccacagagcagctgtaagggctgggggcctcagtcttgggccccacactgagcttcagagctgggcacccccagcatcccacaccctccactcccctgctatagctgagacctggccactgaccaagaatcctgcccatttttaaatctgttttgttgttgttgagttgtaagagttctttataaatagcggatactagagcattatcaaatatgtgatttgcaagtacttcctcccatgctgtgagttgtcttttcactttcttgataatggcctttgaagcacaaaagtttttaattttgatgaagtgtcatttatctatcttttcttttgttgcttgtgcttttagtgttatatctaagaatctattgccaagctcaaggtcatgatttccacatttttgcctaagaattttatagttttagctgttacatttagggctttgaaacattttgatttaatttttatatctagtataagttaggggctcagtttcattctttttcatgtggatatccagttttcccagcacatctgttgaagacactgctctttccctactttatgatcctagcaaccttgtcaaaaatcaattaactgcagatatatagatttgtttctgcgttcttaatttcactgttatctttgatctcctgaggaaaaaatgggtttgctgatggtctgtcttgatagcggcaataatggcccctaaccctctgcaaagtgcttttgcacagttaatcttcactattactactttgtgaggtaggtattactgtctctgtttaacaggtgaggaaacaggccaagaggggtcaagtgacttgcccagagctgagtagcagaactgggactggagcccagatttgccaaatgccagagcctttgctctttctatttcatcccagctgcccctgactaacatttgggtagccctttctggttctatgagtgttttaacatatattacctcctttgtttagttgatttaattaaaaaattaaaagcaagttgtttccacctgttgggagcttctttgacagtacggaaggagagcaagggaagtaccgagcattatcaaatgtgaatcccgggaactctatcaaggaccagggcagaaaaaaaatgaaagcaaagatctggggagaagatctttgattcatgagattagagaaccagtgggggcacagataaggataccaaggaggaatcattgcctagatcactctattaaaataagaccatggtgtaaaaagtccaggaacatcattcaggtgagcctaagtacaatccttggcctacatccaagtgtggttggtgacttgtgatgtgcctctccctgagtagagtccccggggtctgcagggaggcccgggggtgctggctgatgaaagccgtttgcagagagtgaggacaggagccgagggctgtgagctggcagtcttcaatggaatcagctaggaaccaccatttccaaagttgtgggatcctgaaaggaaccctgacaagaggtgcttggtgaaaaagatcttaaagaaatgtttgaagaagtgcttgttgaccaaagatatgaggatttgagatgaatttttaaaaagtgaatatatctttccattttctcctaattggtatcgctggtttagagtaaactggagagggaaaaaaagtagcattctttccaaagtccacaatcattgtctcagaatagactcagttttgtccaggcaagattgctttcaccatttgctgtgctacctagtaaccttttgtgttactggagctcggaatgctactgatcaataatgggggggcagggcgggcgtctcacaacgtaagccccagaattctaacagaaatacacatacacacacacacacacaaacacacactcctatacgtgcacacaaatagaaacagggcccaaatttattgtaaaatcagatttattgatttaaaatataaccagaccactattttggcccatctcttttgccccatccctgactaagtcttcactccattccccatttcctcttcttccttctcttgctggcttgtccattttctctatatcctctacccctgactgtcttctcttcagagactttcctatacccatttaatcttactctcatgtttcttctgtgctgccttctctaaatagtcaacttcctttcaaatattgtctagacccttggccttgctgaacacacaaaaacttttatatagtttacattgtatgattgtttctccacagttaggcttaatttatttagatagaagagctggtttcattttgcgagagctggagggtgtgtttttaattgacagtatgccaagggaacatgatttctggtacttccccagagacagaatttctttaaagaattctgggggagaggtaagggcatttctgagtaaatgtaaagcaagccagcccttggaatggtcaagatctcagccctctttcacacattaaagaggctgacaaacatttatctggctgtctgtgagctgtattatgactgaggtttgtagctcttcaaacctcctagagatgtaaacagtaacccactccaaggaagagagcaacagaactgtgttgaaacttgctggaagggagtttccccctgccaacaccctaacatggttgcctttgtgactgccaaagcctgcctacacattttcatcacttgagaggaagcttctgcttctctgttaatgtgctgtagctatgttccaaaaggaagacacattgatttttcagacagctctcaattatacacatgaatgggggaggtatcaatgacatagaagatggaaaaatcatttaccccacaccttgatccatgtggcacaaagcacagtcctacttgggaactaatgagtagtggtaacttcctttagcagtgctttggctctgatgagagcagggcctccattctggacaaggttagctttaacccttgaagggctacacacaccaccatgttgtgaaaaggatataaaattatgtctgcatcgttttatttgcaaaaaaaaaaaaggtggggggatcaatatatttttcttggtctttcatggcttctgtgcactgctaggattttgcctctactctacagggctgatgagaaatcaatacccttcatgtcttcaggagacccccttagcaaggttgggatctctaagaatccttacaacttttacaaattctttgtgattgaacacactctgtcacagcaagaacactagctggttcggccttctctatttgatgttttgcattttgagtcttattttttctttttaattcttgtttttaaaaatcacacaaatgatttcaacttttctataggtttaaatttttcaagttaaaaagtttggggaaaatgacacaatacaaattagttgtaaacattttgacatatatagtagaaagttaagaatccctatatacctcctaattctactctgctccccagagataaaccacagttaatagtttgctatgcatccttccaggttaatttctttgcatttacaaacatacatacatgtataattttgggggtctttttttaaaacataaattgggatcatgttatattaatgtaacataatggcttttaaaacataaaaatatatcctggacaaccttctctaaataggtccacatcattgtttatcaatagctgcatggtattccatagtatagatgtactaagtttatttaaccattctcctagtgatgactgtttatgttgtttctaatttgtgtttttctacagaacccaactctcccagcactgaac

SEQ ID NO: 4982 - DNA, 20259 bp, human; identical to SEQ ID NO: 3674

SEQ ID NO: 4983 - DNA, 17517 bp, human; identical to SEQ ID NO: 3675

SEQ ID NO: 4984 - DNA, 20259 bp, human; identical to SEQ ID NO: 3674

SEQ ID NO: 4985 - DNA, 3322 bp, human
accagaatctttcccgccttatctaagtcctctcaggccagacttggtgggaggttcctaggattcgctccctgcccttcccaccttagggtgtcctctgagacagactcttatttcctcaataaagagaaagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacatggtgcctgcggccgaggtggtcggagtcgcagggcccgtggaaggcctcggggaggaggagggtgagcaggcggcaggcctggccgcagtcccccagggcgggagcgccgaggaggactcagatatcgggcccgcgacggaggaagaggaggaggaggaagaggggaacgaggcggccaacttcgacttggcggtggccacccgtcggtacccggcggcgggcattggcttcgtgttcctgtacctggtccactcccttctccgccgcctctatcacaacgaccacatccagatagcgaaccgtcacctcagccgcctgatggtggggccccacgctgctgtgcccaacctctgggacaaccctcccctgctgctgctgtcccagaggctgggtgcaggggctgcagccccagaaggcgagggcctcggcctgatccaggaggctgcgtcggtccaggaggccgcgtcggtcccagagcctgcagtgccagctgacctggccgagatggccagggagcccgcggaggaggccgcagatgagaaacccccagaggaggccgcagaggagaagctcacagaggaggccacagaggaaccggccgcagaggaaccgacctcagaggaggccgtggcccccgagggtaagggggctagcggcagcagcggggaagcggggatccatgtgtccaagggctctgggcagggctgcggtgcgggcacagctggtgaagcgggtggtgaaggggggtcggggcctcgggtggtgaagcaggtgttggggccctcctgaaacttaaggctgaatgtgtcccagtgagtcgaagcccaattctctaatgacatctatggttttgagaaaacttgccgccctctaccaacctatatttgataggagatctgagatcatcgatgccatttgcgagcctgcagatgaatggccaggtagataggggttcaggagggagctccgcaggaaacagaaggaaaagaacaggcaaatgggaggcaggcgtgctttttggttcatggcttttcaaagtgtaaagattcgtagaaagttgatcccccaaatgatgaagtgatacaggagcacttggtaaaaatgaaacattcagggggtgaggaaccaatgagcttcaccatagaatttgtcttttgaggtaaacaaatattttcccaacaaagttctgaccaaaacaccatagaatgagatcagacccgatgattcagatctcttcttctccaaagaactagaaataatcagccgctttgggtgggagatttactggaaaaaagggaaatacagtgtccctgtggaaatgatcaagcagcagcaacgtgagggccatggaactgttgtgaaaaccagtaggaaggtgcccagctattcctttcttacttaactctatcctgcttctcctgagggtggagtaactgaatgccgctgctagttataaattgggctatattttctgtgaatgtctggtccccatgtgtgtattattcttccctaaagaagtcactaaatctcagcccgaaaagtgggatgaagaggcccaagatgctgcaggcgaggaagagaaagaacaagaaaaagagaaggatgtggaaaacaaggtgaagaactccaaagggacctagacgcagcagaggtgaagccaagaaaatccaggtatctgtgtatagctttgagaatcagtcaactattcctggcatttacctgttgcagacagttttattgaacaacaacaaaaattctcagtaagttaagtaagaaaaagtttaaaattagtttaaaaattcaatttaacttacttaaaatgttacgagaatattcatgtacctagtaatatgaactgcagtgtgttctgaaatatacttcttggctactcatttgttcatgttgaggtcttttgtcctctagctgcaagactactaacaagtggcagatgtatcagacctactaccaggaccaatatttgtgtagaaaacagttgccagacacagccgctaacttggctgggccacgcattagttgggccttcattacttgaccacagaaatgcaggctcccgtagtaactaggagacaactcaatgccttttacaaagtgactacttaaaaatagcaaaaagctaagaatttcaagtaggaccacaattaatgactaatacctatatatttatttagctatatattttggtattttatgtcacagtcagatgaaaagaatgtgtgtttatcactgaattggtaatgaagtcttaaggtatatctgtctttgagtatatttaaatggttaacatttttctttctttcttatttattttgcattttcacagccgtatatttcgtaacggcttctttcccacatggtagatacggaaaccaagggtctgggagggtaagggagtatcatttgtggaaccagcacaggctgttgaagcttgagagatttatttaaatcccagaatggcccctcatgtaaaaacaaaagcaacaagcttttctagtgctaggcagacaaggttggtgtgatcatttgactgaaaccttcagttccacaagcaccctgatatccaagctcgtgagttacaaaaggaaaagatgggcttctctacctgtttaagatatagcacacaaatgttgcagatatacacagagctggccattttcttctatttagaaagtcactggtgctggttaatgttgtactattgtttattttctctcatttcatcccacagttgggaggaaaagaagactctgttgttcattgttttatttttttttcagatgcctgtgggaattgtaacacatatcattccaaagttcgttacatcaaaagtgatatccagtgacatctaactttcatggatgtatgtgacagtgtttgttcaagttaaaaataaaagtttgttttcaatgaataa

SEQ ID NO: 4986 - DNA, 69141 bp, human; identical to SEQ ID NO: 3680

SEQ ID NO: 4987 - DNA, 20382 bp, human; identical to SEQ ID NO: 3681

SEQ ID NO: 4988 - DNA, 20528 bp, human; identical to SEQ ID NO: 3682

SEQ ID NO: 4989 - DNA, 20046 bp, human; identical to SEQ ID NO: 3683

SEQ ID NO: 4990 - DNA, 233177 bp, human; identical to SEQ ID NO: 3684

SEQ ID NO: 4991 - DNA, 298561 bp, human; identical to SEQ ID NO: 3685

SEQ ID NO: 4992 - DNA, 306660 bp, human; identical to SEQ ID NO: 3686

SEQ ID NO: 4993 - DNA, 306430 bp, human; identical to SEQ ID NO: 3687

SEQ ID NO: 4994 - DNA, 304363 bp, human; identical to SEQ ID NO: 3688

SEQ ID NO: 4995 - DNA, 69141 bp, human; identical to SEQ ID NO: 3680

SEQ ID NO: 4996 - DNA, 20382 bp, human; identical to SEQ ID NO: 3681

SEQ ID NO: 4997 - DNA, 20528 bp, human; identical to SEQ ID NO: 3682

SEQ ID NO: 4998 - DNA, 20046 bp, human; identical to SEQ ID NO: 3683

SEQ ID NO: 4999 - DNA, 233177 bp, human; identical to SEQ ID NO: 3684

SEQ ID NO: 5000 - DNA, 298561 bp, human; identical to SEQ ID NO: 3685

SEQ ID NO: 5001 - DNA, 306660 bp, human; identical to SEQ ID NO: 3686

SEQ ID NO: 5002 - DNA, 306430 bp, human; identical to SEQ ID NO: 3687

SEQ ID NO: 5003 - DNA, 304363 bp, human; identical to SEQ ID NO: 3688

SEQ ID NO: 5004 - DNA, 9128 bp, human; identical to SEQ ID NO: 3695

SEQ ID NO: 5005 - DNA, 1089 bp, human; identical to SEQ ID NO: 3696

SEQ ID NO: 5006 - DNA, 9693 bp, human; identical to SEQ ID NO: 3697

SEQ ID NO: 5007 - DNA, 9128 bp, human; identical to SEQ ID NO: 3695

SEQ ID NO: 5008 - DNA, 9693 bp, human; identical to SEQ ID NO: 3697

SEQ ID NO: 5009 - DNA, 30516 bp, human
tcccagagccctccaaaacaaaagaccagagaagcactctccacccagcagccagacgcctccttcttgacgccagcccccaccctctgtctgctcgagcccaggaaaggcctgaaggaagaggccggggaaagagccctccctctctcccttgtccctccatccacccagcgccggcatctggagaccctatggcccgggctcactggggctgctgcccctggctggtcctcctctgtggtatgtgcatcctagcttccactggaaggcagctctgacctctcccctctgagctcagaaagggttggagtgagggttggggcccgagtctctttttctgttgcttcctctctctgacttgaggaagagacacctcagggccagtgttgggggccctcataacttggatcgagtctggtttggcacctttccattccccccgttatagaaaaaaaatattctgacactcgttaaaacggtaaggaaaacttaatttaagactaccgcattgcaatagaggagagaaatggggctcaactctgattacagaaaagacttccagggatctgtagccaaggagcagagtgagggggtcagtggatggaaaagtattaagaggagatagcaagggtagggggattcttgctaaaccgactgaacagcattcttgctgacggcaggccagagtgatcagatatcaagggtgtctaaactgacttagcaagattcttgctaagactgggtgatgcaagcctggcaagggcaggacagacacagaaggccaaggtcaaggccaagtggagaagaggctttgggggagcctaactaaactttggtcaggaagagagtctttcctctttgtcattcctgcggcaccctctctgtcctcaactaggtgcccagcccagcgctcccaccctagccttcctttctttgttgtctgtcagcagggcctgatcagtcactcaatgtccagttcctgagcacctacccagtgccaggccttgtgccagggaccacagagtcattcagctgcagagcctgctcttgggagccacagccctggcctcagagaacagcatattctggtgtccagagagacataagttggctgtgtcctcattcttatgttagcatatcagtgccaacattttgccagggatctgtttctacagaaatgggtgtttgttttcttaaatgaacagtatgggtcgcatctgatccttgagtttatgagaccaagataaaatcacacaggacgttcatggtgttgaaccccagccaccctccttgcatctgtagctcagcccactcgaaagtgtggctgggcgtggtggctcatgcctgtaatcccagctctttgggaggccatggcaggcggatcacttgaggtcaggagttcgagaccagcctggccaacatggtgaaacactgtctctattaaaattacaaaaattagccaggcatggtggcgcacgcttgtaatcccagttcctcagggggggctgaggcaggagaatcgcttgaactcaggaggcagagattgcagtgagccaagattgtgccactgcactccagcctgggcaaaagaaggagactccatctcaaaaaaaaaaaaaatgcgggcgcggggggcgttgggcgcagtggctcacgcctgtgatcccaacactttgggaggccggggcgggtggatcacctgaggtcaggagttcgagaccagcctggccaatatagtgaaacccccatctctactaaaaatacaaaaattagctgggtgtggtgggtgcatgcctgtagtcccagctacttgggaggctgaggcaggagaatcgcttgaacccgggaggcggaggttgcagtgagctgagatcgccccactgcactccagcctgggtgacagagagactctgtctcaaaaaaaaaaaaaaggagggggggcgggggagtgtaatgtctccccacactcagggccccattaccatctagggaaatccctccctaaaagacaggggggttagaggcaaggactatcagagaccgctttgtctaattcaagcccctcctttccagaggtccagagcctggagaacttagtccagtgcctggcacacagtaggcgcttaggagatggttgctcaatgaatattgggggggggtcactctcgagtcactctaaattgggggcagagcccaaactagaaactagatctccatatattctgtcccttctgtggcatcacctttttcaggcccacctctcatacttggcagagtgggaggactgaaagtgcgctcacctcttttgtattaagatggcctgggttcaaatccctgttctaccactgactcctggtggcacaagttagacaagttaccaaatctatctgggccttgacttcctcctctgcagaaagtgaacaataatttccacctcatagtgatgtcacaaatatcaaatgagatactgtagatgaattgctgcgttcagtatctggcacataatagggtgtctttaaatactaattaatccatctttccccaccatggcagactaggatttctgtctaatatattgaaaatgagcctggaatgataggcaaagatttggactgtaagaaacagtgcaagcaggccttgaattgaagtcaacccaatgtatcatacaattagatttataaaaggctaaaatgaaggtggggtgattatttagcgtgatcttctagagcatttcaaagaaaatttgataacaaaaatttaatttacacacaacttttctacttcactaaaccctgaaaagacccaattagattagaagaaaaattgatttaatgagcactaaaacccatccaaaagtggcaatcacttgtctatgaaacagatttctttgattgtgacccagggtgctatccagttcagcctgatttcctatgaaatgtgattatttttatcctcaagtagagctggccagcttcgtgcgtttcaaaggatggaggccccgtggggcgggctgagaggatactccttccctctctaggaactagctggtccccaaatgaccctggatttttctcccggcttctagcttgtgcctggggccacacaaagccagtggaccttggagggcaggatgtgagaaactgttccaccaacccccctgtgagtgccccctgccccccgcgcacggcccccctggccccacgcacccccccacccctgccccacgcacccctgcaccgcagcacccccgccctgctctatcatcttctctatccctcattgggtcagttggtagcccctcctcctaccaggctttctcctgatttccggactcttgggcccctcccccctccactccctcccctccacatcagtgccctcccctccctcccattcattcccccagcaggttatctgcttccgtcctgatctgggcctgggaaacccctctaggaggagggaggagggcaggaggcccctaactggcctttggctgaggccaggcagaggaaagaaaagacaaattctagagtgacagcaaaaagagaagcacagaagggaagagggaggaagacagaggttagaagagccaacggaggccgagcacggtggctgacgcctgtaatcccagcactttgggagaccgagccaggtggatcacctgaggtcaggagttcgagaccagcctgggcaacatggtgaaaccccgtctctactaaaaataaaaaaattagccaggcatggtggcgggtgcctgtaatccccgctactcaggaggctaaggcagaagaattgcttgaacccaggaagcagaggttgcagtgagccaagattgtgccactgcactccagtctgggcgacagagcaagactctgtctcaaaaacaaaacaaaacaaaaccaaaaccaaagaagagccaacggaagggcaagagagggaggcctagggtgtgcagacgaggaaaaggcccagcagaaggggcttgggtagtcagcttcctagctggagaccagagtgattctttctacaatcagagtagggctaaggggtaggcatgccagcagcactgtaagccatgggaaaaacgcagtacatctgctagcaatatcaactttatgggacccctggggcaggcaggtgggtgggcaaaccacattacttttatattaaaacaaacatggatatatcgtggagtagaaagcaaaacagcacaaacggaaacatgcttttcgttttaaagctaaaatgacctgtaaagaaatagagaactggtctggaaagggtctttctgggcaatatctcaaactgctgggggcattcattcactctcctctgccatttgggaccagtgggtggcaacctgaaaaagccctgccaagggaaggttgccagataaaatacaggacacccagttacatttgaattttagataacaaataagaatttagtgcaagtatgccccaaattgtgcatgttttaatataatacttacattaaaacattacacattgtttatttgaaatgcaaacataactaggtgagtgtcctgtatttttatttgctaatctggcaaccctacccccaggtagccaaagaaggactgtctgcatggcctggcccaatgccagagctcagacccctgcagttctcacccacacccatatcccagactcaggtcccattactgtcacaaggggtccctttccaaactctccaacacctccatctccacccagcccaggcatcttaatctagactaagcagtaacatcagttgccaccccatcccttcccaagccaggccagcctaacttcccccaaccgctgcttcaggagaggctgggggctcttctggaggccaggggcccagatgtcattttctctaagcaacgtgtgtatctgtttgtttgtgtctcaatgtcttcttgtcatctgtcagtaccttccagttactgtggtcaataccacaatgtcactcacagccctccgccagcagatgcagacccagaatctctcagcctacatcatcccaggcacagatgctcacatggtaagagacagcttctctcccccttgccctctctgctaccctgggtcagagaccacaaacaggagctgttaaaactcagaagatgaagacagagaaaggatctgatgggcaaagggagggaagtagagagcatggacacggtagttttagggcaagtgaaagaatgtatccctctacataggcgggcagacattgccaaacctccttaacctcaagaaattaaactataaacaacttcagaatcaattttcatcaattcccagaaggcagatccagaatgaatgtttagggtatccctgccctaggaggttagaaggtgggctggaaattgggctggaagaactccaagctcccttctggcccaggccttcccatactctgtggaatggagtagcaaaataatccaaaatcctgggttaagggagcgcggggttggttgtggaggggggcacccatcccaccgtttcccctcactagctccaccctccacaccatccacctttccaacaccagcccatttggaagagagggcatttttagtgtcaatgagcttgtttaaattaattttcccacatgctgggaagggctaagaacgttgggtaagtatctgaacttccctgagcctcagtttcctcttctgcaaagagaaatgggtctgtaatgagatctatctccaaggattatgaggatcaaaatatgataatgtgtaaagccctttgcagaagttatgatgttcccagtctactgtgcttgactcaggagggagaaggattagctggaggggaaaacccaaacgagccaaaagacaggaccctagactgcatagaatttgcagggcagggcaacaagtctcctttgcagaacagtccagtgttacactgagtccagtgtgaacagtgtgggggcgggggagttgaactgcaaaagatacggttgctcaaaggaagggaagatattgaaggctgggagagttacagagggcttcctggaagaggcacttggtgtgcttgggcttgtagctgacaaggggttggagccgacagacagaaataactgggatgtggttgggggcctttcatgtgggatctgataccacgaaaaaggctaatgatggtgttgttgatttcctagaacgagtacatcggccaacatgacgagaggcgtgcgtggattacaggctttacagggtctgcaggtgacaatcattacccagccccattgcttttgttggtagatccagaggtggtcacagaggacctaatgtggctagtgtctcagcatctgggaccccagaacctactgtagagaaaacccttctactctctctgtctccctccaccaccccaaaaccatcagattccccagggcacatatctcatagcccaccagccactttctgtgtagaaatgaggcagaggctgccttcctgtgctcattacctctgctgcaaccaggcccagtccagcactcccaggctccgtttctaaatagttgctacttctacctctaaccgctaagaacccgctgattcctttcacatgagggctcatttggagacaaagttttcctttgccggttgttttacggacaacatcacttcacatggccaaatgagacacaaacatataagcccttgatgagatcacagtgtctgaaggggcctcgcaccgtgatcctggcccattgaatgaaatccaagcttcctttcctgatcctcaaacattcctccttgggcttcaaactaccctgcctcgtgcctcgtaggctctttttccctttgccaaagtctctggattattcttgcccagcagtcctcagctgagcctctggtttagcctccctatcagccaccgagtctttacgctgagccccatctttcctgagagcgcctacatgcagccaaaagttgacctcacttctgctgaaagtccacaagcagccctcaacacaaagcagaggtgcctgattcaggacacctttctgccagctccccccacagctctttttaagatctccttcctcacttctttccaatggaggagagaatctctttccagaggccccttgtggcattctcagagccagcactgcattgcacatccatcagctaatgccacgttcctccccttcaccctcacctgcaagtttctctgttctgccccaggaactgcagtggtgactatgaagaaagcagctgtctggaccgacagtcgctactggactcaggctgagcggcagatggactgcaactgggagctccataaggaaggtagaagggccgcatggatttgttccccaagtcttgggacctggactaggttcaggaaggtataggtgagagcgtgcatgtaagaccatgctgggcctctatggggagcttaggaaatttgaggccatcactgactttcaaggctgatctcaaggaagacacacatggtaggaccatcagacagaacccctggctggagagcctggggctggccctgaaggtgacctctgcattgcttcctatctttctttcagttggcaccactcctattgtcacctggctcctcaccgagattcctgctggagggcgtgtgggttttgaccccttcctcttgtccattggtatgctcttccttcagtccctgaatttgtccatgctaacgagggtgactcagcttccctaggatataaagaaatggaccttggtagaaggaggggcggtgggactataaagatagagcatttgaaattgtagttgcagaatgttttgcaatgaggatgtattcatggattgtgtaattaaaatacatttaaaagaatcagtacaaatattttaaaattcatgagtgcagagacccaacctagaagactcagtgaatcattaaagagctagtggatgaataggccaggatgtgcttgaacccagaaccatcctctgtgccctggaaccctgccaatgatgatgctggaatcacatggtaaccctcttctggaaggtagcttagaagggtcaaaagagttgggagggcttctgagtttaaaaaaaaaagggcccctgagaatacaactcccggagttctggggcctcagacagctggcaagcccattcccccaaaggggagtcctcatgaatatgtactgaaaggcttgtgctttagaactggcttctctgccagcctgtccaatggcctgaacatcaccattccttttgactgtgacactgaagccctgataaaataattagtgcccaagagaaggaccacccacagccactggcaatgaaaaagacaagcttagccaatttgtggcagtcagtgttagagtaggctcagggcattaggcttggaaagcagaaagaggatgagaaacataccccagcgtgggcatacatgccgggggtggggggtgggcaggctgctggggcaggctccgggcagctgggctgcaaagggaggcaaagggaaccaggactaactttgcctgaatcacaattttttcctggggtgtaaatgggcaagggacaagtgactccttcttgtctctgcagacacctgggagagttatgatctggccctccaaggctctaacagacagctggtgtccatcacaaccaatcttgtggacctggtatggggatcagagaggccaccggttccaaatcaacccatttatgccctgcaggaggcattcacaggtgattcagtaagcccagtttccttcccaacttgtagcaacgcaggtcccggctgctattccgtaggtggcaaacttcatcatcagaggtaccaaagcagtggtttgcaaaccttagcatgcacctgagtcacctgggatgcttgtttaaaatgcagatttcagggccccctccccttgaggagtctgaatcaaaatgtcctccggccatatttagaaaatgttgggttaaagaatgttaggatttgaaacaagatggagcaggaagggaggaaagaagggaaacagagaaagatgagagaaaatatccaacccctttcaagagagaaaaaatcatgatatgatttgcttgcctggtggcagagactgatccataatgaatcattcagacctttacttctgaccctcttgtgatgaagaatttagatttgtgagatggctggggtcaggtgggccaggagtggacagaggaagtaaataactaagttcagagtcattctgtagcacagattacagttcaggttttgctggaccaatcaggaaggttagaaaaatataacatcaataaccttgaccccgttgacactatctaaatccatcacaaaagaacagtatgttgtaagattcctgtaagtcgtaactaaagtcctgaccaggaccagcctactgattatgaatcagtgtcttggccaccaaccagtcctatctccctgggaattctgaatgagccaatgaacttggattcctagtaacattgatcaagccaagagatccctttccgcatgcaagtccacataatttctcacttagaaaggagccaatacagcaggagggagatttcaaaatagcagccatgacgaaacaagtgaaaattgtgtccatttttctttatctgttctgatgtaacttccagaatcattctttctgcatcttgacaccatttttaaagaaatttgttatccaagactgttaaatcataaataaaactcatcttattcagataaagaaagtcaaagttatgtcgggaaggggaagggaaaaaagaaaaaccttcctggggctggaagggttttgtcacttcccaaaagtgaggggatgccgagtcatcacccgctgccagtcttcaagaaaaaggcacctggagcttgagtttggaagccgaagaacagagttcagcttcaataagcttataaagacgagagagactttccagccacttgcagattttaaaggagaaaggagagtgcaaagggcagaacatgaaaagttcgctactcaaacatacctgtacgcaccagaccattgaaatttgggttcatttggtttctcagaaaggtatcatattcctgaaccttgaaaacataattgcaagtgaaagaagccagtcagagaaggccacatattgtacaattccatttgtatgaaatatccagcactggcaaatccatagagacagaaaatagattagggatttcctggggctcaggggaggggggatagggagtgactccttagtgagtacagggtttcctttggggatgaagaaaatgttctagaattagatcgtggcgatggttgcacaacattgtgagtatgctgaaagccactgaattgtgcactttaaaaagattaaaatgatatgttttatgttatgtgtaaaatacacataacataaattatgtgtaaaatatgtagtaaaataaacctacaaaaatgtattgtacccaaagctttggtcattgttgaatagttttacctgttcacatgaaatatttttcacgacattaagttatttatgctcatatctgaacccaactaggacccttaatgtttatggccttcggccagcaaactcctagtcctgcctaggggtagactctttgaatatcttgcagggggcagggatagaagatgaaaactaaagtcatagaacccagatataagcatctgagaaaggacggtgctgtgacacagagtttaaggacagatttggagactgagaatgttatcaagacagtacggtgtctgtacagattaagagcgtgggccatgcagtcagacagaccagagttcaaatcccagctctacctcttgcatccatgaaaccctagacaagtcactttacctctctgaagcctcagtttccttatctgtaaaatgggatgggtaagaattagaacaatgcacatggagtgcttagcccagtacccgtggcttagtaaatactggggttactgcagagaaagttgaacacggccccagccctacccctttgtccttcaactaggactgctctcttgatctcagtctgcatgattatttattaatcagaaagatacaagagttactacatctcaagataccattctgtgtgctttacaaatattaattcattccatcctcatagcagccctattgaggcagatgcttattatactccatccccattttacaaatgtgcaaaatggaacacagaggggttaggtaatttgcccaaggtcacccatccagtaatggcaaagccaggatttgagccccatctgggtccagggcccatgtcattaatgagtacacaagtaagagtttgtttgaggaaagggtttcgctgctttttaagaggatgcaaaactgttaccctaaggctgaccttccaggaaccgagtgccaaaggcaaggtctgtcacttacacttttttggggctcctttgcttctagggagcacttggcaggagaaagtatctggcgtccgaagccagatgcagaagcatcaaaaggtcccgactgccgtccttctgtcggcgcttgaggagacggcctgtgagtgtggatttgcagacatgggtgggcgcctgggtctccccaatgccccaagcctcccgggccctgcagcacagagctagctcttccccaaataaccatgtgcccaccaattcttgagaactccatggccacagcccgtgggaaccaagaagggtaagggggcaggagctcatggcttcagaaaaaggacaaaaggtagccctgagcaagctgggaccagcccacaggccaccagaggaacgaactgactatggcagcaaagtgcttctgtcccactaaggggaggaggaccaggaaatgcctcccaacaacttagccactaccccagggcactcacactcccagctttagcacccagtgggactctactctttccgacatggctcaggacttcttgtctgatccctatggctgggcttcagatattccagggacccactggaactgtgtgctgactgctaagtatctgcatttttctggggggaaaagatccataactctcaacagcatctcaaagacgcccactcccccaccccccccccccggcaaaaagattgagtaacatgcagaggtagatgatacaagcatgctgttggtaatctttggaggccaaaggaaacagtggggcaaaagtgtcagaaatgcttgcctctggccgggtgcggtgactcacgcctgtaatcccagcactttgggaggccaaggtgggcggatcacctgaagtcaggagttcaagaccagcctgaccaacatgttgaaacgccgtctctactaaaaatacaaaaattagctgggcatggtggcaggcatctgcaaacccagctacctgggaggctgaggcaggagacttgcttgaacctgcgaggtggagattgcagtgagatcttgccactgcactccagcctgggtgacagagcaagatactgtcaaaaaagaaagaaaagaaagaaaaagaaagaaaggaagaaagaaagaaagaaagaaagaaagaaagaaagaaagaaagaaagaaagaaagaaagaaaggaaggaaggaaggaaggaaggaaggaaggaaggaaggaaggaagggaggaaggaaagaaggaaggaaggaaaggaaaaaaagaggaaaagaaaagcttgcctcaggcagatcagcattaaatattccttgtcaattctcttcccagggctcttcaaccttcgagccagtgacatcccctataaccccttcttctattcctacacgctgctcacagactcttctattaggtatggcttttccttagcttgctgttgtggactttctccaacttccaccctcttgatgccccaccactgatcccgccttaatatacagccctctggctgcccatcagctcggcgcctgctgcagcacgaccctttagaaaaccccctgttgtcttttcctgactctttaaacctctgtccctattgaatcccaaatctggcctgcttggctccctggggctggcttcctttgacctccaggaacagagggactgtgactgcctctggtcctttgcatccttagcagatgctcaggaccctccttgtcttcccaccccacccaggttgtttgcaaacaagagtcgctttagctccgaaaccttgagctatctgaactccagttgcacaggccccatgtgtgtgcaaatcgaggattacagccaagttcgtgacagcatccaggcctactcattgggagatgtgaggatctggattgggaccagctataccatgtatgggatctatgaaatgatacccaaggtgggtttgccaggccccagcccaagccaggcaccaatccccactctaggcctgagaagtcttaacctaaagtgaggtgaagcccctcagccattcagtcatctggtcagccaacaactgtgcagtgagttcccttcttggcctaactgggaagagccagaagaggaaacagggatggccatccagagagctcataaaattgtcaggaggctggagagtatacggcctgatctagcagagactttggagtcagccaaacttgaaaatgaattccagctctgtccctaactagctgtgcagtgactttggacaagcaacttagccaatctgggtctttttcttcacctataaaatggcaataagagtcctgacctcgcaggagtcgctcagtggagatctaaaggagatagtgtatatgactgacacatggtagtgtccaataaatggtagctgtcatgatatgtacaggaaacttacactgtcaggacagcctgtcgagtgactcaggccagactctgatccatcccagagtgctggtgggatccgaagacagggagttcattgccaagcaaggcagtgtcaatcaaggaagccttcctggaaggagagagggttcagctggacgtggaaaactaggaaagacagaaagcacacacagagtagagagcattgccacgaaatggtggcaaatctcacgtctgctgggtcctcctgccagtcctctgaaaacacccctgtgccatggagacctcctttactgtgcccccagacctgtgcccccagacctccttttctcctccctgcccccaacaggagaaactcgtgacagacacctactccccagtgatgatgaccaaggcagtgaagaacagcaaggagcaggccctcctcaaggccagccacgtaagtccacgttcaggcagacatggccttttgggagtatccagcctaatgagttagaaaggaaaggcctccagaagagcctgaagaagaccctcaatgaaacaaagaagcaagctgggcgcggtggctcacgcctgtaatcctagcactttgggaggccaaggtgagaggattgcttgagctcaggagtccgagagcagcctggccaacatggtgaagccctgtctctactaaaaatacaaaaattagccaggcgtggtggcgatcacctgtagtcccagctactcaggaggctgaggcacgagaatcgcttgaacctgggaagtagaggttgcaatgagctgagatcatgccactgcactccagcctgggcgagactaggtcaaaaaaaaagaaagaaagaaagaaaaagaaataaagaagcagacaccaaattattcctgggcgcccacatgcacctcatatccttgcccccaatatagtacagtggtttagagcacaggccctggagctagggtgccttgagttcaaaccacagctccacccaattcctaactgggtgaccttgaccaagtcattttacctctctgggcctcagttaccccatctgtaaaatgaggatcataacagtaatcttacagcatatggttgttgtgagaattcaatgaatatgtatattgctctgagcaccacctagcacattctaagtgttaaataagtgttagctataatgatttcctcacactggcaagaggatggctcaatttttaaaaaagaattcttgttaaaattaagataaaccacctcatttaaaaaaaactttgtctcataggaaattttaaacacacacaaagataaagaaaatagcatcataatctccagtgtcccttcatccagcttcaataatccttgactcatggccattcttgtcttgtctataaccccatgttcattaccaccacaaccaccccctctgctgctggattcttttaaaagtaaatcctagatagtgtgtcatttctgccgtcaacacagaactctttcaaaaacaggaacacactatgatcatatataaacactaacaagaattctttgacatcaaatagccagtgttttcaaagctccacatcctggagccgctatctgatctccatcatcttggagcctgtggctgcaaccagacctcacccggctcctctgtttccctgcttccccaactccaggtgcgggacgctgtggctgtgatccggtacttggtctggctggagaagaacgtgcccaaaggcacagtggatgagttctcgggggcagagatcgtggacaagttccgagggtgaagagccacggccgtcctttttggctgactgtcttttagtgtggcagtgggggcagggagggggaatttgtccccttacttagcagaaaggaagatcctcctcatatgcgtgctgggtgggggagggctctggagaacaaggagtgacaggttcttgggtggtcggggagttgagcagggggcgttggatgatatttcccgccccgctgaaagcaggacaactcgaagggccacaacccaatagcgtcccctagtgtctgcttcaggtacggtctgaatctccctggggggtgctgtggctcagaccaggtcagcccctggaccacttgagaataccaggtagggaggaggattcccgaaggcatgcttggcccaggtcagggccggattgtaggtttgaggtacaggatgctctcccaggactgggggagttttcagatacagagagctgggtttcttcactcctatccgtaaaatggaggtggagaggaaataatgtgtgtctacagtgtgtcctctgatcttcctctataaatgacaggtcagggcttgaggagatggaaccaggaggtgagggctgggagagccaaatggtgtccagttgagaggtagaggcagccatgaccttcattggatttgattagatatcccgggcccagcctagtccaggggcccattcattgaccatgccttgccttgtactttccagagaagaacagttctcctccggacccagttttgaaaccatctctgctagtggtctgaatgctgccctggcccactacaggtacttgaggaaaaagaattttctagggccctgttggggcatcctgttgtgtgtgtagaggaacagggtgaggggagggggatgttctgggacctgagtccacgttgaaggtccgaggcccctagccctgtgggggctgggagaggagctcagtgtggagtagggagttgccttgtaatgaaaaggcctgagagctggaggctgggggacctggaaggaagacaccgatgccattggatgcttttccctggcttcccatgtgttgcttatgttagctaatgcttaaagctcacgagttcacatggagagaggtctgttcactcagcctgaaccagccaaggtgggcccaagatacaggctagccaggtgtttggccctatagaaaacaaacccctgcaggcctgcctgatgaaaagctgaccagctgcctccgcctggcatgggcacagcagggagaggtcaatgccctccaagggagtgcctgacatgtcccagaattccctcccctggtgtcccctggtgtctcccacgccttcggctgccttgccccagcccctcctacccactcgggctagagtggcagggtgggtgctcctcggctttaccacctcttgctcagcagccccaccctggaggtatcctcccttcctgtgctctgcttcttctcagggccctctgctctcggaggcagcaggaagttagagacaaagggccggagggagcatctgggtagaggcccagctctttgccgctttaccgcgcatcctcgtgcaagccccttggcctccataggcctgcttctccttatggaaaaggagacagctgagctggggggtctctagggctctcccagctctcatattctgggctttaccctctctctcctccctggggaccagggcctggctcagccaggtgcaggattaacagacgtgtgctgaggacagcagcaacggaagctgagttctcttccagggccctttgggatagaatgacttcctccagagggactggcctggaagcccaggccccagaggtcctcccaccaaggcctcccacgtgacccagtgcagggttaggctgcccttctcaacattctctccccttctcagcccgaccaaggagctgaaccgcaagctgtcctcagatgagatgtacctgctggactctggggggcagtactggtatgtaccccgacctcaccctagcctggatgtctctgctcagacctcctgagcctgccaagagtcagccaaagctttcccttcctgggccacggattcttcgtctgaaaaaggagagatctggaatgagccccgaacatcctacccattttcacacatgggggtccctgcacagtgggaaatacacagaggctggaatagtggcaggacccaggcagcacctctgtgggaattaggaaaagactccctttgcttaagttgctgttttttgtgggttgtttgtttgtttgtttcttgacagagtctcactctgtcgcccaggtttggagtgcagtggcgcgatcttggctcactgcaacctctgcatcccgggttcaagtgattctcctgcctcagcctcccaagtagcttggattacaggtgtccaccaccatgcccagctatatatatatatatatatatatatatacacacacacacacatatatatatacacacacatatatatacacacacatacacacacacacacacacatatatatatatgtatgtattagtagagatggagtttcaccatgttggccaggctgttctcaaactcctgacctcaggtgatccacctgccccagcctcccaaagtgctgggattacagacatgagccaccatgcccagcctcaagtaaaatgttttctaagtccacgtattattacacagtctgagcaactatactcaatgtccctgcctggccacacaaacacatataccctactctcatccactagtgcacaccctggacacccccgcaccaccaacgtcatgcagactcctcagccccctcttccccatggcactgttcagggtggaggtgggggcagatgagagaagcaacccttttgatgggctacctttgtacagtgtacaacctgaatgctcagacatgacagccgtgcagaatagactaacctggccaggcgtggtggctcacacctgtaatcccagcactttgggaggccgaggcgggcagatcacctgaggtcaggagcttgagaccagcctgggcaacatggtgaaaccccatctctactaaaaatacaaaaattttccgggtgtggtggagcatgcttcccaagggaaactgaggcaggagaatcgcttgaacccgggaggcggaggttgcagtgagccgagatcgtgacactgcactccagtctgagcaataagagcaagactataaaaggaagaaagaaagaaagaaagaaagaaagaaagaaagaaagaaagaaagaaagaaagaaagaaagagggagagagagaaagagagagagagagagagagagaaagaaagaaagaaagaaagaaagaaagaaagaaagaaagaaagaaagaaagaaagaaagaaagaaaaagaataggctaaccccattccttccaaacgtgtgactgatcattcacaccagagttgagctgagctgagctgacctgaaagattttcccttctcattgaggaaggaagtgtgggaagcgtggggtgggacaaaagaagggccgtactgaactgatggaggagcaaggagtcctgtggaaatggcgaatgtgctaacgacagaggctctttgcttgttcttagcacagctctaggggatccagagtagcaggcgctcagcttagcagcctttgctggtcaggagttcgatgctgtgtgtacttgagatggccaatgagcaaaggggaagtgaatttgtgggggcgttgctggaatggggtgtgctcagagtagggtgaggccggggaaatagtcacctcacttcctcttctttccttctgaagaagaaggtcaccacaccccatgacccaaggagaagccccagggccctgggaccatttctcccctctccctcaccaaggcatgatcacaggggccatctgtggcaactgctgcagctgggagttgggagtcagaccttgggactgaggcttcacctaactggaactcagcaagtcactgggtcagatccgtgtttgccatggagaggactgtgtggagaggcagtgcttgctctaggcctggcttcactgaggttcagagagggaaacagccgcatggcctcaatggcctcatctgtgaactggggataatgaggcctcttctaccattcttcccagggagcagcaaaagtgtcctataaatggtcgacaactatctgaatatgagagtgttatgataatataatctctctggacctcagtttccccagctgtaaaaaggggacattcccctttctgcctcccaggaagcctggaagaagccttgctttcataaccagctggacccaaggaaacccagacctacagaacagccaaaatgagtgggatgggggaggagtgtgtagggtggggagtcacacttgtcagacaacttagtaacttttaacttgataggtttgcagaggcctttcacacataggtgctgaagaggggattttgattatggtagctgtcttcttcctttcgccgtccacccatcccatcccagccctgccacttgtggaaagcacacagaaagcacatggccccagtccctagccccaggcatttggcatgttggttttccttctccatagggacgggaccacagacatcaccagaacagtccactggggcaccccctctgccttccagaaggtaagcatgggcccagatttcccctcaccaccttcccccaagggggcacccaagcagtcaagatcccttccatttcagaggctaaaactgaagctcagagaggttaagtagtttgcccaaggtgacaccactggtgccggaaaacccagtgctccctgctgcttccccggggatatttcaggccactgacaaggcctcagcccaagctgagcctcatcctattctggtaaatcagtgcacaaatatttttttgttgttgcctgtgtgcctggccctgtactcagcagaaaggagaaagaaaggcatcccaagtggaggaaaacggcacaagtgaagcctccgcggtggaaaggagccagaggtgttcaggaaacatcgagggctggccagctggggcagaggcgagggcattgtctctgtgcaccagagggccctgggggtggagcagcgagctgccgtcatgctgcatgcagcaggccgactatggggcagacattgtgctggaaacacagagaggggaacaaaatgctgtccaggtctccaggagctcacagtttagcggcggagtctgctgcctctggctgtcctgcccaaagtgacaagcctgtgaacctgtgtggtgatggagattgaccacatcgcctctggaagtgaccagaagaggccactgtcaggccacctccctccgctgacagaggaaggctaagctgccaagtcagcaaacctcaaccctcatgaaaggccttaagaaaactcagcagccgtcacaaccacaggaatgagtgtgctaaacttccgtgaagcatgcacgctgttggcagcaccttctgtacattagtctgcctgcctctcccaacaaccttaggagctaggtcctgttatcttcccatcgcagataaggaaactgaggcacacagcagttaaagtcgcctgcccaaggtctcagagtgagtggctaagtcaggattcagcccagggagtcacagcctcggttcaccgccaccaagtgtctcctgcagatattgtaatgatcctcatagaccagccagagggaagcacgtgatggagccccagctttgggaaggccctcctcagcctctgctggccatcttccagaacccgggcagccacacataacgatgagactccccccaccctgcctacacacacccaggcctgggccctgcaccgtgtatccataggccaagcagctggatactcctctggctcctcctcccgtcctccatatcacctcttcctctccccatcaggaggcatacacccgtgtgctgataggaaatattgacctgtccaggctcatctttcccgctgctacatcaggtgggtttcagaaaccagtctggacacagcctcaggccctgatttcacaggactcagaccatcaccctgggaggctggtggggcaaggattttgtcatcatcccatcccttatgtagatgagaaaatccagcctagagagagaaagtgacttgcccaaggtcacacagaaggttagcgggagatccaggccttgaacctgagtttcctgcctcttaatctaacactgttgctcagaggtgggagagatcagtgggccacagcaattatgggaggattcttagaggaattaggtgtcaaagtgcaaagccctgacagatggggagaaattacagtagaggcatcaattcaggtaatggatacaatgtatggtaagctggagatagtgatgggctggtctggcgagggaaccactaactccatccatcagccctcctccatcccaacccaacatcattgcatcagtgcatgcttagcggcctctcaggggcccctcttcttaggcaccactctgatagtgaagcaagaaggggcaaggtggacagtcttcggtaaagccatctgactggggtcaatctctcttcccttccagggcgaatggtggaggcctttgcccgcagagccttgtgggatgctggtctcaattatggtcatgggacaggccacggcattggcaacttcctgtgtgtgcatgagtgtaggtgtctcctcagcactccccaggccaccccccttttattataccctctatgaaggtagagaatttcacaggtatggaaatgacaaagacccacaaagatgccatgatctacccaaggttacccagctccacagggtaagtgaggaatgccagcagcaggccagtcctgctggctgcttggcattcaagagggcaccagaaagagggtcaagccctagtgactaacttatatagaccccagagaaataaaagccagagccagctgcatgtggtgactcacacccatagtcccactgctttgggaggccaaggtgggaggatcacttgaggccaggagtttgagatcagcctgggaaacacagcaagaccccgtctctacaaaagaaatgttttaagtatccaggtatggtggcatgtgcctgtagtcctggctactcgggaggctgaggtgggaggatcccaggaggtcaaggctgcagtgagccatgatggcgccactgcactccagcctgggcaacacagcaagacccctctcaatacctaaataaataataaaagccagagccaatctggtgtgtgccaggcccaggcagacaatgatgtgatggacctgtgctcatagagatgctctgggatcctcacttatctgctcttcctcggaagctgctcacttccaagctggtgagtataggagaactgataccatgtttatgtcttcctttctagggccagtgggattccagtccaacaacatcgctatggccaagggcatgttcacttccattggtatggccctcaggcccctctacctcaccaccccatcccagagcaggactagcccaggactgcagtctagagtgtaccagacttcagaggagcacagcaggcactagtacagctcgggactcacctccccattcccaccgctacgcccagccccaaatggcttgtcccaccctaattccagctcccctcagcccagaccctctttttgctcttgggagttgtttcccagctgtatattcagacgagatcaggtgcgttcagggtggtatggccgtagacccagctgtatattcagactctggagttgccaaatgctggagtaacaggacagtggcatccagggagatgggagtaccttcaggacccaagtgggtttttagggcttccctgctgggctacagggaagagagagtgagtcagagatgcccctgtgggggatctgaggcctgacagggatgagttgcctctgcttagccaacaaacatctaaccagttgtggggctgccagagtcaacagccaggggacagccagacagccagtccctccagccactcatcagtaggtacaggaagcctgggcttgggccctctcccagcttaatgccaccagcatctctgtgtctcccagaacctggttactataaggatggagaatttgggatccgtctcgaagatgtggctctcgtggtagaagcaaagaccaaggtaaactgccaccaggatgggctggaggtgtgggcagcatgtcagtgactttgggctgcatgggaggaaagtggggaggaagatcaaaggagaagggcatttagtgtgcaggcatgaatttatctggagtcttccttaggaattccataagtcagacttttcaaactcgcttgcacatttgaatcacccagagagctttctggtgctttaaatgcccatgcccaggccccattccagaccaagtgaatcagtatccctgccctatatcattggttctcaatgcacataataatcgccaggggagcttgttagaaataaagattctgtataatagcagccaacaagataaaatacctagatgtaaacttaaaaaggcttacatggagaaactctctactaagggacataaaaaagatttaagtaaatggtgctctctggagagaagcctcaatattatgaagatatcattactctctaaattaatctataaattcaagataacctcaattccagtgctaactggatacttttgtaacttcacaaaatgatagtaaagtttatttgtaaaaataaacatgcgaagatagctaggaaaattctgaaaaagaagagcagggccaggtgcagtgcctcatgcctgtaatcccagcactctgggaggccaaggcaggaggatcgcttgagctcaggagtttgagagcagcctgggcaacatggcaagaccccatctcaacaaaaaatacaaaaaaaaattagctgcacatggtgtcatgcacctgcagtcccagctactcgggaggctgaagtgggaggatggtctaagcctagggaggttgaggctgcagtgagctgtgaccacgccactgcactctagcctcggtaacagagcaaaacccaatctaaaaaaaaagcaataagaaaagccagtcctctcaaatttgaacacaaactaccataactaaaacagtatgacactggagatgaaatagatagctgtaacaatgaaacagaacaatcagtccagaagtaaaccctcttattcccataaacaacatgggaatttagtttacaagaaagctgattttgcaaaaaagtaagaaaaaaatgattattcagcaaatggacagggggaacaaatggctaatcatttggggggattaaactgaataacctccaaaataaaattccagatggaccaaagttttaaggtgagcaatgagaccacaaaagatgtagaggaaaacctatatcaattcatttataatctcagggtggaaaagagtctttctgtgcaagaccagaagccatgaaggaaaagattaataactctgactaaatagaaaatggaaacaatgtttatggaaacaatgccataaacaaagccaagagatgtgtgacaaatatctcttggctttgtttatggcattgtgagagggtgagttttcttattttaccatgagctttttacaaatccgtaagacaaaaatagacaaaacaggaaaaaatagggcaaaggacatgaaaaggcaattcactaaaattaacaccaaatggtccacatgcatgtggaaagatgctcaagttcatccttaaagaaatacaagaccgggcgtggtggcttatgcctgtaatcccagcactttggaaggccgaggctggtggatcacctgaggtcaggagttcgagaccagcctgaccaacacggagaaaccccatatctactaaaaatacaaaattagccgggtgtggtggtgcatgcctgtaatcccagctactcatggggctgaggcaggagaatcacttgaacctgggaggcggaggttgcggtgagccaagatcatgccattgtactccaacctgggcaacaagagcaaaactctgtctcaaaaaaaaaaaaaaaatacaaatcagggccaggcatggtggctcacacctgtaatcccaacactttgggaggcagaagtcagcggatcacttgaggtcaggagttcaagaccagcctggccaacatggtgaagccccatttctactaaaaatacaaaaattagccaggcgtggtagtgtgtgcctgtaatctcagctactcaggaggctgaggcaagagaatcgcttgaacccgggaggtggaggttgcggtgagccaagatcacaccactgcactccagcctgggcgacagagcgagaatctgtctctaaaaaaagaagaaggaaaagaaagaaaagagaagggaaaaaaaagtctctttcttgctcagtttccttcctgagaacatttcaggcacacacagcgtatgtatctatctatgtatatattttgaaaatacaaacaaaatggattctactgtacatacttttctgcaccttccttccctgccccgctgccccttacttaatagtaaacctaggagagtggtctgcaatagcgcagggagatctacctcattcttttgaagggttgtcgaagagcctatagtatgtggatgtcccatgatttatttaaccaaccgtggatattgaggctgtttccaaatttttactatatttgccatcaatgctacaaatcactgtataaacatcttggtgagcttttgggactatatccagaaggtacatatctggcgtagggatttccaagacaaaaagtacaagcatttttaataggtaatttgatagatattgtcaaactgccctccagaaaggttgcaccaattgtactttctccaacagtgtgtgagagtgcccatttcctcacatactcactagcactgagaatcatcgaagtcactaatttttccaatctgataggtgaaacatggtattctattgttgttttgacttgtatttctttttttctttctttctttcttttttttttttttttttttttgatggagtctccctctttctcccaggctggagtgcagtggcgagatcttggctcactgcaacctccgcctcccaggttcaagtgattctcttgccttagtctcttgagtagctggaattacaggcacacaccaccacgactggctaatttttgtatttttagtagaaacagggtttcaccgtgttggccaggctggtcttgaactcctgacctcaggtgatgcacctgccttggcctcccaaagttctggattacaggcgtgagccaccacacccagccttgaatttctttaaggatgaacttgagcatctttccacatgtatgtgaaccatttggtgttaaattttagtgaattgctttttcatgtcctttgccttattttttcctgttttgcctatttttgtcttatggatttgtaaaagctcatggtaaatatgaaaattcaccctctctctgtgatatgtgctatatttgtcacacaactcttggctttgtttatggcattgtttccataaacattgtttccattttctgtttagtttagtcagagttattaatcttttccttcatagcttctggtcttgcacagaaagactcttttccaccctgagattataaatgaattgatataggttttcctctacatcttttgtggtttcagcctcccgagtagctgggactacaggcgcccaccaccatgcccaactaatttttgtgtttttagtagagagtagagacggggtttcaccatgttggtaatgctggtcttgaactcctgacctcaaatgatccacccacctcagcctcccaaagtgctgggattacaggcgtaagccatccattgcacctggcctctttttttttttttagagacagggtctcactctgttgctgaggctggagtgcagtggcacgatcacagcccgctgcagcttcaacctcctgggctcaggtgatgctcccacccttccacctcagactcccaaataactaggactatagatggacaccaccatgctcagctaatttttgtgtttttttgtagagactggtgtattagtctgttctcacattgctataaagatactacccaagactgggtaatttttaaaggaaagaggtttaattggctcacagttcccacatgcctggggaggccttgggaaacttataatcatggcagaaggcgaaggggaagcaaggatctcgacatggtggcaggaaagagagagctaacaagagcagggaaaactgtcttataaaaccatcagatcagccaggcgtggtgggtcatgcctgtaatcccagcactttgggaagctgaggtgggtggttcacctgagcttaggagttcgagaccagcctagccaacatggtgaaacctcatctctacaaaaaatacaaaaagtatctgggtgtggtggtgcccatcaataatcccagctacttggaaggctgaggtagaaggatcacctgagcccaggaggtagaggctgcagagggccgtcatcgtgtcactgctctccagcttgggtaacagagggagatcctatctcaaaaaaaataaaataaaataattgaaatttagatttctgggccctgccctaaggattctgcctccagtaggtttgggaggtgggccctggaatctgcatatttatcatgctccctaagtgctgttgatgtgcgtactttgaaaaacacaaacctaagtctaaatttccagaatcaggagggaagcaccaaaggtggagcactaagtggcagacaagggggctggccaagagaagggactctagaaggctcaggcctagccagggtgtccagggttgatgaggcccagctccttgtgtcctccgggtggagtgctccttccttcccttcagcccagttcctcctcctccctcactgtcctgcttacccggcttctattctgggctcccagtacccagggagctacctgacctttgaagtggtatcatttgtgccctatgaccggaacctcatcgatgtcagcctgctgtctcccgagcatgtgagtgcccctcagcattgccttctccctgaccctgggcctttcctgcctctgctacctgccaccacatcctctgtccctgcccctcctccaggagggtccacactggtggcacctgcagacacacactggggcattcctccccagctcatcagagaccccagagcttctagaactttccagtcagaccagcctgcccaaccccaggtagtgaataactggaggaatctgagattgggcctctgagctcggccactacaaggcctggaactataagtgatcccttctattcttttgcctcagtctcctcttttgtaagctgaggataagaatgcctgcccagcttactcccattcccgggcctgaaatctacccaccccaccgcccatgaacatcaccatgacatgaaacagccagccaggggaactgcctctgaaaagccccagagaattcctgaagcctgatgatggtgggggacctgtggccatctggactatggtgacagctggagtaccacaacaggggactgggcgtcaccaagacttcacctcttggcagcttggcttagagaggctgtcaccccttctatccttcgcagctccagtacctgaatcgctactaccagaccatccgggagaaggtgggtccagagctgcagaggcgccagctactagaggagttcgagtggcttcaacagcacacagagcccctggccgccagggccccagacaccgcctcctgggcctctgtgttagtggtctccacccttgccatccttggctggagtgtctagaggctccagactctcctgttaaccctccatctagatggggggctcccttgcttagctcccctcaccctgcactgaacataccccaagagcccctgctggcccattgcctagaaacctttgcattcatcctccttctccaagacctatggagaaggtcccaggccccaggaacacagggcttcttggccccagatggcacctccctgcaccccggggttgtataccacaccctgggcccctaatcccaggccccgagataggaaagccagctagtctcttctcttctgtgatctcagtaggcctaacctataacctagcacagactgctacagctgctcccctcccgccaaacaaaaccccaagagagcaatgcccctaccacccaagggtgccatggtcccgggagagcccaaacctatcaccacctgttgggcatagccagagctgttcccacccagccagggcatgaaacatcaaccccccacatgtgaacccatcattcctaaaccctgggtaggctccatgccaagtaacagcagagggagttaagccataggaatttggctgtggagtaagagggaatgcggtgaggcactctggaatatgaccctaccagaggttggagaacaaacttgggcagccggaacccgtcactattctagacttccctggcattcgaggagccctttgaactttccaaagtgcagccacagctacaatgctgttaaatcctcccacattcttggatgccccttcaccttgtgtggacagtgtctggtttctccattttacagacaggaaaactgagcttcagacagggggtgggctttgcctaaggacacacaaatttggttgggagttgatggggccagatgagccagcattccagctctttcacccttcagcaacatgcagagtccctgagcccacctcccagccctctcctcattctctgaacccactgtggtgagaagaatttgctccggccaaattggccgttagccacctgggtccacatcctgctaagacgtttaaaacagcctaacaaagaca

SEQ ID NO: 5010 - DNA, 1192 bp, human; identical to SEQ ID NO: 3701

SEQ ID NO: 5011 - DNA, 47188 bp, human
tactctggccaccacgatcttggcagcccacacctgatcaggacctaaagcgtgaagggtgtgaatgaggagaaacgaggaccgcctgctaccccagcgtctggccccctggggactgaaggctggctctggagctgtacctcggcaactgctataaggctgccgaagccgccgccactaaggcggccgccagcagcctgaatgcaggcaagaagcagtgccgcaccgtgagtggaggccggtccgtcttcctactcgtggccccaaatgagggtctccggaaggcggacagaccgagtagggagatctccgcgagtgggagggaacgaggcgggttcttgactgctcagctttcagccccttagctctgggcagccggtggctttggcggccactggccaccactggcaggggtcgagaggtagaactggtaacccagaaaaacgaggacatccaagttgtcagccggcctggcgggttccttcaaccccgaatgcatggttctttggtttatttggaggtattagcctatttaataggaagtaataatacgtttggtctaaactaaatgaataatttctattaggttggtgcaaaagtaattgcggttttgccattactttcaattacttttgcaccaatatacagaagaaaatacaaacttccaattgcatctgacagagctcgcaggaaaaccccattccagaggtcagagcatatcatcttttggatctgtgtcttggggtcaagctgcctgttatcccaggaagcgataatgtattctatactacagttctaagtgagaaggtaaacgaagttttaatagtgcttaagtgattttcttttttttttttttttttttaattatactctaagttttagggtacatgtgcacattgtgcaggttagttacatatgtatacatgtgccatgctggtgcgctgcacccactaactcgtcatctagcattaggtatatctcccaatgctatccctcccccctcccccgaccccaccacagtccccagagtgtgatattccccttcctgtgtccaagtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggcagcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgctggtagtttcttttgctgtgcagaagctctttagtttaattagatcccatttgtcaattttggcttttgttgccattgcttttggtgttttggacatgaagtccttgcccacgcctttgtcctggatggtaatgcctaggttttcttctagggtttttatggttttaggtctaacgtttaaatcttgaatccatcttgaattgatttttgtataaggtgtaaagaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgagggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttatagttctccttgaagaggtccttcacatcccttgtaagttggattcctaggtattttattctctttgaagcaattgtgaatgggagttcactcatgatttggctctctgtttgtctgttgttggtgtatgagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagttttttcccattcagtatgatattggctgtgggtttgtcatagatagctcttattattttgaaatacgtcccatcaataccttatttattgagagtttttagcatgaagggttgttgaattttgtcaaaggctttttctgcatctattgagataatcatgtagtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttggctggataggaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcatcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctccttgccgccttgcagtttgatctcagactgctgtgctagcaatcagcgaggttccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgacttggaaagtgaactccctgaccccttgcgcttcccagctgaggcaatgcctcgccctgcttcggctcgcgcatggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccttaagtgattttctttacccttttcagtttgctgttaaatgggaaacattttgctatgattttgctttgtgttaacttcagttttacataccaagttaaatgagttgaagtgtttaaattcttaaacctcattttaatgacagaaagccccatgatatgcctcagccgccccatccaaccttatctccaacccaagagtcttcactgacaggttggggtcttttctgcctacccacacataccctgctgattcctacttccgtgccttcgtccatccagctactgaaacttgacatgcactctcctcctctccttcacaacagtcaatcccaacctctgtgttcaggaattggactgaggttgaggctacaggaagactgaatatagggttcacagatagggattccacaggacacttccagcctaaagacaggcctgggagaggagagagagagaaagcagttaggtttacccaaatcagcccattgtctgtattctctcacttcccattctgcttgcaagttttattttcagtgaacagcctaatcatttaaataaattgatgtttaaaagtgtggcttcgtttatttttacatttgtaatgcttttgaatctacttgtttgtggcttttttaaccttcttaggattttaacctgactgatccttactgccaaatttaggaaaccaggtttataaaagtctacatgatgcacatttaaaaacaaactatcagtgaaaagatattctgaggccattaaagaagggtggctacatcactagcaataataaagtgcattgaagcatacctcctgttaaccagccaagacctaggtgcttccctttacctcactgggagcctgtgtcaactttcaattgagcagtagaggactcccaataaaagactcaatgaataactcagtactggggccaagggaaatcaggtagctgttttgtctaaataaaactcattcctacttgacctttatttccattttaatagcaacagatattaccaatgatttgagtatgcaaagatacacacacacttatttatttatttatttatttatttatttatttatttattttcacccagttgtattgtagtgcttttcctctggctccaaaagtggtaatatcaccgtctacctgtcaaagaatatttctcatacactttgagaaaactggagataaaatgagaaactagcaaaatacagattgatagaataaattctttggggagttaagcatcattattatatacgtgttttaataacaatttgattgggaatagtaaattcctgattatgatatgaaccatactaataaaacaatgtttggatagaaatttcttggtgagacagcaattgtataaagatgctgacttcaaaattgtcaccaaaatatgttgttattagaccttatcccaaatttttattaaaatgaatattcttttcaccctctcctctgtaaagtgttatcattgttacaaccttgtatttatattgttggtttttgtttttgtaggttatatgtcccttgaaggagttgagtaaatacaggcagtatgtgactagtttaaaattagactttgaaagaaactgtataagagaacaagtaagttaaatacttaaatttgtttatttggggcctgtaagaaaagttttatgtaaggtttggtcctacgcagaatatgttcttataatattttgacctagaagtatttattaaggtaacaaatcaaaaggctaagacctctataaaagatctgtaaaagataaaatgagacatttgtctttcatttctagagaaaaaaaattcacctgtctgaaatggagccacactagacttaaatgtaggctaacagaattagccatttgcaaagcataggatgtttactaagcctgaaacataagacagatcaaaggacaggtttatgtctggcaaatataaaggctttactcctttttatgtttcagaaaatgattgaaaaggtaaataaattatgtaaaacaaagagagcctgtgacagttaggctactgcccaatttcaagaatggctattacaggaaggtacacaaacaggtctggaccaatagtttttcataaaacataggtataatgaaagctaatgcctaattcttgtggacattgtggatcccaaaaagttgtatcaatactagaaataattaaaaataggacgaacaaaagtactagacactgtttaacctccctaacctccctacagtttttttttgtgtgtgttttgtttgtttgttttgtttgtttgtttgttttttagacagagtctcactctgtcacccaggttggagtgcagtggtttgatctcagctcactgcaacctctgcctcccagtttcacgcgattctcctgcctcagcctcctgagtagctgggattacagtcacatgccaccacacccacctaatttttgtatttttagtagagacagggttttgccatgttagccaagctgatcctgaactcctgacctcaactgacccgcccaccttggcctcccaaagtgctgggattacaggcgttggccaccatgcctggctccctgtagttttcaacatgcagagaaaggaagccagaccaagaagtacagaaattgggaaccttggtaccaagaatagggaggagagtttctacctaagaagttggagccactagaaacccaagagataagcaaaactgatgtttgaagaagaaatccaaaatacaaatccctgatcttgtgaaacccagtctacaatagcagagggagagagaaggtgcctttagcatatgtttcaaacttaagtttaaggaaattactgcaaggtcaaaacaggaaagttgctataactttatttgatgctaatgtaaacaggtgtcattccccaaccaactatgtatgttcattcagctactacccacacatattcaatgataccactcagaagtcaagcccatgcctcgggaaatgaaaggatgagttataattctttctctttctcctttatcggggtaagggccagttctccatcccctggttcttatattccatagattcatcacaatatgccagaatacaaactgatccaccagaatcccaggctgatagtctatagacctcatatataagacctccacttattttttcaaggaaattcaaatctgctgggtttttttaaagtcagtccttcagttaattccaatcatctttagaaactcatgttccccaaactactgagttatgaataatttctatgtaaaatgttttcaatcactctgtatcacatttgccattgtcctagccataataatagacaattctacaacaaagacaacaaaggtaaaattctacaacaaaggtaaaaatgagtgcagcatgatgagttagtggatcaggcttgaataactttaaattttctgtagctcaagaaataaaaaaacaatgaagcaggtaatttgggaatatcaaagcaggcaatgccattgtaagggtaacacccagtttaccttcacttattgtgcacttattttttcttttcctttttttgggacagggtttcactccaatcacccaggctggagtgcagtgggatgctctcagttcactgcagcatcaacttcccgagctcaggtgatcctccagcctcaacttcccagtagctgggactatagtcacatgccaccatacctggctaatttttggtatttttagtagagacaggtctcaccatgttgcccaggctggtcccaaactcctcggctcaagtgatcccccaacctcagcctccaaaaatgctaggattacaggcatgggacacagtgcccagccaatatttgcacttttatgtagatattgatatatgattatatgaaattggacacagcaggaaagcagagtgtactcaagatgaaagaaaaaaaaagacgatatgaagactgttgcgggaagtcagggaccccgaacagagggaccagctggagccgtggcagaggaacatgaattgtgaacatttcatggacatttatcagttcccaaataatacttttataatttcttatgcctgtctttactttaatctttaatcctgttctcttcataaattgagaatgtacatcacctcaggaccactgtgataattgtgttaactgtacaaattgattgtaaaatctgtgtttgaacaatatgaaatcagtgcaccttgaaaaagaacagaattagggaaaaagggaagacaaccataaggtctgactgcctgtggggttgggcaaaaagagccatatttttcttcttgcagagagcctataaacagacatgcaagtaggagagatatcgctaaattcttttcctagcaaggaatattaatattaataccctgggaaaggaatgcattcctggggggaggtctataaacggctgctctgggagggtctgtcttatgcagttgagataaggactgagatacaccctggtctcctgcagtaccctcaggcttattagggtggggaaaaactctgccctggtaaatttgtggtcagacaagttctctgctctccatccctgttttctgttgtttaagatgtttatcaagacaatatgtgcaccggtgaacatagacccttatcagtagttccgcttttgccttttgccttttgccttgttatctttgttggacccttatcagtagttctcctttttgccctttgaagcatgtgatctaccccctattcttatacccgctccccttttgaagcccttaataaaagacttgctggtttgaggctcaggtgggcatcacagtcctaccaatatgtgatgtcacccctggcagcccagctgtaaaattcctctctttgtactctttctctttatttctcagccggccaacacttatggaaaatagaaagaacctatgttgaaatattgggggcaggttcccccaatacaggaccacataagaagaaatcttgatctctgtagacaaattgaagaggtgagtaacactggattttaaatattaagggaaaaactgtctgcctgttttatttataaacatttttagcagtcttatcatattacctgaagttatttcaggtctaaaaaataagtcctcttaatattttatcactgtgataatatacaagcttttttttttgagacagagttttgctcttgttgcctgggctggagtgcaatggcatgatctcggctcaccgcaacctccacctcccaggttcaagcaattctcctgcctcagcctccctagtagctgggattacaggcatgtgctaccatgcccggctaattttgtatttttagtagagatggggtttctccatgttggtcagtctggtctcaaactcccgacctcaggtaatccacccacctcagcctcccaaagtactgggattacaggcaagagccactgcgcctggcccaagcttttacttaaaataatgagactgataccacaaattatgtatcccttacagtatagttacatctcatctgctctttaaagttttagaatttagctctagtgaaaaaaatcatgcctgtattctcactgccccaaattcacacaaggctactatctgtctggtttccctgtcaaaatacatgtaagaacatgagatcacacaccatacaccccgagtccagaagacaaaatccttttgccagcatcctttccaatccacttttggagccagcttaggtttgaattaagtgtctaataacaaaataagttttcctactgccattccattgcatctaccaacactttcccaataaaacacagtaaaataagcccatttaaagccaatgcaagattttcattatgattgacctgatttctattaggccattgatttgctcaaatttccttattggtagtagatactaaaaataattattatgaaagagaatccatgctgactactgtaacattgtgttccttatgaatggaaggcaaaaaagtcctgttgtgtctgacaaaaattaagtcgtaaatagagaagcaagagctgaagaatgacaccagaaaacctgaggacaaactggctggaaggtagtagagtgggcttttaccaatgacttgggctgtttgaggaaatgctttggccatttttgctatttttaaatgtgaattgtctgaaatggcctaaactcatgaagaaggctactgatagacccattctggcctgaacctatacttcaagggctggcctgaaatgagacttgtctccagaaagtggccagtaagtgaaattggatttagttattaaaatatattcttcttcatgctagaccacaaaaggatatttacccctatctttctagctttgtactcattgtgactttagaaatgtcaagataggaattgagggttcacttcaaatataccatcacatttgaaatctctattttgctttgccagtggcaagttgatactaaacttttaaaatatattaaatatatatttatgtattacttattttattgtatttttttctagagacgggctctcactctgtcacccaaactggagtacagtggcacaatcatagctcactgtagcctcaacctcctgggctcaagtgatcctcccacctcggcttcccaagtagctgggactacaagtgcacaccaccatacctagatatttttttgttgttgtttttggtagagatggtttctcattatgttgcccaggctagtcttgaactcctgggcttgagtgatcctcctgcctaggcctcccaaagtcgtggaataataggcatgagccgccacattcagcctatttttaaaaatattttagaaacaagcacttctagagaaaaacaattacctatttttacaaacaatgttttaaaaatgacctgtaagatgaagaccagaggaaagtgcatttgaaaacaaacgacaagatgaaacagaaggtgagagagagagacaattaaaaagtggctacatagaagatgcatccctgtatattaaatattgttgtctttataaaaaccccctctgcttatacagtgaggtcacaaggcccttgcaaaggtaagtcctaagagttcatgttcctagagccaggtactatgtaaggcacttcttagttacatctccaggtgtagagtgtacatgcacacacacacacacacatacacacacacgtgtctgtatgcagagagatagagagagaaaccctctgtacatgagtttttctggcaaggatgtttttctggcaaggattgaaaaggatgctggcaagagggtttttgtcttccttttctcctctcttttttgtcttatttttctcctctctctttttctcctctctctctctctctctctcgagagagagagagagagagagagagttagtgagacaaagagaaaaaggttgtaaaggaatataaaggaaaagacatttaaaaatacacaaagcaagaaacagagaaaaagtaagaacaaaaaggttgaaaaggaggaagtggtaagagaagacagtgcagaaacaaagaatgaaatggagagagggagagaaagagaatagagagaaaaagaaagaaaatggaacagaagcagccagtaggaaaacacaagcacacactctggatgaaggaatggagggagaacaaagagaaagaaacaaatgagagactgaaagagggtgggggaggaggaagaaaatgaaagaaagggagcaagaaaaagacatacagaaaaaaaggcacaggaacaagaaagggggaggtgaggtagagaggaatgggggagagcaggagatagaacagaaagaagttttaaaagataagtcagtaggaaaaaataaaatgaaaacgatagaacgtgaaagtgagagaaaaatttgaagaaaagccagttagaaaatcaagtacatttggcagggggtgacagattaaaaatgaaaagtcatttttaaaaattagaagtcagtaaaagaaaacaaagataggtaggtagaatacacttttttggttttttttagatggagtctcactctgttacccaggctggagtgcagtggtgcaatctcagctcactgcaacctccacttcctgggttcaagcgattctcctgcctcagcctcccaagtagctgggactacaggcacatgcaaccacgcccagctaatttgttgtgtgtttttagtagagaaggggtttcaccatgttggccagggtggtctcaaactcctgagctcaggtgatctgcccacctcggcctcccaaagtgctgggattacaggcatgggccactgcgtccggccagaatacactttcaaaaggagaaagcagtaagaagaggcagtatgatgaagacagactgaataaaagaaaaggatatgggaggaagaagaaaatcggagaaaaataaaataagaaggaagcagtaagaaagccagtacaagaaaatatatagaactaaaacaaaaaaaatgaataagaaaaagtgaaataaaaagaggggaaatagaaaaggagagaaagcacaaagaaaatggaagattaaaggggtaaatcaataagaatagctcagtaaggaaaaagagagacttaaaaagaagacagtaatgttaaatgatagatgtatagatagaaaatatgaacagacttttaaaaggaagagccaataaaaaaaaaggcagtacaagaaaatatagaaagaaaccatggaataagtaaagaaggttgggaagagagagagacagagataaagagacaaagagagagtaggcaagtaagatgacattaaaaaagaaaatccagtaaaaaagacaggacaaaaaaaaggaaggagagagaaagagatggagaagtagagaaaacagttttaaaagaagcctataaaaacaaataaaaaaaagacctattggaggaagggaggaaggaagtaaggcaggcaggcatgcaggcaagcaaagtaaagagagagtgaggcctggcacaggccctccttggcctcccaaagtgctgggattacaggcgtgagccactgcacctggcctgttgtactatcttctaacatgccgtgacatagaactataagctaaattcctcctacaattagcaggcatacatgcagagctgagcagaagcttttaacctaaaggaaattaccacagggagtcagatgcaaaaatggagtcagtcatgctaagcctccctctattgttacaaaaggagccagaagaataaagtataccaaaaaatataagaaaaaaagatataaagaagtagaaaaggaaagagagacagatattgacagaacaaaaaagagagaagagttttaaaatgagaaacctataagaagactttacaaagaagagaaggagaaaaaggaaaaatgtaaaagaaggtgccaacaataaaagatattcaagagagctatagagataaatatgtaaaaaacagtggggggagcaattaagaaagaatatgaaaaagagaaggaaagaaagcgatgaagagagaaaaacttagatgtttaacaaggaagagtcaataagaaatgccactgcaaaaaataataaatgcaagacagaaagagaatgaaataagttctgaaatgagccaatacaaaaattagtgcaaaaagatggaaagagtgaagtaaagtgagagagaaagggagaaaggggaagagaggaacttaggaaggagggaagacatttataaccgatgagtcagtagggaaaacagattttttttaaaagaaagggaatattagagtgagagaggggagcccataagaaattaaccaagtacaattttgcaatggcaaacagatgatgaaaggtggagtccaaaaaaaaaacacagaaaaatagagacagaaaaatagaagattgatagctgaatagatagctagacagtacgtaggttggcaagtaagtagatagatgtgtgagtgagagacagagagaaggcagaaactagtttaaaaaagaaggtatgaaaaaatgagaaagaaagagtgaggggagagaaaacagtatggatggggcaacaaaagaaggatggaaggaaggaaggaaggcgggcaggcaagtgagcaggaagtaaggatgaatggggcaggagaaagggagaaagggagagaagtatggagaaaggaaagaaggcagttaggcatgggggcagaaaacaaaaagagaaagtttggaaaagagaaagttaaagaaattgagtgagaaaagtcagaaaagttatagaggcaggcatgaaagaaggaggaaaaagaagggaagaactggaggcagcaagcaagagatgttaaaagaagaggctaggccaggcacactggctcacgcctgtaatcttagcactttgtttgcaccaccgcactccagcctgggcaacacagtgagaccctgtctaaaaaaaaaaaaagcagcagcagctagttgaaagtagactgaaataaagaaagacagatacaaaggatggcagacataaggcaggaaaacaggtaggcagatggaccagatagatagatagagagatgatagatagatacatagatagatagatagatagatagatagatagatagatagatagatagatttggtcttaatggtggaagccagcaaaacaaaaaaaaaacatatgaaattaataaaaagagacagtagcacccccccccacaaaaaaaaggagagggaaggaaataaataggttttaaaagaggaggcactagaaaaagtgtaaattgagacttgaagggagggaggaaagaagggaggaagaaaggaagatagaataaaaataagaaagaagaaaagaaatttacaaatggtgagtcaatagggaaaggagttaaagaggagaaaccaaatatggagtgaaagggaggagccaataagaaaatcaagtacaactgtgtgaaagggaggagatttaaaaagtagaagtcactttttaaaaaacagtaaaataaagatggatagatagctaggtaaggactttagtaagtagataaacagaaagacagatagacacaatcctagacagtgctaggattacaggcgtgagccagcgtgcctggtctagcttcttcttttaacatctcctgcttgctccctccagtttttcccttttttcctccttctttcgtgcctgcctctataaattttctgtcttttctcactcaatttctttaactgtctctgttccaaactttcactttgactttaaaaggcatgtgccaatataagagactgtatgaggccaggcatggtggctcacgcctgtaatcccagcactttgggaggccgaggcgggcagatcacttgaggtcaggagttcgagaccagcctggccaacatggtgaaaccccgtctctactaaaaatacaaaaattatctgggcgtggtggtgggcgcatgtaatcccagctacttgggaggctgaggcaggagaatcacttgaacccaggaggcggagtttgcagtgagccaagatcgcaccactgcactccagcctgagtgacagaacaagactcggtcttgaaaaaaaaaaacaaaaaacaaaacaaaacaaaaaatctgtatggaatagatataaagagagagggttagaacaaaagagagatggaaagaaaaatgtttaaaaacaggaatagttaaaaaagaaatagtggaaggaggaaacagggagggagggaggcagtgagaaagggagaaagcaaagaagaaagaaaggaagtaggtaggttagaaaagaaggatgaagggcaatagggaggaaggaagaaagaaagacatgtgttgggcccagtggctcacacctgtcatcccagcacttaaggtcaggagttcgagaccagcctggtcaacatggcaaaaccccgtctctaccaaatatacaaaaattagccaggcgtggtggtgcatgcctataatcccagctactcgagaggtcgtgacaagaaaatcacttgaacctgggaggcggagggttgcaatgagctgagatcgcaccagttcactccagcctgggcgacagagtgagactctatatcaaaaaagaaaaagaaaaaaagaaaggaagacatgcaggtagggtaagaatagacaaagacagagaaagcgtgaaatacagtgagaaaagacataggaaaaggtgatcaagaaaggaagaaaagaaggaagggagggggcaagacagaaaagaaggaggggatggaaagaaagagaagttgtaagtcatgagtctgtaggaaagagcaaaacttaaaaaaaaagaatgagaggcagaggggcttgaaaagaaggagctataagattacatagaattgtggatagcaaggaaagacaaatctttaagaaagaagtcagttaaaatattacagtaaaataagatagatagatggatgacaactagataggaagggggaggtataaagacaaaggaagatggaaggaagtaaagaaggaaggaaaggaaggaagaagggaaggaaggaaggaaggcaggaagggaaggagggagggaagaaggtaaggaaggaagggaaggaagggaaggaagaagggaaagaaggaaggaaggcaggaagggaaggagggagggaagaaggtaaggaaggaagggaaggaagggaaggaagaagggaaagaaggaaggaaggcaggaagggaaggagggagggaagaaggtaaggaaggaagggaaggaaggaaggaagggagggaagaagagaaggaagggaaggaaggaagggaaggaaggaaggaagggagggaagaagggaaggaaggaagggaaggaaggaagggagggaagaagggaagaaagggaaggaaggaagggaaggaaggaaggaagggagggaagaagggaaggaaggaagtgaaggaaggaagggagggaagaagggaaggaaggaagggaaggaaggaagggaaggaaggaaggaaggaagggagggagggagggacgggacagcgggagattttctaaaggagaacccagtaataaaaaaaagtcagtgcataaaagatagaaagttagaaaggaaaagaggaaatgaaaaatgtttttgaaaggagccagtaaatagagagtgaaagaaagagggaatataggagaggacaggaagagaggaaggaataatggcataaagaagggaagaaggcaaaagaacaaaggcaagcagaggagaaacaaaaagaaataaagaaagggagcaagacaaaaacacagagaaaggaaataagaaataaagaagggaaaaatgaatgtagaaaggggtaaaaatgaagaagcaaagagatgtttttaaagaattttttaaaataaagaatatgagaatgaaagaaaaagaagaaagaaaaaagaaggaaggaaggaaggagggagaaacagaaagaaagggagagcattacacaagtaggaagcagccaataagaataaactatacaaaaaaaaaaaaaagataaaaagagaaagcggccgggcgcggtggctcacgcctgtaatcccagcactttgggaggccgaggcaggcggatcacgaggtcaggagatcgagaccatcctggccaacacgatgaaactccgtctctactgaaaatacaaaaaaacattagcggggcgtggtggcgggcgcctgtagtcccagctactcgggaggctgaggcaggagaatggcatgaacctgggaggcggagcttgcagtgagccgagatcacgccactgcactccagcgtgggccacagtgcgagactccgtctcaaaataaataaataaataaataaataaataaataaaaatgaaaagagaaaggaaaagaaagagagacagaaataaagacagagaacaagaaaagtttaaaaacaagtaacctgtaagaagactttacacaaaaaagaaacagaaaaagaaaagttttaaaaggaaaggccaataataaaataaatttaagagatgtaaaaaagaagagcaagtaagaaaagactacaaaaatgatagagagagaaaggagggaagaaagacatttaacaaacaaggatcagtaagaaatgccacaacagtaaataatgaaagcaagagagaaaaagaatgaaataatttattaaaggagacaagaaagaaaacataatacaaaaaatatataaagaataaagtagatctaggtagagaaccatattgtcacaaaataaaaaggaattaagaaataaaagataaaaaagatatactaagaataaaatagagagcaaaagagagaaagagggagggggagggagagaggaaggaagaaaagaacaagcttaagaacaaggaaaaaagtttatgaagggtggaagcaggaggatcgcttgaggccaggagttcaagaccagtctgggcaacatagcaagaccctgtctctaaaaaatatatattaaaaaaaaaaaaaaaaaaacattatcccggtgttttgggatgctgaggcgagaggatcacttgaacccagaagtttggggctgcggtgagctatgatagtgccactgcagtccagcttgggtgacagagaaagaccctgatcctaaaaaataaatggaaaaataggacatttatagaagatgagttagcagcaaacacagttaaaggaagaaagaatgtaagaatgagacagaggagccaataagaaaaccaagtacaattctttgggggaagcaaattttaaatttggagacaggaaaataaaacacaaatgtaaagaaagaaagtagatgattgatagctataatatgtaggttgatgggctggcaggtaggtagatggatgagagagagagagagagatgaaacataaaaagcagaagcgagtaaaaagaatgtataaaaaggatagaatgagagtgaaagaaaggggagactgtttaaaaagaggagccaatcgaaagagcataaaagaacagtgggaggaaggaaggaatgatagaagaaagaaagtaaaagggagggaaggaagaaaaaagtgagaaggaggagggagaaatgagtgaagataggagggagaaatgtcagggagtatggatggagaaacaaaaggaggaccgaaggaaggagggagggagggaaggaaggaaggaaggaagtttataaatgatgagtcagcagggaaaagagttaaaggaataaagaaaatatgggagtgaaagggagaagccaataaggaaatcatatacaattgtgtggtaaggaacagattttaaaggtggagataggaaaatcaacataaagacagaaatataatagctaaatagatagatatgtaggtaggatgatacataagtaaatacatggttgaatagatagacagatgatagatagatagatagacagaacttaaaaagcagcagccagtaaaaaagaatgtatgaaaaagatagaattagaaagaaagcgaggagggagaaagtaaaaaagttttaaaagaggaaccagttgagaataaaagaggaatgagaagaaggaatgagagggagaagacagatggaagaagggaggaaaaagaacgaaggatgaagggaaaatgaatgaaggaagacaggagagtgggagtttggatagagaaatggaaagaaggaaggaagggatatcatgtaggcatgcaggcagagaacgaaatacagagatgaattcgtgaaagaaatggaacaagaaaagacagaaagtttaaaagtataggaaggaagaaaggaggaaagaagaaagggaggaattggatgacaggagagagatctaaaaagaagtcagttgaaagcataaaataaagatagattaatgggcgacaggtagacaggaaggatagcaggcataaggcaggaagatagacagattaggggaatagataaatagatagataaacagatagacagatcagatcttaaaaggcaaaagccagtaaaagaaaagaccatattaaactgacaaaatgagagagtagcccaaaagagagagggaagaaaagaaatatgtttaaaaagaggaggtacaggccagatgcagtggctcacgcctgtaatcctactttgggaggccgaggcaggaggatcacttgagcccaggagttcaagaccagcctgggcagcatagtgagaccctgtctttacaaaacataaaaaaaaagttatctgggcgaagtggcacatgtctgtagtcccagctactcgggaggctgaggtggaggatcgcttgagcccaagaggtcgaggctgcagtgagctgtgatcacgccactgcactccagcctgggtgacagagaaagaccctgtctcaaaataaatatataaaagaggaggtagtagtaaaagtgtaaaagtggaacaaaaagaaagaaggaaggaggatggaaagtaagaaagaaagaagagtgtaaatgatgagtcaatagggaaaagagttaagagaaggaatatgagagtaagagggagaagccaataagaaatcaagtacaattgtgttgaaggggagtagatgtaaaaggtagaagtcactttttaaaaaatagtaaaataatgattgatagctaactaggtgagtacctaggtaagcagataggtagatagacagatagaactttaaaggtgtaagtcaatataaaagactgtataaaaagatacaaagattcatgaccgtaatcccagcactttgggaggctgaggtgggtggatcacctgaggtcagaagttcgagaccagcctggccaacatggtgaaaccctgtttctactgaaaatacaaaaattagccaggcatggtggcacgtgcctgtaatcccagctacttgggaagctgaggcaggagaaccacttgaacctgggaagcagaggttgcagtgtgccgagatagagatcacgccactgcactccagcctgggcaacaagagcaaaactccgtttcaaaaaaaaaaaaaaaaaaaaagatacgaagagagaggattagaacaagatatagatgaaaagaaaaatgtttaaaaacaggaaccagtaaacgaatggaaggaaggaaggaagcaggggagggagggaaagagggaggaaagctgaaatgaaggaatgtaggcagagtaagaatagagaaatggagagggacttaaatggaatgagaaaaggcagaaaaatgtaataaaagaaggaagaaaagaaagaaggaaggggcaagataaaaagggaggaaggagtggaaagaaaaataagtttacattaatgaatctgtaggaaagactacataaaattttaaaaaagagaagaagtgagagacacggagaggtttgaaaaagagaagctagtaagaaaagtacaactgtggacagcagggaaagaccaatctataaggaagaagtcagttaaaatgtgacaataaaataagatagacagatggatgacagctagataggaagggagggaaaaagttgtaagacgggcagagagggagaatacgaacaaactgattttaaaaagaactccattaaaaagtcggtacttaggccgggcacagtggctcatgcctgtaatcccagcactttgggaggccgaggcaggcggatcacgaggtgaggagatccagaccatcctggctaacatggtaaaacgcagtctctactaaaaatacaaaaaaaaaaaaaaaaaaattagctgggcatggtggcacgcacctgtagtcccagctactcgggaggctgaggcaggagagtcgcttaaacccaggaggtggaggttgcagtgagcaagatcgtgccactgcacaccagcctgggcaacagagggagacgctgtcttaaaaaaaaattggtacttaaaaaataaagagataagaagagaaagagaggaaatgaaaaacatttttaaaggactcagtaactggagtgaaagaaagagggaatgtaggagagggtaggaagggaggaaggaataaaggcaaaagggaggaaagaaggcagaaggaagggaggagggaaggaagaaaggtgggcatgcatgcagacaggaacggaggagaaatagaaataaataaaagggagcaagaaaaacaaagggaataagggaaggaatgaaggaaagaatgaagggaggaaagagtaagaaataaagaaatgtttaaaaagaactagttaataagaaagtaaaatcaagaagaaaaaaataagagaaagtttcacaagcagaaaggggccagtaaaaacaaagtgcattaaaaaagagaaaaagaaaaagaaaaggaaagaaagatagaaatagaatacaaaagaaaaatcttaaatgcaagaagcctgtaggaagaatttacacaaaagagaaaaggaaaagttttgaaaggagaagtcaatgataaaataaatttgagaggggatggtgaaaaggggagagtaaaaaaaattacaaaaatgatagtgcattaaagagaaagagagagaaggaaagagtggaagagagagagagagaaagatgtttaacaaagaagagtccataagaaacgccactgcaagaaataatgaaaacaagagagaaagaaaagaaagaaaaaataagttctgaaaggaggaatcaataaagaaaatatagagcaaaagatggaaaaataaagcaaaagaaagagggaagaaggaagaaagagggagggaaaaggatagagaaagagaaaaagagcagaaaattttaaaaaattaaatgaggaaggatatgtgtaagagaatgttttaaaaagaggtgctggttggctgtcgcagtggctcatgcctgtaatcccagcactttcagatgctgggccaggcagatcacttgaggtcaggagttcgagaccagcctgggacacatggtgaaaccccatctttacaaaagaaatatataaaaattagccgggcacagtgatgtgcctgtagtaccagctattcaggaggctgagacagaagaattgcttgagccctggaggcagaggctgcagtgagccaagattgtgcaactgcactcactccagcctgtgtgacagacgagactctgtctcaaaaaaaaaaaaaaagatgctgaaggtgctgataagaatagacaatatgatagggaagaaggaattaaaattttataaaagaggagtcaataagacaagcttgtagttcagttcagtgaaataatgaggctataatgttccgcctcctccataaaagatcatgtaagcagccatacggctcttaaccttcaactgttaacacccacttctagcagaaagaaagtatcaggtaggcatcttataccgggaccacctcaaaccctttttgaaaaagaaaatataagtgaatttaagttcactatattatagaggtgacagaagagtgaggatatcaatttcacatatgcaactgactcatatccactataacaaggctgtcatcttctaccatgcagacacaagggacacacatcttaaaactctaatgaaaacccaattagcacacatgcagttaggaatccttttgtcaatctaaatggttaaaaacaggagctgtaatcacctttttcccagatgaggtctatgtatatggttatatggttgcctctgtcaagctgtgaggaacaaccaagaattgtcattgccgctagcttggaggatctccagcacagttattatgctggtctgcctcccacacagaggcaggccgtgttctcatggaacagaaagtagttgttcccttctcccagaagacaattctggctagttagagccaaagtagctttaattagacaagatagtataaaggtaattttcttttttttttttttgaatatcaaaatatttcaattttatttctgcatcataaatttataattttaacaactttgatcattagctaatacagtaatacaaaaaaatgagaaaaaagatgttaatatttctcatttccataaagtgcagatttaattttcaattatttgccttagtaaacattgtcttatttcaggtactccctgccctcactcaaaaaaaagggagggtgtttaatttttattgaacaaatatgtaataccaagaaaaagatgaaagatccaataatgttttttgcaaacatgtttccaggtaagatttccaaggacatcagtactgagtgaaaaataatcctttacaatcaatatgaatgaatacactaacaagtacatcatttagacctccatgcttatttggcaattccagttatgaaaaaggtacataaataatacaaacaattggcttgacatgtggccaaactactttcactgaagttgctggaagcctttctctggttttggcccctgtaggaagttaatctcatattcccttagcaataatataaggtcactgtttcagtcctacacacttttatattcaatgggcttcttagtttatcacataaggactggcacttttttcaaaagaatattgctaacagggttaaatgagtgctaatggctgaacgtttgccaaatgcttacttctgcgatagtataaatatggattattaaagttgtctactcaagtataaaatatatgcaaaactctcataggcaaaatgttcaaaggccgggaaaaaccttttttttttttttttttttaacttttacgagaaagtgcaactgcagggtctcttgaatgatcttctagacagttccgcagaaaattagcagtttggctcagaaagtagagttcctcaggagaaattaaagttcttcctagaagaatacaaagcaacgtttcaggcagctttctgaaaataaaccattagcttatgcctacacagcgagacaaactggaacgtgtaataatgaaggctttcacatttgtcgtgatgtgcttttttcctcttaccccaggacctctagctgttctgtaatgttacataaagtagttatagcacttcgtccagcactgacagcaggcaggaagctaatcagcgaggagaaaatcggaagtgtgttcatgtgtttcattgtttttcaggtcaaatctcaatacttgcaaataaatcattaaaaagatataacagtttctctgttattttcaggacttcatgtagtgagtgggtaatcagagtgaaagagggctttctatcagtcatcagtgatacgttctgtcacacagtcagattttcagcatttgttcggctgctgctagatgataaaggaagttttctgttgctggtggaaatcgtttttgctttagcgcctccaaattaaggactctcttttctccatcagccgaaacttctgaaaacggtgctaggttggtaaagatttctcttgtttttagagcaatatcctgtataacctggctctctgatttctctggatcttctgcagactgaacaattagctgacccatttctttgtgcagtttgcccattgccatggcctcttttgcaaggggagcaatggtaatctcactctctgccagattcacaaacacatcatagaggtctggtctgttgctcacctccaagtctacaaatccagcgacgtaacctgtgcacatctgcagggcttccagctcatcggcgttgaggtgcacgtaagagtgaaggatggtccagtcctgtcggtgccacaccagggcaggcagagtcctggtgaactcctggaccgcttctatcttggggtgatacaccacaattcttttctttagcatcagtgctgtgtgtaagataacagtttccattccaaactgagatacaatgtctttgatggagccagccgggtaggcctttcgggcatcaaaatccttactaaggaaagagccgttttcttcactctggcatatcccctttgtgagaactgcaatataactctccatcattttaactgggctcccatgtttcaggtacattctacacaatatcctagtgaaggcagcatacttctctgggttaaaatctttggcggtcaggacaatagaaaaatgagtcacctttttcaaaatggaagaatctggaacttcaattattgtgatataaaaccatgttcttctgtactgaccaaagacaaagggatggagaagtttgttttcatctgtaaggcagcattttctcagcagcaggttccttaatgtggctgtcgtggaaggataacaccacacccacagaacttctccatttgtgtccttttcgatcagcccgactccaagcatcagctgagtgtccgccaactcggccgcagccatcttccgccgccgcggcgcgcagctctaaaggtaattttctttccttcccatcacacgtctctaccccagggtctctcaactttggcactattaacatttggggccacagaatccattgtggagggccatcctgtgcacggtaggatgtttagtagcatccctctacccatgccagaaacacaacacccatcatttgtgacaatcaaaaatgtctccagacattttcaaatgtcccctggaggacaaaattacctcccatcgagaaccactgcctgtcatctcccatttcctccgccacaaccccatatgtagatcggcatatggctctcctcttattgggcatggaaggatgaatagaatctatctgggatacttttgtcatccccactattaaaaataaatgtttcattatgtttctttaagcaactccctcaaagagaaagaaaatgagtgacactcccatgggtcagaaaccacaccaaggacaaaaatttaattgaaatgttatcattagaaatgagtaatttgtggaaagactggatttggtaatgacctgcttatcatgcagataaatcctctattctcgtctatcaaatgatggattttgagtaattctcaccaacagtgctacagcttctattgccatctgcattagatgccctaactactcagttggtgtcactgcctccacactcccatgagcagggcagcccacattttgcagttgacaactctccaagcatgatcagagccctgagttttccacagcccctgcttctgatctctcctctgtacttccccattcccaacaagattctgaggtatttttttcagcctgtgcatcactagctgctgctactgctgctgccacccctttctcagcagttccacctcctacggaagttttttacctgcatctcacttgttccacctggagaactatccttgcagattgctgaatggaaccacagcactagggacctagtgaggaccaagacatgggtcttgctcaaaaccctgcccttcctttgacttgggacctttcgggcccaaaagtaatttatgtcacttcactggcagcagaaatattttattctgccacatatttttctgcagcagtggagtgtgcccccagtattgcccactcttgttcccctcttccttttagaaaaccccacctgagtagtagctgtcatttaatgtttcaacccgcttctttagtaggcttcctgaacacatgtagggctggcactatttgttgaattgaagtgtcttcctttgttttgctttctagctcagtcattgattttcctaacatactcctttagattctgcctttgtggagcccccaaaatggctcagactttcaggaagcttccccatcttactgcttcttttccaaagatggcgtccatgtgcctgaggtaagaggtttgacttatgttcttactcctctaagcgtcagccacatgggcatcatctaggtgcttattagaaatgcagattatcaggcctcaccccagccctacggaatcagaatctgcattttaacaagatcccagtgtgggtatgcatgttcaagtttgagaagcactggcctccatgacctcataaaggcagaacaaagtcagggtgcttagacgaaatgtcctctgcctccttgggtctccaaacagatgtttctgtctccactcagatagcgcttagcctactggcattcaaaatttaagtctgccactagtgtactgactcatgctctggtctccctgggcttagtagagccctctggctttcttgtctatcccccaccccaattctggttggcttctctataacactcagggtagagtcctctcacttccaccatagtgactccccctggccagctccccagctagactttcagccccttctggaccatgactataccacatgggaaccaagagtggcttaagaaaccaaaacctcagagagaaccttgctgggcctgactgcactatactgccaagttgctgggccatggcccaggtgaggaaaaggtggaagcaaggactgggggaacctaagatctatcttcctagagtcttaaatggagagtggagctatagttccccttgtttgctctccatgttaacttcaattatctaaagcaaccaaggcccagaataaggcaaatgtgaagccacatctgatttctttgctctccagcctctctctgacactactcttccatcttcttactatctctgagcttctaaaggagtgatctttctttggtacctttctcctaggtcatataccccttcttcctgaccccagataacctttaatggtggcaaggctatctctagtagctaagcattccaggttgttgctacacaaaacagggaaaaaatttagggaaattcttgagacaatcatggcttacaagggaactgtcttgttgtgtcatcctattttgggatgagaggtgctgaatattaccttggtgtgtatcatggaattcctcctgttacaaattattgagtagacttctctactctacctcccctacctccactaccaaaccagtagatgcctatggaagactaggataaagagtaccgaaggagtcaagaattagaaatgatataaaatttttgaaataatagccctgttgcacaatggttatttcacatctgtcaggccccaaaggtaagcacaggaaaaatatgggcctcctgacctacatctagaatacattctcattgtaaaaagatgtagaatataaaatacatataatatttttgcaacaatgttataaagttggcaaaaggcaggacaatctcataaaaaggggcaaacaggcatttcactgaagaaaacgtatagatggcaaataaacacatgaaaagctgttcaacattattactcatcagggaactacaaattaaactactgtgagataccactacacattcagtaaaatggctagaatatacttgttcataccaagcatttgcaaagaccaagaggacctagaactctcttacacagctgatggggatgtaaacatggcacaaccactgtggaaaatagttgggcaaatgaagttacacttgcatctaccacacaattcagtcattacactcctaggtatgtgcccaatagaagtgaaattatacatccacataaagaatcaaacaccaatgttcatagcagcattattcatcatagctgaaaactggaaacaacctaaatgcccttcaatgggtaaatgggtaaactgtgatacatatataccagggaatactatgcagtaataaaaaggaatgaattactcatacaggcaacaatattaatgaatcacaaaataattatgttaaatgaaagaaaacagtacagacaaaaaatagtacatcttgtttgattcccttcatacaaacttctagaaagtgcgaactaatttatagtgacagcaagattggtgattgcctgcgggacagtacagagggggatgaactataagagggcaaaggaaacttttgtgggtgatcagtatgttcactatcttgattgtagtgattgtttcatgggtatgtatgtatatatatatgtcaaaactgaacaaattgtacattttaaacatgtacagttttgtacttcaatcataatttaacaaagttgtttaaaaatgatatgatttcccttttacttacttttagggccagttcatcattctcaaaatggtaccaagattgctatcaaaaagtgaagaagcaattacatccttgatggaatgtatagagtaacacgacagaacaaaaagaagaaattgtgtttcaaatgtttgtattgatcattagtttgtctagttaacttatttctataggatatcccattcactggcttggtgctgactagctagagatcattgtgttaagacacaggtcacacccctctccctggtaaagaaggtgctgagtaagcttcatgctaaatgtaccacgcaatttagcagaaagtaacttaaacatttgatgatgatgatgatgattatggtgatgatgatgatgatgatgaaagttaacatttgttgagaacctactgtgagctaggtcctgtactaagtgagaaagaaggaaaaaggaaaaagtgggtgacacagaatatacagatggaaaagacataatcaccttctaagggtcagacttacataaacaaaagttcttataataaaatgggagttttgattgatgcaaaatgtagtgaaagtgtagaagatttaaagcctagtcctgcctagagaggttgaagaaggctttattaaaggaggatttaattaaattaggtcctgaaatgtgagtgggaattttccaggtgagtagttgtgaggatatagtgagccaatgttgcagatacaagtgaaaagcgtacattgaaagcatggaggtgtgagccagcatagccagagaagtgcaggagatgagactgaaaaggtgagttgaagtcagagccttgtacaccttgctgaagtatgactatatcctctcagtagcagggaaccattgaaggtttctgagtaggcatatgacataagaattatttgaatttctaaaaagataatccagttgcagtgtttgagatagatggtagagaaaagagattagagacaagatagtttggagacaagatagtttggaactatcccagtttatctgaactgggatagttcagataaaaatgataagggcccaaacaggcagcagcatgagggtgaaagggaagatatagattcaagatattttggagttagactatgtctggagttggtgacttaatagatgtgtggagtctgagagggagattgatgatgattgtattagtctgatctcacactgctaataaagacatacctgagactgggtaatttataaaggaaagaggtttaatggactcacagttccacgtggctgcagaggtctgacaatcatggcagaaggcaaaggagaaacaaaggcgtgtctcacatggcggcaggcaagagagcttgtgcaggggaactcccatttataaaaccatcagatctcaagagacttattcactaccacaagaacagtatggggaaaactgccccaatgattcaattatctccaccttgacacgtggggattattacaatccaaggtgagatttgagtggggacacagccaaaccatatcaatgatgaggatgatgatgatgatgattattattattattattattatattattcagtttttgtatataggtttttcacaaagtagggtgtcttttctctgtgcttccatggtgcttaggcttacctctgtctcagaactcattctactgtatcatatttgtctgactgttttactggatgataagcttcttgaggtcaggaattaaatatattttttcaggtctaagcagtgcacccaataagcattagattgaattggagtggccttactgaaataaacggggcaaatctgaacttttagaatggagcactgggtgaatcaccacatctttaactaaaatatgaactgcaggaagggaagtgaatttggaaagatgtgagtccatgggtacataatgagctagttaagtttaggtgtctgtgagagatgtccagcaagtggttgataatatgtattagcattgagaccagtgcttgggagagaggtaggggatgaggggaagatattatattaatttgatgcctgtagagtaggcaaaagtctcttttagaagcttaattatcagataccacatgcagggtgaaaaaataataatagaagcttaattactaattaatgcttttctctggaatactaagccatatagaaagataaagaaatgactaaactgtcatgtccttcaaatgaaggaggtaagaaaataaataatattcataatttttctgtagtttttcaattaaatagttttgtcatacagctggttattttcctgattataaaatctgtgcttatttttagtaaaggaagattttaaaaatattcatgattatgaatgttattatcttacatactggggtgttttttagctgaataggtcatttgggatttgcaaagtgtggagaagttagagttcctgcaatggctgcccttactgataggcagagtaagttcataacatagtatgatttgggagtcccagtgcagaaaattctccccaaaaaggtccctaccttctactgccatccttctcctcagacatgaaaatacatcctgcttcccatctccgcaaggctgaactagaggttagctaagtctctgctagtccctacagaagattcccatgcatattctacacatacccacggccaccaggcacactaggacatcaccatctgggtagtcattgagcactttaaatctaatatgcacaaaacaaaattcatcatcttccagtcaccccaaaacctgttcttacttcctccttttttatccaggcacaaaacttggctcatctttcgctttttcccattgctcatattctacatcttaaagttgccacattctgtgtaatttacctttcctttccattcatgttatccctgcccttaatgattaccataatttgcctccaatgtcttcttattcctttttttcagtaaaatgtttccttttccttttcattttattttttgttttttaatttttgtgggtacatagttggcatatatatttatggggtacattagatgttgtgatacaggcatgcaatgtgaaataagcacatcatggacaatggggtatccatcctctcaggcatttatacttgagttacaaacaatccaattacactctaagttattttaaaatgtacaattaagttattattgactataatcacccatttgtgctgtcaaatactaggcctatttattcattctattttttgtacccattaaacatccccacctccgctctagccacccccactacccttcccagcctcttgtaaatggtcacccatccttctactctctatgtccatgagttaaattgttttgatttttatatcccacaaatatgtgagaacatgtgatgtttgtctttctgtacctggcttatttcacttaacataatgaccctcagtcccatccatgttactgcaaatgactgaatctcattctttttatgactgaatagtactccattatatgttctttttcttccttttaacctgctctacattttgctgtgaatgtaacctttccaaaatacagtttggggcatataatccctctactcaaaagtcctcagtggtagctgttggctactgaataaagtacaaaatatttcattctcattgggagggagataaagctagcaaaggaagttacagcaagaagttagggagttcagacttgtccctgaggtaagtggcaagccactagaagtttgtaggcaggggaaatttaaaaacctcatcaagtcatcttatccttggagctactgccttaaccggaataaatgtatccttgactatggtaattccagacattatggcagcccaggaaggagaactatatcattttctcaatttaatagtacctcttcttttccccaggaataaaaagtgcctcacttcatgcttcagttgtttctgctaaaacaacaaatgtccccagacaatctttaccagatattctgagacaagaggcaagtaacatttcttttgtaccagatgtagatagaacaaatgaagtatgaaattatgatcaagattggtgtacaacaacttcgttcattaaatgtcaatttagaacagccttattccctgaaattaaccatcctaaagtaaggttttacaaaaattgaaatgcaaaccccagtaatagccctgtgctactttagtctactgacactggtggctatcagttatgttaatgtcaccaagctgtaaatgtagggaataccagtaacaatttgtcagttagaaaaagaaagatggtgggcctgagatttgttagacaaatctcaaatttgaatgttatatttgccttcattcttaatagtaattacctgaagcaacttgagtgttcccacttaatagcccttaggttataggctaactggtgagctacttgaacttcaagatacatactagtgctctgaagatgaagcatcaaattgggtttttgtgaatcacttgtcttctagtgctgatgggttgtgcagagacagccatattgtctcattctgtccccttggttaccagtccttagtcatctaatgctgtaaagttagcagcagatattcatggcgcagccccttgtcacagcatagattgtctctgtgggataccaactgattattataggaatcaaatccacattgttggctctgttagcactgtattaactgattttgctgttctaaaaaggtaacatggtttgagagagacgtcatcaagcaggtaatttactgaagtcttcccaaaagagttttagataactaaagtagaaaatgtcattggcatatcctgtgttaattgcatactaagtgacagacttgcttatgtgtaatggctaaaaggtagcatgtctgccataatatgcttctctgtataaacaaatatttatgaaatatctgctatgtgcaaggcattgtgctactaagtcaacatggataatcagtatgttcagtatctaaaggaagaaacttaactactttgagatagtttagtagttgcaaatcaggagttaattttttcactggtctcaatacagagccaggaaaaagtgtccccttattttaacatggatggcaagcctaatattacatatttttaccaaaaaatatcaataaacaaatttagaccaccagtttttaaaggagactttgaaatatgttgggcaaaataagtacatcaaatggtcacaaatatctctcattattttgagaaacagcataaacacctttattacaatagaatacaatactattttccaacttgtttcacccatcctatcagtgttaggaaatgtacttctggtggcttgtgtccagctctcagatgtggaaaaaaataaagtcgactttgttgcatttatctacctgtacaatcaccaaagcaagcagagttcttggccaagccaaagagtcacattttaacctgctgtctgccttccagttctctaaaaatgtctctcctatacttagctttgtttaaaagccacacatattctttttagctgttcagttgattaccttccatgcttatcagggtgattccacagttagttaattttagaataccaatgaattctatgaacctttgagttctacaaattcagttctacaaatagcatatgtcatataaaccaaataaaacatggatatttattataaatgagcttttgaaataagttcttaaatcactttcttaaagttttatattttaaatgtgaaaaatacccagtgttcacattatttaaaaactccttggggaacttttgttttattgtttttatttttcttatggtatatataggtgagacatgctgatttaagtgtaaaaaggcccaagaaaccaagcttcagctatgaaccaggtaaatattagcaacaattattaagcacatctggcaaccccttaattcattcactcaactaacgtttgttgagcatctgctacatgacaggcactgtgccaattatttaacatacaaagcagaaaagccatggtccctaccctggaattttacagtttagtggggaacagtcatgtcaataattacaacccaatatgataagtgcatactggagatatgtacaaaatctagtggaagcacaaggaagcttttacagaagaagccacaattgagctgagacatgaaggatgaaaaagaattttctaggcaaacaaatggaaggtggtagagagaaccttccaggaaaagggaatatatttaccaagatatagacattaaagcatgtgtttgtggaaatacaaattgttttagaattgttttacctaaaagttcaagttagagaattgcagaagatgaagcttgactggtagataaggactggtcattaaaattctggtaggccatgacaagcatttaccttttatcctgttaatcaagagcaagtactggaaaatatcagcaggccgggcgtggtggctcacgcttgtaatctcagcactttgggaggctgaagcaagtggatcaggagttcgagaccagcctggctaacatggtgaaaccccgtctctataaaaatacaaaatttagtggggcacggtggtaggcgcctgtaatcccagctacttgggaagctgaggcacgagaatcgcttgaacccaggaggcggaggttgcagtgagccaagattgcgccactgcactccagcctgggtgatagagcaagactcagtcaaaacaaacaaacaaaaaaagcagcatgggaaataatatggtcagaatttgccttttcagaagaggtaaaatggaattagaagtaaagaaattggaggaaagaaacaataataataataacagcatttattgaacacttactgtgtaccagataccatgtaaaccctttatattctctcacttaactctcccaataatttagtgaagtcactactatttttatctatcattctatatataagcaaacgaagtctcagggtggtaaattgtcttgcccaaagtcacacagcatgtggcaaagccagagttttaacccatgtcggtctcactcaaccaatcctaaccgtaataccacgcttcttactacaattaaaaagggtattacaatagtcaaagtgagaaatgactcctgaacaaaggcattggcaatgaggatagagaactgggcccagatctgacttaaactaaggaggtcgaatggctgaggtttggtgtccaattgaatataggcaatgaaggagttgaagacaacacccagattcctagactgggcaactaagtggatagtgaagagtggtgccattcagtagataggcaatacagcaaggggaacacttttggaagaaaaatatttagttcagctttgaatattagtatgagtttaaggtgcctgtgggcatccaataggacatctaagtggaatagccaaacaggcagttggagaaactggtctgagactcatgagagaaacaatgaaaagaacactttatatcaatacccatggaaacagcttttgttatttcccatagatcttaatataaggtgtaatttttcaggtagattatactttccccttttaatttcttttttgatctgagagttgtccatagtatgtttctttattaccgagaaattattattttgcatcacattatttttattagtttcagagaatgtagcctggaaatctctagcataccgaagttgttaatgttttcttggtggctaaatatgtgattgatatttgaaagtgtttcacggacatacaaaaaatgtatattctctatttaaagtatataaaagtctaaatgaatattaagttatatttatggattatactattcaattaacctgtctttactgatctgtctactagactatcttttcttactgtctactagatgtgtccagccatcaacgaggtgcattgacattctccaccataattgtatttgtattatattcccattgtatttctagtaggtattacacatttaggttcttcaggatatttaattctccaattgctaaaaaccatggaggtatgtttttttcagaagttccattagatatttattactgagtaacaaattaccctaaaacttggcagtttaaaaaaaaaatgacctcacagcttcttggtccggaatataggagcagcttagctagatggttctgacctggggtgtcttaggaggttgcagtcaaggtatcatcctggcctcctgcagttacctgaaggcttgactgggactagaggattcacttccaagctcgctcactcacagggctattggcagaaggtctcaattccttgctggctgttagcaagaggtcttagttccacaccatatgggccactctatagggcttctggagtagccgcatgattatggcagctggcttctcccagagcaagtgttccaagagagaggggttgaagtcacagtagatcttatgatcttatctctgaagttacacacaactgtttccaccatatgctattcattagaagcaagtcactaggtacagcccacactcaagaggaagagaattaacctccacccttgcagggagaagtatccaagaatttgtggacatactctaaaaccaccacaacagtattatcttcacacttgatttctcaggcttgcatactactaattccagctccttccttttcaaaaccaaacacacgtaaaaacgtacacaaagaaactcaaaaagttatatagaatttaagtaaagcttttaaaacagatcattggaatttattggttactcacaatacactttatatttattgggagaaaaataaataccaattcaccttgattttgaactggctctaatttgtaatactactttccattattcagagcattcttattgtggtattcaatgcttgtcctgttttggctagacctcctaagtctccccaaccaacccttctgggtcaccttgcccaaagggccaatactctcttttaacagtaactttggacccctgttaaacccaaagttaactgagattgaaagtgaaggaagagaaacaggcaaagagggagactgactaatgtcacagatttttctcttttaacattagaaaagaacttaatatgttactttttcagtgaatttcatcatacataatttttcttgacagtgattttgatggcagttttgatgtctgaaaagtcaagagagattgattttataatttagggctaataatttttggaacattctcccagattctaatattacactcttgatccaacttagacttagccacatttattttgtagtgagctgggaagagcatggggttgtaagaagagtggagtggctgggcgagtcttttctgcttgccctgcttgatcagaggtttctgatcattcactttctacctacctcctcaaaactcctagtctcctctctctgacccacagtgggaaagaatctacagatgattattcaataatgatgaattaaaattgtgattttctgatcatattaaataccaaattagatatagcccttttctaggtatcacaatattctattctatgttctaatccaaattagacactgacttatttgatgaatcatgagaagaaacaattctctgagctgcagatagattttcagacagaaaaagaaaattattatttgttggcattcttcaaaacctacttgtaaaatagttattaacatatcgtactaggtccttattccttgctgtcactgctttgtttcaaatcctccagggactcccagtgaggcacaaaatacatcttaaaatctgggtccactgcctacctcacctgcctaatctctagaccattctacatgtattctgtgctccagagatactgaacgacattcaattccctaaacatatcatgttatttacacctcagggtctttgcccttactatttcatttggctacaacttgagtgtccctctttaaaacgtgttatcctttaagattcattcagttcgtgtcacctcttccagagaaccttcctcacaatctgtgtagacaccctctgtcactgctcctgaagcattatatatacccctttattataggacttcctatgttatattggaatgaccatacagtgtctggcacatagtaacactcaatggcattgatttgttgaatgaattatttaatatatatatatatatatatatatatatatgtttgctcaatatttgttcattagtctgcatgttattaatctcttcctactctaacactttctaacatgtttgtatgccatctagtaccataagcggtttttttttttttttttttttgagatggcgtttcactctgtcacccgggctggagtgcagtggtgtgatctcggctcactgcaacctctgccttccgggttcaagcgattcttttccctcagcctcccaagtagctgggactataggcgcaagccatcacacctggctaattttttgtatttttattagagacagggtttcatcatgttggccaggctggtctcaaatgcctggcctcaagcgatccagccacctcggcctcccaaagttttgggattacaggcgtgagccaccactccccacctcataagtagattttaatgaatatttctggataatgatactaaagcaggtctccatgtagagcaacatgtccatagaaatctgttcatcaaaatccctgtcaggaaaaagtattcattgaaaacaatatattaagttttttttcaaatatgttataagagaaaaaaaatctgtgaatcagaaagccagccatcatctgttgacattagtcagtctccctctttgcctgtttctcttccatgactttcaatctcagttaatctcaggttttacaggggtccaaagttattgttaaaaagagtattggccctttgggcaagggggctcagaggggtagtttggggagccttaggaggtccagacagaacaggaaaagcattgaatatcacaaacctactccataatgggaagtcattaagggaaatccctttgcagaccacagcagacctggctcagggctgagcgtcctgcccctgaggtgggtgagccagggtgccttggatgtgtctctttattttcctgggagtaagaagactattaagttggccacaccaccaaaagaaatgacctggccacctgagagctgtaacgtggaccaagcaaaaataagaaggtgaatttgatgaaccacaactctggggctggatggatcaaacatgaacaaagagaggttcagggaagtggcatactcacacatatgtctgttcaattcatagactgtgcaacaagcacaaaattggcaccaaaaagatatttcttggtctagtggtatagtgaaagtaagctgaaaaatcctattctatttctcacatttcacttcattaaaaactttaagaatgtccctattttatgtattaagattaggaatgctatcctaagcataagaatgtaggtctgttgtacatgatctgtggtcataaggaaataatacatattgaaattatcagctcatatctattggaatggattggatttaggccaatttagacacagaaggtaagtatcttccccgttaatgtttacatgttattcttagaggtgtttgatttaggacatatttatgtaaaacaagtgttttcaaccatatgctgtcatcccaaagtatgtttttcaaacttattgccgctttcttatctgtggttaaaaaaaaaaaaaggctgtgaaagaactagacagtagcaatggtagcatgacattgtcaacgtacataatgctgctgaagtatgctttaaaatggtaaaatggtaaattttatgtcatgcaacaaaatatgaattaaggcatttgggaattagagtggaataaaataagtcttccctgggttggccctcaaccctctaatgggtcaaaagagagtatgttacacgcagcaaggtgataaattttctttgaatgttggcctaaacctgaacaatctcagagctaactttggagataattgtgggggaggcaacaaccacattatagggatcctatcattctcctagtgctcaaatgctaggcatccagcctttgctgccactgacttgtatctacagccttgagaagtacagttcctgtggaaggtaaagactcttgttctggctgttttgagagtaacaacttaaaaacatactattttatgatacgcaaagggatttttatattaccaaaatatatctgcaatgagtaaaaggacataaaccagtagagagtgtgtggacagagtgactttattttattttgttttatttttcaagattgatgacaattctttttcttttttatatttccttttttattattattatactttaagttctgggatacatgtgcaggacgtgcaggtttgttacatgggtatacatgtgccgtggtggtttgctgcactcaccaacccatcacctacattaggtatttctcttaatgctatccctcccttagcacccccaacccccagcaggccccagcgtgtgatgttcctctccgtgtgtccatgtgctctcattgttcaactcccacttaacaagtgagaacatgcggtgtttggttttctgttcctgtgttagtttgctgagaatgatggtgtgcagcttcatccatgtccctgcaaaggacatgaactcatccttttttatggctgcatagtattccatggcgtatatgtgccacattttccttttttttttcttttattattatactttaagttttagggtacatgtgcacattgtgcaggttagttacatatgtatacatgtgccacgctggtgcactgcacccactaacttgtcatctagcattaggtatatctcccagtgctatccctcccccctcccctcaccccacaacagtccccagagtgtgatgttccccttcctgtgtccacgtgatctcattgttcaattcccacctatgagtgagaatatgcggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaatatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagcgttcctatttctccacatcctctccagcacctgttgtttcctgactttttagtgattgccattctaactggtgtgagatggtaactcattgtggttttgatttgcatttctctgatggccagtgatgatgagcattttttcatgtgttttttggctgcataaatgtcttcttttgagaaatgcctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcaccccgatggtagtttcttttgctgtacagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagacagttttcccagcaccatttattaaatagggaatcctttcccccttgcttatttttggagtgactttattttaaatgctaacctgctgtgtaacttctgactaaccccaagagtccaagaacgcccccaaaatgtctagttgatatattaccctttatgtaggaacacctattcattgtaggtttcctccaaaacaactcttgttgcagaaatcattggctgggatgctcataccacttacacattcattccagagaacgtatgctttttttccaagatataagccctgggtctgggggattgtggtgtggagatctacttgtcttgtgaccactcaagaccacgattctgtctgtaagttcccttaataaatcaccccaaatcgacaa

SEQ ID NO: 5012 - DNA, 41677 bp, human; identical to SEQ ID NO: 3702

SEQ ID NO: 5013 - DNA, 11687 bp, human
cggaccaagaggctcgccaagaggtagtgcaggggtagggcaccagtggcctgagcgcagcccactgcggggtgagagagggaggtgagggcacttccacgtggaaggcccgacgtgagggagggagaggagacctgagagtgtggaacaagttgcccaggcttttgcgttcgatgtctcaaacgtaagagcgcaagaaagatttaatttttctaattctcagaggagcaggaagcagtgagtggtttccgcgcgccgcagggctttgtttaactttacaggttctgcgctgcctggagctacccaggggcaggacccgcgcagcgcacctcaacccagcctaaaggccatgctctgcagcgcagtggcagccagagacccagggcaaccccgagaggcagagggcgcacattccgcagccccctaccctcacctctgtccctagctcagagccgagggcacgcagcgggacgggtgctcgggcggagggtcggaggtggagacaggctcagtcccctgcactctggccccttggaggggcttgggggtggtgggctctctcttcaactgcgaatagcagccgtgtggccctgtgtcccggagttagctaagtccagtggaagaatcaaggactttgcagacgtgagagttgtgtctctacagtgcccttagataaacagaatgataataaattatgccagtatgtttcgggcttggagacgctctctgacttgcccaaggccacccagctgcttagtaactgaggaggcctcctgactcctggtctagggatttttctgattgcgtcatagccatgagagtggtccaattttgaatggggatggatagatggatggatggatggatagacagacagacagatattgatatttttaaaaatatgcttatttgaatgtagttttaaaataccattcctgccatgaaaactacagggaaaaacatctcccacagccccagttccctatgacagccactcagacaggattttgaaaaagaaaactgacagaaaattggatgcttgttggggaagatatgatcaaaggagaatagagggggtaggagtgggggaacaaagatggaggagaagaagctctcagcacggattctgagaacttccttattctgaaggtttctttgatatggcctctgttcagatggcttccgggagtgtccccatcagtcctttatttcttatgcccactctgtagaagccacagatgtggtctggagaggcagatattgatgacccttcttttaattaagtctcatttccctttttccctctcttgtagtgagtacatcgaagaagggaattttgtatgtgtgtgagtgtgtgtgtgtgtgtgtgtgagagagagagagagagggaaaatgcttatgtaagagagtgtaagggtgtgtgtgtacatggatgtctgtgagtgggaatatgtgtgtgtgtgtgtgtctgaaagggagcaggtctcaaagagggaagctttgagagaggcaagggagataagaagaatgaatccgaatttacagagtgcaaactaaaaacttatagctgactagggatctgtccagtgctggtgggcctggggaaatagtcaattcttaatattccttaaaagaacaaaggaaaggaaacatatttaaattagtgcaagaaagatgatgttaaacccatgggcctttcttgatagtcttcagacacttgacatttatgtgaccttcgactaggctgtgagatcccagggcaggaacaagggctttctactccaggtagctctccccttccctccaccatctctagcatgggtggcttccatactgtgccaaggaagccaaagttcaggattaaatccattttgtaggccagttagcttttatctacatttcatagactagactaatccccacatatcacacagttagctgccttgcatctctgatcatgaaagacccagtgaaaatacagttcatcttatcccatctagaagtgtgcttcctgctgacagtgggtgagtacccattttcatcttcaaaggatgatacagaggcattcttcagcaggggacactatctgcctcattccagatagtagcacttctgctaagtcttcctctcaagtttggctcccaggtattttggagggcaattcctcaccttgcttgtttgcttgcttggcatagaaatgtaccctttggagaacactttcattctacccttttattttatcttcacagccacacttaataggtaccatgattcttgttttgtaaggtcatggatctgaggctcagaaaagcaagataatttgctctctgtcacatagttagtgagtgtgtaaacttacatggagtgaagctgggatttgaagctaagttccagtctatatcacaggaccttgccaggataccatgctgtcaggttgggggtgggctggggtaagaaatatggtgagatgcctacacagggcttttggtgtctttctcctctgtcaactcctctcctctacctttcataatagtcttttttttccaaaaacatatatatactcttcctgtaaatatatatatacacacacacatatataaacacacacacacgcatatatatgtgtgtatatatatgtgtgtgtgtgtgtgtgtgtgtgtgtgtccatgtatctatctttctttctatcttcatttcccacggaatggcacagagcaatgtataaaaataatacctcaaaaatccaaccacatccttaggaaagaaggtagtcttggtttagactttcccagttccaggcagcagatgttggtggtgaataccaagaactgctatggtttggtggaaagggcaaggcttgagttggggataggaagggagagctggttcccagatcatattcctccatggcatttttgtgcaactttagataagtcacagcctctccaaagtcttagtttgttgctattgtaaaatggggaggaaatatccaacctacctctttcccaggggttattgtaagaataaagtggcatgattcatttattcatgaatcacgaatagctgttttaattacaagactctcaagagcttataatcctgtgattcactcgacaaacacttattgaacatctattgtgtgctagggtctggagataatgggcatatggaaagcttttaagaaaatgaaaagcaggagacaaattaggcattaaaaacttttacctcctattgatagaacattttatttttaacttcttccaccacaatttaatagaagcagcaaccaaaaggggaaaaaatgatatgcatgacacagcttgtgatgccaacactattatgcaccctgatacatattgcagataatagtgagaatatctgtatcttcgtgtacttgatgtcacattgccttgtttacactatcctttgggatgtttatagcataaaaattgcctttcaccatcctgagcctgagttgtttctttagtcaataaaatttaaaaacaggattccatggaatgacgactgtacttattttacaaagatgctgtaatatgtggtggctgcctgccgtcagatatgacctaccctggcttatggaatcaggctttgattatgtgtattcttttgatttctttatttagcaatgcagaatcttgcagctagtgaaagcaagtatgggtgcgtcaatggcaagagccctgagactgaagagaactgggttcttgtccaagctctgttgtcaaattgctgtgtggtcttgggaaaacccctgtctctctgtgagcctcagttttctgacctgtataatggaggtttgggaccaggtgatggctaaggtcctatttctgaaacattctaatattataatgtttctgaaactttcttatttttttgaagccagggcttttctccatatattttaacagtaatattacctctagtttatgaccttctgctataacatgatgggctgactcaatgtattgatgaacactatccccagatttaattatcttggagcgtcatcaccacattgtataaaatgagccatattgttcattgcatcagcagcctttgctgaaatggaggttatgggataacaactttaaggctaactcattaatgctctgggatgaataagctaatgtgtcagcagaccaaactggtgcccaaatgttttcgtatagagacccatatctctttcccatgttgtgatacattaatggggatgtctttatccattgccgctgcctgtagtcatttgaataatgtagatgcagtaccttctgggcacccagccccattcactatcaatttcctaaactttgaggcactctcagaggcttggaccaaaattctagtgatgccatagagtacctaatttataaggatttaaaccatggcatcagtgcagtccctgcttttttttttccataggtgtttactagtaagcactgcaccattcttaactattttatgggggtaatggagtaaattagtcctccaaatcatgaaggctgtagatttatgcctagttgaaaccatttcagtcctcacaatgttgaagtgggtaacctttctgacgttaatttgtttctccatctgtgtgccatgcattttgggaggacgtgagaaacaggcttgatgccattcaagtgtgtttcccctttttgtattgatggaaacttgatttgtgcctgtccgctctttgttcaaattctctctcttgatatctgctcatattctagcccctttacttatccaaataaaatcatatatatatatatatatatatatatatatatatatatatattgctagtgacaatgtagaattggatggcttgaaagagaaacaaattttgagacatacaggcactttattaatctgaataataacatttgaaatattaacctatgcagttagtttttctaaattttataaaatgttttttttaaatacttgactctgctgaaattggagaatgaagaagaaagatatatcccttaaaatctcctaagatctctttacataattcaaatttagtggagaagagtagattgttcaatggattgatacaaattctaattttatgtaattacttttgaaacatgattttttttgtaaactccagccctctgcaaagaaccttcactattaacatgtttattaaaaaccaatgctaaataccacacataatattattcattcaactctcagacaaccactgaaatggatactgtgtcatttcaccattttatagagaaggccactgagactcagagaattcaactgactttcttaagatcacacagctaagaaatctagaggctggctttgaactcagttatatttggctctaacactagtaaaagtatttgtctaaagatagtgtttctgcaaatgttttgaattctagactgaaactgagctggtttgctttcatcttgcttttgaatctcatggtctcttcaggctagtgccatggtatactgaaggggtaaggggaaaacactttggagcaagagaggtctcttggcacctctttcctgtagggagcctccttttgtgttcagcttgaaatgtcaggcctgaagtattcaaatctcaagatcctgttatgtgcctctctcatagtgcgaaagcctgcctactcattccccctccccaccccacccatctgcttcttgtctggggacattggtcttcctaaatctgcttctgtattgtatgctactggcaccttgagaaggttgaaagcaagtaaggcaatgccaatttttctgttagaactgcagcatataactgctcttaagtttagccctgtgtgctggagcagggaggcaatgacaaacggtttattctaaggcctttgatttccttcggaattgtaagcatctaggctgactcatctctcaaaggcttttctctctctctccttttggggctgttgttgattggggattttactgtttgttcttaccttatatttgggggagagaagggactgattttcatcttatttttgggtgaaaaaaccagctctgctctttggatgatcagatctggtaagcttcgataagaagaaatagctgaaactccaaaacaggtacaaaagatatctggattggggaaaggggagaggggagtaatgttagagaaattaagccagagctaggctgtgtgtctcaggatgagaccctagactaataggctctggacctgctattttgaatggggaattgctagaggcttagtctggaactgtggttaaatgcatgtgcctttggttaaaatggtcactttgcaagttgcagtttggtggttggggttaggtgttcactttgggtccaggggatggagctttgcagttgaaggtttaatatctatgctaggtgttttcctcttggtttagttcaaaagccacaggaaaactcctcatcttttctcttactgcacctatttctgacatctgtgatcctggctactaagggaagtaggcaaaagagttttggagacaaaattcaagtatggtttatttgtttgtttgttttttgttttttgttttttgtttttttttttttggacagaaggtagctcatctatttagattattgcatgataaaccgttacttaacttttctctgccaaagctgcattgcctgatctttgaaatttaagctccccaccccccaaatcatatatagaatgttattgtagattccatgggaaagagacattcagtaaagttgtatgtaactacttcctttcttggcaaaaggtttagttccccatctcctgaattatcttctctatcaggaaccagccatatttacccaaaccatgaacttgggagctatcctaaattgttttctttccattgcaattaaagatgttccctaagccctgtcagttccatccatgagattcgtcccctactccagccctagtgacactgacttgtgtcaatatcccttgcctcttggctcatctacctacttccagctctctacccaaaacaggctttttcatggctttctgtgatttttccaaggtgcaaccctgaatctttcactccctgcctaaagccctattgccttcaggaaaaagtccgactctttaagctggcttatagggccatccatgatctcatccctgcccatccagatttttctccttccaatccctttatacagcttcaagaatatgacaacctctctcccatctcttttcctttgcacaagctgttctctctggatgctcccctcctctgtctccaggcagatttagctgttttctcctttctgctctcacaatactttgtttatatcttggaggtctaacatcacaaggttttgtaaattgttgctaacttgtgtatctccttcactgcactgttaaatctttaaaaaaaaaaaaaaagaaatagtattaccttgctcatcctttcaatctttagcgcctggcacaaagtgggcaattaatacaggtttttgttttaatgaatgaatgaatgagtgaacaaatgagtaatagagaatgtgcgggaaaggatgctgtgtgaggtgtaggggcataccccattggggatgctttgtagtctggaagtagtataagatagtgggcatcatggagaaggcacatataaaataggttttaccattacactaagacaaactccactttgataccaattctgtttaaggagtctcactagaaatggtctggaaatgatgtttgttggttttggtacaaatgatttttttatgaaaaagtaatataatgaagttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggagatagcaagacagtgcgtgagagagagacgctcctagccgggcggtgaacgggagggcggtgcgggcgcgggggcggcggcaggaggtgcgcctctagcactgcccacctcagctggctgccggggagcgagcaggacgcggcgcaggacgaggttcgagtgcaccagggaatctcaggggtaagcgcgcggatttggcagcggagcccaggcggttagcgcggacccaggcgcgccccagaggtattggaaagtgctgggggtggcagcttcgctaggcgcgcaccgcgaacgcagcttgaattgagcgaagcaaagggcgaggagcccccgctggcagccactgatgccagattcggagtgcggggacagccaggtgtcgccgcttctcctaccgcagcgcagggagccgacggcaacctggtgcgagcgcgcccgcagtaacttggcgaccctcacccgcggtggcgctgcaggagagcccctccctcccctctcctgttgcgtgatctgggggcttcagagccccggaatttatgttttaagtgttgtattgagcgactacgggtgcgtagcaagatgcgcggtgcgcacgcggcgcattagattgtctggtttggttaaattcttggagtctgataagagtgagataggcttgtccttgttgttaggtggggaaactgaggctcatagaaagcaaattacttttcgcccgctgggcagagctcgcctctctgccgctccctccccctgctgcagatcagggcattgggatgttttagtcacttattaagtcctatttgtaagtgtatcttttcttttttctctttctgtagctctgcctattgaccgtccgaacaccttggataagtggtttctgattttgagaggacagcagaggggtgagggggctcttgtattttctttagaaaagaaatagaatgctaaccccctgtgtagtgtggccctggctattggagactgggtggcgtccactgtcccaggggacactctcctcagctcccaaaccccacagtgggtgatatcaggaaatggcgcagtagctgtaggtgcttggggcggtcctctcagaccttcctggtggactcaccccacacagatcaacccgaagaaatcgccctctttgtttcaaggtagtcacccccagggaaaatttaaggcagggacctcgagcctcgtcggggtggttgagtggagctgagtcctttcgccaaaccactgcggggtctttttggctagctccccagggaggggcgctgcggttctggagaggtggggttggctgcgggtggttgctgggaggagtgctacagcccctgcttcctcctgatttaagcgctgcgaggctttgacgtttctcattctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgagtgagttaaaccctccaggtttcaggcaggggcctctcctgaggtatgcaggaatgtgaggccggaggatcaaggcctgtgccctcagaggcaggggggagctgaacacaatatgttgaagtggtgtccttggcttgccacaaagggaatgtatcttgtcctgaatgtcatacatacagtactcaggaaggtcctaattgactctctttatttcccattttaagataatctggatttctccacagggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggtaagggagctgcaaatgggtaaatcaaggaaggaagcaaagggaaaggagggatgttctggaaatggggggagaaaagaggccgaggatgaagggcttggataacattcccctgacacccagtggaggtcgcgatgcagtagggggtgaggggagaagagaaatgccatgggaaagggattcagagatgcttagcatcccctggtcttttctttcaggcttaagcgcagtggggatttttacccttgaatactccgtgcagcgagtg

SEQ ID NO: 5014 - DNA, 31526 bp, human; identical to SEQ ID NO: 3703

SEQ ID NO: 5015 - DNA, 31637 bp, human; identical to SEQ ID NO: 3704

SEQ ID NO: 5016 - DNA, 11687 bp, human; identical to SEQ ID NO: 5013

SEQ ID NO: 5017 - DNA, 11166 bp, human
ttgtatgctactggcaccttgagaaggttgaaagcaagtaaggcaatgccaatttttctgttagaactgcagcatataactgctcttaagtttagccctgtgtgctggagcagggaggcaatgacaaacggtttattctaaggcctttgatttccttcggaattgtaagcatctaggctgactcatctctcaaaggcttttctctctctctccttttggggctgttgttgattggggattttactgtttgttcttaccttatatttgggggagagaagggactgattttcatcttatttttgggtgaaaaaaccagctctgctctttggatgatcagatctggtaagcttcgataagaagaaatagctgaaactccaaaacaggtacaaaagatatctggattggggaaaggggagaggggagtaatgttagagaaattaagccagagctaggctgtgtgtctcaggatgagaccctagactaataggctctggacctgctattttgaatggggaattgctagaggcttagtctggaactgtggttaaatgcatgtgcctttggttaaaatggtcactttgcaagttgcagtttggtggttggggttaggtgttcactttgggtccaggggatggagctttgcagttgaaggtttaatatctatgctaggtgttttcctcttggtttagttcaaaagccacaggaaaactcctcatcttttctcttactgcacctatttctgacatctgtgatcctggctactaagggaagtaggcaaaagagttttggagacaaaattcaagtatggtttatttgtttgtttgttttttgttttttgttttttgtttttttttttttggacagaaggtagctcatctatttagattattgcatgataaaccgttacttaacttttctctgccaaagctgcattgcctgatctttgaaatttaagctccccaccccccaaatcatatatagaatgttattgtagattccatgggaaagagacattcagtaaagttgtatgtaactacttcctttcttggcaaaaggtttagttccccatctcctgaattatcttctctatcaggaaccagccatatttacccaaaccatgaacttgggagctatcctaaattgttttctttccattgcaattaaagatgttccctaagccctgtcagttccatccatgagattcgtcccctactccagccctagtgacactgacttgtgtcaatatcccttgcctcttggctcatctacctacttccagctctctacccaaaacaggctttttcatggctttctgtgatttttccaaggtgcaaccctgaatctttcactccctgcctaaagccctattgccttcaggaaaaagtccgactctttaagctggcttatagggccatccatgatctcatccctgcccatccagatttttctccttccaatccctttatacagcttcaagaatatgacaacctctctcccatctcttttcctttgcacaagctgttctctctggatgctcccctcctctgtctccaggcagatttagctgttttctcctttctgctctcacaatactttgtttatatcttggaggtctaacatcacaaggttttgtaaattgttgctaacttgtgtatctccttcactgcactgttaaatctttaaaaaaaaaaaaaaagaaatagtattaccttgctcatcctttcaatctttagcgcctggcacaaagtgggcaattaatacaggtttttgttttaatgaatgaatgaatgagtgaacaaatgagtaatagagaatgtgcgggaaaggatgctgtgtgaggtgtaggggcataccccattggggatgctttgtagtctggaagtagtataagatagtgggcatcatggagaaggcacatataaaataggttttaccattacactaagacaaactccactttgataccaattctgtttaaggagtctcactagaaatggtctggaaatgatgtttgttggttttggtacaaatgatttttttatgaaaaagtaatataatgaagttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggagatagcaagacagtgcgtgagagagagacgctcctagccgggcggtgaacgggagggcggtgcgggcgcgggggcggcggcaggaggtgcgcctctagcactgcccacctcagctggctgccggggagcgagcaggacgcggcgcaggacgaggttcgagtgcaccagggaatctcaggggtaagcgcgcggatttggcagcggagcccaggcggttagcgcggacccaggcgcgccccagaggtattggaaagtgctgggggtggcagcttcgctaggcgcgcaccgcgaacgcagcttgaattgagcgaagcaaagggcgaggagcccccgctggcagccactgatgccagattcggagtgcggggacagccaggtgtcgccgcttctcctaccgcagcgcagggagccgacggcaacctggtgcgagcgcgcccgcagtaacttggcgaccctcacccgcggtggcgctgcaggagagcccctccctcccctctcctgttgcgtgatctgggggcttcagagccccggaatttatgttttaagtgttgtattgagcgactacgggtgcgtagcaagatgcgcggtgcgcacgcggcgcattagattgtctggtttggttaaattcttggagtctgataagagtgagataggcttgtccttgttgttaggtggggaaactgaggctcatagaaagcaaattacttttcgcccgctgggcagagctcgcctctctgccgctccctccccctgctgcagatcagggcattgggatgttttagtcacttattaagtcctatttgtaagtgtatcttttcttttttctctttctgtagctctgcctattgaccgtccgaacaccttggataagtggtttctgattttgagaggacagcagaggggtgagggggctcttgtattttctttagaaaagaaatagaatgctaaccccctgtgtagtgtggccctggctattggagactgggtggcgtccactgtcccaggggacactctcctcagctcccaaaccccacagtgggtgatatcaggaaatggcgcagtagctgtaggtgcttggggcggtcctctcagaccttcctggtggactcaccccacacagatcaacccgaagaaatcgccctctttgtttcaaggtagtcacccccagggaaaatttaaggcagggacctcgagcctcgtcggggtggttgagtggagctgagtcctttcgccaaaccactgcggggtctttttggctagctccccagggaggggcgctgcggttctggagaggtggggttggctgcgggtggttgctgggaggagtgctacagcccctgcttcctcctgatttaagcgctgcgaggctttgacgtttctcattctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgagtgagttaaaccctccaggtttcaggcaggggcctctcctgaggtatgcaggaatgtgaggccggaggatcaaggcctgtgccctcagaggcaggggggagctgaacacaatatgttgaagtggtgtccttggcttgccacaaagggaatgtatcttgtcctgaatgtcatacatacagtactcaggaaggtcctaattgactctctttatttcccattttaagataatctggatttctccacagggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggtaagggagctgcaaatgggtaaatcaaggaaggaagcaaagggaaaggagggatgttctggaaatggggggagaaaagaggccgaggatgaagggcttggataacattcccctgacacccagtggaggtcgcgatgcagtagggggtgaggggagaagagaaatgccatgggaaagggattcagagatgcttagcatcccctggtcttttctttcaggcttaagcgcagtggggatttttacccttgaatactccgtgcagcgagtgcgtcaggtaaattggctatgtttacatgtttgttcctccaataagaaagagcaggaggaggtggggtttccccatagacctgactacctggtggggggaggagcagggtcttctttgtagcccccaggcccaccatattgccagctacctccactgaatactggaacctgttgaaggaatgaccaagatggagctgtggtgggccaggcagacagtccctgtcttctccttttcctagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaagtgagtcttctgacctccctagtagggcaaggaaaggaaatattactggggtctagggggttctagggacagagctcaggctggaggactttgaagaactaaggcaaaatgaccataagaagattttaaaaacctctccagaatatatacaattattatttgtcaattaaaaataaaattttaataaaaaacttatttgggttactttctttgtatttctaaatgttccattataagtctgttgcttggaaatttctctagagcttcttgaagatgtgtgtgccctctcaggtcaaaaaaaaaaaaaaccacccaggttctgtagaggaggtctggtttttatgggggcacttcttgctttcagagttcctgagctcaaatgctttggaaatgagcaaaggcaagatgcctgggtactttctccataactgccagcaagtttcaagcagaatctcacctcccttggtatcagtctgcagccaagactatccccctgagacagcccctgttttccttcttctagctttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtaaaaagatcttggaaagagtagtgaaaactgtagtaggggacatatgtgggagtatatcagcaagagggtggatggagaggagagagagaaacaagaataaaaagagacatattcatttgtacaactcccagtactacctcagcgtcaatcactttctgctttcctttgcctaggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtaggtgcaagttttggatgcacttgttttacacatccatctcctgttcacaaggcaaggcacagttgtacctgcatctttgagggtagccaaaacaggcagccacaagatcgtccagtctagaaattcctcccacattagctggccctggtacctttagtcctaggtacctgaaagagatgagtataaatgaaaaggtgctgtgtaatgatggctaatgttgctaattctaccctcaggtgcctccccatattcagaggcaggttgctaagcgcgtgtggaagtccagcccggaagcacttgattttatcagacgcaggaacttgaggaagatccagtgagtgttttttgggtttgtttatgcttagcctgaagtacctcctcctatggggttttccaactccagactatctttatattaagtaacgcaagtacacaaactgactttttcaaaatccttcccattcaggagtgcacgcataaagatggaagaggatgcactactttctgatccagtggaaacctctgctgaagcccgggctgctgtccttgctcaaagcaagccttctgatgaaggtcagttccctgctggaggtcaggcccttgctgaaggtcagtcccttgttgaaggtcaggccctttttgaaggccaggtcgttgctgaagatgagccccttgaggaagatgagtcctctgaggaagatgaagagctagtatttgaatatcttaatcaaggagtagtctttggggaagctcaaggtctagaaatcccaaataactttgagattcagggcccacatcttgaaggaataccagagcttgatgaggaagatgatgatgatgataatgatactttaaattttgatgatcttcctccccttggagatattctagaaccagataatgaaattccagaactcattgagatcccagactttgaagaaattccatattttgatatggtcccagaccttgaaggagccccagatgtgcaagaaatcctgaaccctggagaaaactcaaaccatgacctagaagaaggagcagattttgaagaccaccaaaatcttaaccttgcagaagctccctatcttgatgtaatcccaaacaatgaaatcccagaccacgcagatgcttcagataatgatgaaatccaagattctgaagaagatcccagtcttgaagatgtcccagctgttgatgaagttccaaatgatgaagcctcaaatactgaagaaatcccagactatgaagccccagaggtaaatgggatttcagactctgaggaagaccttgattttgaagaagtctcagctctttatgtggttccaagccctgaagaagcccctggtggacatgaaatcccaaatcatgaagaatctccagaggttagtggactctcagaccctgaagaagatcccagtcttgaagaggtctcagattttgatggaatcccaaaatgatgaggaagcctcagacactgaagaaattccagaccatgaagaagctccagagaccaatggaattgcaggccctgaagaggtcccagctctccatgtagtcacaggccctgaaaatgtctctgattttgatgaaatgcaagaccatgaagaatcctcagatgtgagtggagtcccaaacaccgaagaagcctcagatattgaagaaattccgggacgtgaagaagcctctgatgttagtggaaaccaagactctgaagaaagccctagtcttgaagaagattcagttctctatgtggctccaaaacctaaggatgcccagatttacaacaaagttcaagattatcagaaagaccaagccagtgcatttgaagaagaagaagttaccactatggctccagaaactgatgatgtctccattctcaatacaattccagaccctccacaagacctggctgtcaatcttgaagaagtcatggatgtggaagaagtcccaatgcctaaagatttaaactctaaagaggttcagaatccaaaggcaattcagtttcataaagatgcagatgttgcattccctgtagataccactctccttaaaaacaagtctcagcctggccaagtcatggactacaagtcctcaccagaggtgttgaagggcaacacctgctttctgtcttccatgcagtgctgtaagctttcagctctagctttgttactcatttgcttggtaaaattagtcaggttacttgtagggtggtggtggttattaggaggtcgccctcttacctgtctccctggtggtattgtccattccctctgagcgcagggtatctgtcttactctttctctttcctaactcagctcttttcccagttcccacagtggtcctagattcagagatctgtgttctgctgtcaggctgtagtattcttatatgtcaaatggggataatcatccctgtcctaccttcttgcctcatactgtatttgaaactcaaaattaggtcttagtgccttgggtgctgcgcaaagtataaagtctagaaacataaggagttaacattgttactatttttcaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagca

SEQ ID NO: 5018 - DNA, 6173 bp, human
ttctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgagtgagttaaaccctccaggtttcaggcaggggcctctcctgaggtatgcaggaatgtgaggccggaggatcaaggcctgtgccctcagaggcaggggggagctgaacacaatatgttgaagtggtgtccttggcttgccacaaagggaatgtatcttgtcctgaatgtcatacatacagtactcaggaaggtcctaattgactctctttatttcccattttaagataatctggatttctccacagggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggtaagggagctgcaaatgggtaaatcaaggaaggaagcaaagggaaaggagggatgttctggaaatggggggagaaaagaggccgaggatgaagggcttggataacattcccctgacacccagtggaggtcgcgatgcagtagggggtgaggggagaagagaaatgccatgggaaagggattcagagatgcttagcatcccctggtcttttctttcaggcttaagcgcagtggggatttttacccttgaatactccgtgcagcgagtgcgtcaggtaaattggctatgtttacatgtttgttcctccaataagaaagagcaggaggaggtggggtttccccatagacctgactacctggtggggggaggagcagggtcttctttgtagcccccaggcccaccatattgccagctacctccactgaatactggaacctgttgaaggaatgaccaagatggagctgtggtgggccaggcagacagtccctgtcttctccttttcctagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaagtgagtcttctgacctccctagtagggcaaggaaaggaaatattactggggtctagggggttctagggacagagctcaggctggaggactttgaagaactaaggcaaaatgaccataagaagattttaaaaacctctccagaatatatacaattattatttgtcaattaaaaataaaattttaataaaaaacttatttgggttactttctttgtatttctaaatgttccattataagtctgttgcttggaaatttctctagagcttcttgaagatgtgtgtgccctctcaggtcaaaaaaaaaaaaaaccacccaggttctgtagaggaggtctggtttttatgggggcacttcttgctttcagagttcctgagctcaaatgctttggaaatgagcaaaggcaagatgcctgggtactttctccataactgccagcaagtttcaagcagaatctcacctcccttggtatcagtctgcagccaagactatccccctgagacagcccctgttttccttcttctagctttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtaaaaagatcttggaaagagtagtgaaaactgtagtaggggacatatgtgggagtatatcagcaagagggtggatggagaggagagagagaaacaagaataaaaagagacatattcatttgtacaactcccagtactacctcagcgtcaatcactttctgctttcctttgcctaggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtaggtgcaagttttggatgcacttgttttacacatccatctcctgttcacaaggcaaggcacagttgtacctgcatctttgagggtagccaaaacaggcagccacaagatcgtccagtctagaaattcctcccacattagctggccctggtacctttagtcctaggtacctgaaagagatgagtataaatgaaaaggtgctgtgtaatgatggctaatgttgctaattctaccctcaggtgcctccccatattcagaggcaggttgctaagcgcgtgtggaagtccagcccggaagcacttgattttatcagacgcaggaacttgaggaagatccagtgagtgttttttgggtttgtttatgcttagcctgaagtacctcctcctatggggttttccaactccagactatctttatattaagtaacgcaagtacacaaactgactttttcaaaatccttcccattcaggagtgcacgcataaagatggaagaggatgcactactttctgatccagtggaaacctctgctgaagcccgggctgctgtccttgctcaaagcaagccttctgatgaaggtcagttccctgctggaggtcaggcccttgctgaaggtcagtcccttgttgaaggtcaggccctttttgaaggccaggtcgttgctgaagatgagccccttgaggaagatgagtcctctgaggaagatgaagagctagtatttgaatatcttaatcaaggagtagtctttggggaagctcaaggtctagaaatcccaaataactttgagattcagggcccacatcttgaaggaataccagagcttgatgaggaagatgatgatgatgataatgatactttaaattttgatgatcttcctccccttggagatattctagaaccagataatgaaattccagaactcattgagatcccagactttgaagaaattccatattttgatatggtcccagaccttgaaggagccccagatgtgcaagaaatcctgaaccctggagaaaactcaaaccatgacctagaagaaggagcagattttgaagaccaccaaaatcttaaccttgcagaagctccctatcttgatgtaatcccaaacaatgaaatcccagaccacgcagatgcttcagataatgatgaaatccaagattctgaagaagatcccagtcttgaagatgtcccagctgttgatgaagttccaaatgatgaagcctcaaatactgaagaaatcccagactatgaagccccagaggtaaatgggatttcagactctgaggaagaccttgattttgaagaagtctcagctctttatgtggttccaagccctgaagaagcccctggtggacatgaaatcccaaatcatgaagaatctccagaggttagtggactctcagaccctgaagaagatcccagtcttgaagaggtctcagattttgatggaatcccaaaatgatgaggaagcctcagacactgaagaaattccagaccatgaagaagctccagagaccaatggaattgcaggccctgaagaggtcccagctctccatgtagtcacaggccctgaaaatgtctctgattttgatgaaatgcaagaccatgaagaatcctcagatgtgagtggagtcccaaacaccgaagaagcctcagatattgaagaaattccgggacgtgaagaagcctctgatgttagtggaaaccaagactctgaagaaagccctagtcttgaagaagattcagttctctatgtggctccaaaacctaaggatgcccagatttacaacaaagttcaagattatcagaaagaccaagccagtgcatttgaagaagaagaagttaccactatggctccagaaactgatgatgtctccattctcaatacaattccagaccctccacaagacctggctgtcaatcttgaagaagtcatggatgtggaagaagtcccaatgcctaaagatttaaactctaaagaggttcagaatccaaaggcaattcagtttcataaagatgcagatgttgcattccctgtagataccactctccttaaaaacaagtctcagcctggccaagtcatggactacaagtcctcaccagaggtgttgaagggcaacacctgctttctgtcttccatgcagtgctgtaagctttcagctctagctttgttactcatttgcttggtaaaattagtcaggttacttgtagggtggtggtggttattaggaggtcgccctcttacctgtctccctggtggtattgtccattccctctgagcgcagggtatctgtcttactctttctctttcctaactcagctcttttcccagttcccacagtggtcctagattcagagatctgtgttctgctgtcaggctgtagtattcttatatgtcaaatggggataatcatccctgtcctaccttcttgcctcatactgtatttgaaactcaaaattaggtcttagtgccttgggtgctgcgcaaagtataaagtctagaaacataaggagttaacattgttactatttttcaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttagatgtttttccttctataaggtgccagacaggggaaaagggtgggggtacatctgggatgtcacaggaaacattaaggagagagttgaaggtaaagatctgaaggtaagaaggagttccacctgatgctcgggtcaggatgagaattccaaacacactgccagccccttcactggggatgcttggtctcttctgctggtaaaagcagagatgtttctgtgtcatgcccaagctccccggtgctaccttgcctttctcttttacccctgatcttggctttctctctctctctgcagactttcctttaattgatgtgacatttgtggtaaacacctttcccagggaacctcacaaatcttgagatgctttcccttccccagatgggattgcatgatttccctgactttcctaccctcctccagagagctcagttggaaaggccctcaagaggcatgctagaacgttaggtcagcctactgacagctgacaaacaattaatgcgaaatcatgtcacaccaacccatagccgtgtccacgcagcaactccaccaccttaggatttccccctccaaattattcagaccaatggcttgccaaatggcctctcccaaaattctgtacagttttgctcaggtcacgccaacagggaaacctcaagtgtaggtctaattagtgtttctgggatccaaagttagaggaaaatttagattttattgcctggatctgctttaaagacaattggtgtttacaccctcttgtcagcaaaacagctagttaggtaaggacatatagttccaagtaggtaaagtcacttgattacaaatgttcttaactatcgtctctgtaattcctttatacaggacagtacaaaattgtgggacatgctctggtaacacacagatatgggttgcatatgatccagaattacagctgatattatggatgacaactgctaaggtccataaaatgaagactgtattgtattgagggatagaaattgatcatttaatgggtaacaactgctgagctcaaagatttgtgattgttaaaacttctctggcatttaatcattaataaacatctgtattgtgacagcagca

SEQ ID NO: 5019 - DNA, 31526 bp, human; identical to SEQ ID NO: 3703

SEQ ID NO: 5020 - DNA, 31637 bp, human; identical to SEQ ID NO: 3704

SEQ ID NO: 5021 - DNA, 1538 bp, human
gagaatcagcagaaccccaagaaaaattctacctttttactagcctccattgcctgccctgatcacactgaggactcatctggaggtagtgaggggtggggttgaagggtccctgtgtgagaagtccatctgcaaagtggatttaccttactttttaaatgcacttacttaaaagcaaagaagcctccgagaaccaatatttgctatatttgctttctctctttcttgttcttaatttggttttgtgttgtattttgttttttgtttttgtttttgttttttgccttctagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacaggttaggaggggggactccaggtagaggtggtgccaaccctgggatggtgggtggaaggctgtcagtgggagaggaagaaatgtttcttctaaaacacactgagaacgtgcttaggacagcggctggcccatagtgaccagtccatgatgcacagctgctcatgttattattacaggaacaagaaacaaaggcagtggggaggcaagcaattcacttctggggaaataaatgaggtagatgggggtgtctaatcccaagagctcggttcaacttgccctatttctgcacatttttatggcttggcattgagctttaggctcaatgtccactttttctctagctgggctgtcagagaccggtgggctggatggctctcagagaaagggagaagaccttgaaatgtcagctgcatactacacaactacacaactgtgcataagtggagtcccaattatgtaaacagttatagctacatggacatgggaatatatggaaagaataaatggcaattaaatattaaaaatatttatctttgagtggtagaattgtgtttccttcattagtttttttttctatattttctaatttttaacaacaaacatatattgtgtcttacaataacactttaaaaggctatttgcaggatgtgagggctgggtttatctcatgctgtggtctctttaatttcagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccc

SEQ ID NO: 5022 - DNA, 15772 bp, human
cagtttgctgcatctggaggagctcactggagaatctccaacatcggagcgggccttcaactaccgtaagtacctacaaatgagcgcatagttcagtggctgaatattaaatactggccaccggatcctaaacaaaaccccgaaagagtctccttgctgtaattaattgccgtaaatcaaactgctccccagtctgtccccccacccgcttcattcctgcctttctcctttccttcccggatcccagacctgcctcggtgagaatctctgggcactgtagatatctccccttttccttctcagtcttccctccaaaccctcagctgagcatgtacccggcaccccgccgagcccaacccctttgattcctggagccctcaaagctatgcagggggcgagccattagacatttcagatatgtcaccctcaaaagcactgcggcgctgcctaagggtggggaaagtgcttggggtggagtaggagggaagggtaaaacggctaggcagccaaagttgggggtgggggtggggtgaaaggccaaaatgggcgtggccaactaacccaaggcttggggctgttctcatgttcccccggtataagattcatcatctgggctgaatataaatggtacaatttccttagtgattgaggaggggtcagccatgccaaaaagcccagcttccctgactcccctcaatcccccagtaggcaaagatcctggtttaggggtccaagtggcaaggctgaaacctcagatggcatttcctgggtgtaatcccaggttgaacctctcccttggcagtggaacctggcttcccccaaaaactcctggcccaaagccccagggtaacaaagcaacagggtagcatccaagctttggcctggccctgagaggagtgggagcaagggactgtaggaactgagatggaaagggcatctttagggccctacaccagttggatgccccctttgaaaagaagaaaaaataagcatctttttaaaatgtaatgttcactatgtgcctggcactgtacatgtattatctctaacccaacacaacaataatgttaggtcgatattactcctccactttacagataaggaaaattcagagtgggtaatctgaaaatcctttgatacaaagtgaaaaatgtacaatggacctatgcttccttggatttctcactgtccacttgttccctacagtccagatattttgaacacgaaatatcctcctcttcctgctcctccatcctacccagtgttagcactggggcaagtttgaggctgaggtccaaggtcagtctggaaaagcaaaatcagttcctttctctattctgggagctgcctcttccccactcttctgagctaagatttaataacagctggagtcagccaggacttcagactcccagtagaaagttggtggaagagaattagcttgagtttgcgtggctgggacataccttcccttggtgaaaggttactgtggggggaggtggagagaggcatgaaagctcaagagtctaccttgtgtatatgcaaggcctatggtaaataatgactttggtcagggagaatggaaagcctccctgaactcaaatatctttgccgtatttcctgagattcaaacaattccatttcccttagaggcaatcaacaaaactgtttagaagttaagggcaacgaaagaatcatttagaccttatgtaaattaactcaagcagcttgattttctaacacatgcttgacactggggtattgagcttttaggggtaggagacaagaatgagagtaatattggatctaaagcattctatggaagggaaggatatccaagggatcaagtgagaggggtaagggagggtgaagagggagtgaagggtacctctgggagtttaaatcattgttttagatccataggccttggagttaaacatggattctaatttgggctctaatatttaatatcttttgactttgggcaaattatataacctctctaagcctcagtttgttcatcagtaaaatggggatggtagtaatgccccctctcttaagttgttggaggactctctctctctctctatatatatatatacacacacacacacatatatacgtatatatatacacacatatatacgtatatatacacacatatatatacatgtatatacacatatatatacgtatataaacatacgtatatatatatatatgcatatctgaaaaggtgactctgcacctcccatctcccccatcctgtggagcttctgcaggctattctgggcttctgagatcccagagacaaatccatatttcaacaaatctgacatctttgataccaacaaagaccttgagcaggatagggaagtgagggaaaggagcaaggagaggaagcagcaggtgaccttgtaataccctgcatgcctgtgaggaagtacaatgtagggttgtcaagtgcaatttagccatctaaactaaactttaaggagcaggacaagtcctctgagtaaaaacaattctgcttttagatcccaccacctgctgaggagaaaaattcttcaagactcagagcacacagccagcaccagaggccccatgaccctggacagaccaggggagggggccaccatgctgaagacattcactgttttgctcttttgcattcgtgagtacaaggaaggggtgaggggcaagtgaccctgtcataggtacccactcattaggggtgggagaggaaagtattgaggtttgagcacaggatggagacaacaagggagctctcctttaccataatctctcttttcagggatgagtctgggtatgacatcaataggtaagtgagtcctgccctctcaggcacctccttcctaaaggatccaagatgctggcgtgtctccatgaccttggacataatgccttgagattccagagatagattgggctgattgggaatcagaggacttggtttcctatggcatggtgaaaaagctttatctcagatggaaaagagaccatcagactttattctccaattcatttggaccccttgacaaaatatcttggggttcttatacgatgccccacaggagcacactcctgtccccaagggaagacaaaatgagggatctgggtccgggctaattttaagggacattgtgggacatgttatgggagggagagggttggactgctcatatctttttgatctttgggaataacagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggtaagatgacagtgatactcaagaatcaactccagctcctgagattcaaacttgccttccaggggagagtttgtttcacaaatgcatgcaagcatgcatcccacagttagtaaataagggcctactttgtattgggcaatgcagaggggggatgcagactctggagcagagataggagaaggaggggtggcaaacaaggatcatacagggaaacctcaattaaagtagagctctcctctgctgctccctagacagtactatccttgctttacctaattccagttcattctatccttccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatattaattttgttagtatagctttttattgaggatcaaagaacaaaaactgcctgtttgaactgagtgtatgaatgtttgttgtactcatgccctttcagcatagattccactaaaatacacttccgtagttacctgttcaccaatatcccccaccaaccagttcatgagctttttgctagcggagactgtgtcttctttactcatacacacctagacctacatgacgcttgatgcatactaaatgctcagtgagcatatgacagagctgatccttccttaatgaatagataagtgtgcctggcattggggtgggggtaggaaggagtggtaggaggtgaggtttgccctcactttcatgtaaaatctccttggagaaacaattcatggaaaggaatgtgtggccccataacaaagatttatttgggtcgcagacttactggccaaaccctctttattggcttctttcagtcttgttgtagaagtagggtcttaaatgagcttaatgtattcaaaagctctccttaatatttcagtggcattcatgctctgcaaagatgaaaacaatgttattttcagaggtttggtttttctggtggttgaaagaactacatttggcatttcaggggcctaaagatacagggaattatagatgtagatcttccactgagatacacccctacacatggttagagctcagtgaagctggcagattcttgagagagaacaggggcataagtgaatctacccttgattatgttacagaggcagagatccaaggaagggatagggaagagaaggtaaacttcagctaccacttcttgttcaaagaaattaagaaagagaaaacagaagacaacaggaaagaatcatcttgcctctaactttagggtctcttccgtttgtaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactggtaagagacgggtatgccatgaaacttaggttaacggctaaggatataaatctccctctgtgctccctggagaacctaatcctgtggccagggttaacagtagagaagggagcagaatttgtaaaactgggtgtaggcaggtttttccaagggtggtttggaggaagagaaggaaaagaatcttaaggagtgggagcaggaagtgaaatcactagtgctttttattctgggtctcatcctagacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtaggcaagtgttaacaactgtttttattatcaacctgtttgtttttatcatcattgtggtgttgtaagaaggagctagtagcctcatatcctctgagagctatgagcaaaacacacacacacatacacacacacacgcactaggaaggtggtgtagaactttcttccaaaactttagggaccttgtctcccaggattgttcctcaagctccacctctcagtatggcacagccccattgtaacccctgggaaaattatttttctttaggccagaggaagcttacaggtatgaggtcttcctgattgaaggtaaggaaccaggaatctttagatcaccaaggggtgggcaaaggaattctaatgcacagtcaaatcttgaagccactggccaagtggaagtggaaaggaagagaagatcaaatggggagctcagaaacattttctgggggagagggtactgggtttgaggtcacttctcactctggtctctggattggtttcagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggtgagaggataactcttcagaggaatgcccctccataccccagggatcccagatcagtgcccagaaagatatgggaaagggagtcagaggcctgaaaatcagagcccttgggtttcagcacccttcccctggggtggtctcacaattcctcaaaggcagttagcaggataatttcaaggctcccattctccatgaaaaagaaggccacttctgcctcaccttctcaatataagcactgtcagtaaccagattgtcctcaccccatgaatgtattcacctgcccctgtccccatcaaggcctctgattctggtcttctctggccacaggctatctcacctggaattacgttctgaatgaagctatcaggttgtctctaatcatgcagcttgttgccttgctgttggtagtgctgtggataaggtggaagtgtcggagactcagaatcaggtaactgtcttgtcccagccccctgttccccaacctaacagagtctgaagaatgagtcatgccctagttgagacaagccacagaggcaaaccctatagaacccctatcttctgggcttagggaacaagactttctcaccccacctgtctctttcgcctcacagaggggtcagcactcaagccagcgggtggagaaatgcatagttctcagaggcaagaggagtaatcagaactgcattcactgacatcccccccggagggtgcccaaatctcgcccacaaaccatcctgccctcagagatgattgatgtctccctcattaacttgttctggatttttcctcttgtaagaagccatgctgtcctgtctcccagactgttatccaactcctatcccaacttttcacccttatccctagctctcaggagctattaagccttgtgacgcatcctagttgccttagtaaccagtctctgacactgtggcctccaaccacctgtgcagagcattctgggaatatagacttgacctggatggccatctgatgtgatattggacggggcaacagaatcagactgtttcctctgactcacaaactcacaggccaaacagattctcctgccatttcctttgattctgtggtgtgctctgggccatctgcctctctcatccccatggcttgtgctcaggctactctactgggaacaaggagagaaatgaccacttctgacccagtagggatgttagctcctgaataccttgtctacttccccctactccctgcttctggctgtaccccccgccctgcaactgtggtcagtgtgtctggaagtattcaatgcacaatggattatgattatgattacatgtgtctgtgttttccactggaatctgagggacagaatacttgggcaatcagaagggagccacctaagccttctgcaaaaaccaccaccctttgagttttcaaaaagtttcagcaggggtcaagttctacttctttccggaacctgacctgggtcccgtactcattagagtaatctccaagccagtggttagaaaaaaaaaaaaatgtagctttatgtgccccaccccagcccagcaacactgcatcaaagaataagatcaggaaccagatttcagagaaagcagcttgaaaatcatgttttcctcaccaggaaggatggtcagtgttttctaagtaaaaattgtccgatggattttgggttaatatcatctaatactacaagactcatgacccaaagctgctgcacatttctagttataatctgggtgaggggagagtttctactctctgaaaagcttggctcggcactgccaatcttctagtaattcatcacagctgcctaggcaacccttccataacaaaggcaggtgaggcaggtgggtctgaggaccaatactgccacaacaactgcttccgaacttaaacttgatgactgagaaatactcacagtttctccctccacccccacacacaccacccagagctgccgatcacaatgagctccaggggttctgagagctccaaataatataaaagcattttcccatctgacatctcaattccagcaacaacctaatcaggggccatggggagctgacatatgatataggctgcggagtggggagggggcgggggggacacgtgggtcatgaaagagcaagaggtttgtaggtggtaaggccctcaaaaagaaaagtcattgatgtcaaataagattatatcccattatcttggccatatccagtccccattgggtagcgagtaagccaatgacataaattgccgccccctttcctccaccctccccctcatcccagcaactcctctcatctcttttctggtctcactagagaagcctggttgctgggaacagctcaaggggtcaccatgctcttcatagtcacggcccttctctgctgtggtgagtacaagtgggggaaggggccccgggcagaaggccggggtgaagtcccggtgggggagggggccgagtcctggcagcaatttcttttgcaggactgtgcaatggggtattgatagaagagactggtgagtttttcctgctccagactgggacattcctccctggagatccgaaataactacagagcgtcagtgtcattggccagggagtggctggttgggagggaagggcagccaggaaggggcacttgctaaagctgctggcaaaattcagcctccaactttgcctttctgcctgcaaaatttcctccaagcttctgcacttttctgaggctcagctataagacaccagcttcccctttccccagcacctgaggaaggaaggaaagaaggaaagggtttggatttgggttgcaaggggaggtgggcagtgtgatctgggtagagggttcaagggcaaggaggagggaggggaagggaggcgggaggatggcttcattaattctgctgtttctagaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacaggtaagaaaatgtagagggtctccgggagttatccccagtgcccctgggactccaacactgctcctgggagtgagggaatgaactcacagggaccctggagcccaaggggctcgtgctgcatgtaggagaggaggggcactgaaatggtagggggttatggggtagggggaggggcggaatgggaaagagagtgtgaggagactgactggaagagcctagggccagcccagaatgaatgtctttatttgctgacaaagtgaccctgagtatcccatctgggcaactgcaaacttctgactcctttttcaccccattctgttttccagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaaggtagagctgaaaagggtgtgggaggaaagggggcagggtggagggaaaggcaaagccctgggtcagacactcctctccctgcagcaaactttgctgctggtcctgagagcctgtgtccaatcttagagccaggcaggcgtggcgctgggagtgccagggcctctggctgcacgatattaatagccataatcgttattaatagctttggttcgtggagggtgatttaatttttctaattattttcacatcaattatctcacttcaccatagagcaactcttcaaggtgggtgaagcaggtaccattttccccttgtccaaatgggcaaactgaggctcagagaatcagcagaaccccaagaaaaattctacctttttactagcctccattgcctgccctgatcacactgaggactcatctggaggtagtgaggggtggggttgaagggtccctgtgtgagaagtccatctgcaaagtggatttaccttactttttaaatgcacttacttaaaagcaaagaagcctccgagaaccaatatttgctatatttgctttctctctttcttgttcttaatttggttttgtgttgtattttgttttttgtttttgtttttgttttttgccttctagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacaggttaggaggggggactccaggtagaggtggtgccaaccctgggatggtgggtggaaggctgtcagtgggagaggaagaaatgtttcttctaaaacacactgagaacgtgcttaggacagcggctggcccatagtgaccagtccatgatgcacagctgctcatgttattattacaggaacaagaaacaaaggcagtggggaggcaagcaattcacttctggggaaataaatgaggtagatgggggtgtctaatcccaagagctcggttcaacttgccctatttctgcacatttttatggcttggcattgagctttaggctcaatgtccactttttctctagctgggctgtcagagaccggtgggctggatggctctcagagaaagggagaagaccttgaaatgtcagctgcatactacacaactacacaactgtgcataagtggagtcccaattatgtaaacagttatagctacatggacatgggaatatatggaaagaataaatggcaattaaatattaaaaatatttatctttgagtggtagaattgtgtttccttcattagtttttttttctatattttctaatttttaacaacaaacatatattgtgtcttacaataacactttaaaaggctatttgcaggatgtgagggctgggtttatctcatgctgtggtctctttaatttcagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactggtaaggaccgaccggacatgggactgggatggagatcattggagaaggggttagggagagtaattcctcctggaaggctaggctaggccacggaggggaactaccgtgcccaagaggagaaagatagagtgttaatttaagcaggaactcataagtttctatagtcaccactttacaaccttggtctctttctagacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggtaaggggaagaggctgtcgagtgggcatggaagtgtagaaaggagggaatagactagttcatgggagatagttttcagagagctcgaggagaggcaaccaattgcctttcctctttattgagcagagaccccaggggtgatgcactggaaagtgacctcttctctttgaccaggagttcatttcttccaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactggtaaggtcctggagacttcagtacaagtcacgattttgtagtttttagcagtaagcaataagggggtaaaaggctaagttcaggatcatttcttttaactctgtgtccttgttggttgcagataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcaggtaagagaataatctctccatggtcctggtgtgacacacctgggatcccagggacagtccccatggagacatcccaaatcaggagaatggaggagctttggagccagggacctgaagtgtgtcatctttctcctaaggatgatgaggaggtgggaccttaaatatatttgaagatagtgagtgggtttcttttcaggcctcttttccccaaggaaaggagggctgcttctgcttcagcataaactctgccactgcccaccccctctgtagtctgaacagatggctcccacgtgaaccctaaagaaggccagagtgtggggcaataccagatcaaggggaacatacacacgctaatctccatggcctcggtttctcctctttcatcaccacagggcctgttgctcaggagtgcactgtagggaacattgtccgaagtagcctaatcgtggtggttgttgtagccttgggggtagtgctagccatagagtggaagaagtggcctcgactgcgaaccaggtaaataaatgcctcattatggcccccttctgtgaaccaggtggtgctagaaaaacaatcatacaaatgctcccctagtatctgagccccaccgtgcaatctgttttcagtttctgggtcctcccttactcatgtctttttctttacatagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaaaa

SEQ ID NO: 5023 - DNA, 15918 bp, human
aggtgccaggcagagttggtgtaggtgggctccccgagcccggcgcagggaggggaggaggttggggcgggccggcaggcgggcgggggagagaggaaggcggggctcagagccgaagaggctgtccttagacagctcttctcatgccgggcagtttgctgcatctggaggagctcactggagaatctccaacatcggagcgggccttcaactaccgtaagtacctacaaatgagcgcatagttcagtggctgaatattaaatactggccaccggatcctaaacaaaaccccgaaagagtctccttgctgtaattaattgccgtaaatcaaactgctccccagtctgtccccccacccgcttcattcctgcctttctcctttccttcccggatcccagacctgcctcggtgagaatctctgggcactgtagatatctccccttttccttctcagtcttccctccaaaccctcagctgagcatgtacccggcaccccgccgagcccaacccctttgattcctggagccctcaaagctatgcagggggcgagccattagacatttcagatatgtcaccctcaaaagcactgcggcgctgcctaagggtggggaaagtgcttggggtggagtaggagggaagggtaaaacggctaggcagccaaagttgggggtgggggtggggtgaaaggccaaaatgggcgtggccaactaacccaaggcttggggctgttctcatgttcccccggtataagattcatcatctgggctgaatataaatggtacaatttccttagtgattgaggaggggtcagccatgccaaaaagcccagcttccctgactcccctcaatcccccagtaggcaaagatcctggtttaggggtccaagtggcaaggctgaaacctcagatggcatttcctgggtgtaatcccaggttgaacctctcccttggcagtggaacctggcttcccccaaaaactcctggcccaaagccccagggtaacaaagcaacagggtagcatccaagctttggcctggccctgagaggagtgggagcaagggactgtaggaactgagatggaaagggcatctttagggccctacaccagttggatgccccctttgaaaagaagaaaaaataagcatctttttaaaatgtaatgttcactatgtgcctggcactgtacatgtattatctctaacccaacacaacaataatgttaggtcgatattactcctccactttacagataaggaaaattcagagtgggtaatctgaaaatcctttgatacaaagtgaaaaatgtacaatggacctatgcttccttggatttctcactgtccacttgttccctacagtccagatattttgaacacgaaatatcctcctcttcctgctcctccatcctacccagtgttagcactggggcaagtttgaggctgaggtccaaggtcagtctggaaaagcaaaatcagttcctttctctattctgggagctgcctcttccccactcttctgagctaagatttaataacagctggagtcagccaggacttcagactcccagtagaaagttggtggaagagaattagcttgagtttgcgtggctgggacataccttcccttggtgaaaggttactgtggggggaggtggagagaggcatgaaagctcaagagtctaccttgtgtatatgcaaggcctatggtaaataatgactttggtcagggagaatggaaagcctccctgaactcaaatatctttgccgtatttcctgagattcaaacaattccatttcccttagaggcaatcaacaaaactgtttagaagttaagggcaacgaaagaatcatttagaccttatgtaaattaactcaagcagcttgattttctaacacatgcttgacactggggtattgagcttttaggggtaggagacaagaatgagagtaatattggatctaaagcattctatggaagggaaggatatccaagggatcaagtgagaggggtaagggagggtgaagagggagtgaagggtacctctgggagtttaaatcattgttttagatccataggccttggagttaaacatggattctaatttgggctctaatatttaatatcttttgactttgggcaaattatataacctctctaagcctcagtttgttcatcagtaaaatggggatggtagtaatgccccctctcttaagttgttggaggactctctctctctctctatatatatatatacacacacacacacatatatacgtatatatatacacacatatatacgtatatatacacacatatatatacatgtatatacacatatatatacgtatataaacatacgtatatatatatatatgcatatctgaaaaggtgactctgcacctcccatctcccccatcctgtggagcttctgcaggctattctgggcttctgagatcccagagacaaatccatatttcaacaaatctgacatctttgataccaacaaagaccttgagcaggatagggaagtgagggaaaggagcaaggagaggaagcagcaggtgaccttgtaataccctgcatgcctgtgaggaagtacaatgtagggttgtcaagtgcaatttagccatctaaactaaactttaaggagcaggacaagtcctctgagtaaaaacaattctgcttttagatcccaccacctgctgaggagaaaaattcttcaagactcagagcacacagccagcaccagaggccccatgaccctggacagaccaggggagggggccaccatgctgaagacattcactgttttgctcttttgcattcgtgagtacaaggaaggggtgaggggcaagtgaccctgtcataggtacccactcattaggggtgggagaggaaagtattgaggtttgagcacaggatggagacaacaagggagctctcctttaccataatctctcttttcagggatgagtctgggtatgacatcaataggtaagtgagtcctgccctctcaggcacctccttcctaaaggatccaagatgctggcgtgtctccatgaccttggacataatgccttgagattccagagatagattgggctgattgggaatcagaggacttggtttcctatggcatggtgaaaaagctttatctcagatggaaaagagaccatcagactttattctccaattcatttggaccccttgacaaaatatcttggggttcttatacgatgccccacaggagcacactcctgtccccaagggaagacaaaatgagggatctgggtccgggctaattttaagggacattgtgggacatgttatgggagggagagggttggactgctcatatctttttgatctttgggaataacagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggtaagatgacagtgatactcaagaatcaactccagctcctgagattcaaacttgccttccaggggagagtttgtttcacaaatgcatgcaagcatgcatcccacagttagtaaataagggcctactttgtattgggcaatgcagaggggggatgcagactctggagcagagataggagaaggaggggtggcaaacaaggatcatacagggaaacctcaattaaagtagagctctcctctgctgctccctagacagtactatccttgctttacctaattccagttcattctatccttccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatattaattttgttagtatagctttttattgaggatcaaagaacaaaaactgcctgtttgaactgagtgtatgaatgtttgttgtactcatgccctttcagcatagattccactaaaatacacttccgtagttacctgttcaccaatatcccccaccaaccagttcatgagctttttgctagcggagactgtgtcttctttactcatacacacctagacctacatgacgcttgatgcatactaaatgctcagtgagcatatgacagagctgatccttccttaatgaatagataagtgtgcctggcattggggtgggggtaggaaggagtggtaggaggtgaggtttgccctcactttcatgtaaaatctccttggagaaacaattcatggaaaggaatgtgtggccccataacaaagatttatttgggtcgcagacttactggccaaaccctctttattggcttctttcagtcttgttgtagaagtagggtcttaaatgagcttaatgtattcaaaagctctccttaatatttcagtggcattcatgctctgcaaagatgaaaacaatgttattttcagaggtttggtttttctggtggttgaaagaactacatttggcatttcaggggcctaaagatacagggaattatagatgtagatcttccactgagatacacccctacacatggttagagctcagtgaagctggcagattcttgagagagaacaggggcataagtgaatctacccttgattatgttacagaggcagagatccaaggaagggatagggaagagaaggtaaacttcagctaccacttcttgttcaaagaaattaagaaagagaaaacagaagacaacaggaaagaatcatcttgcctctaactttagggtctcttccgtttgtaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactggtaagagacgggtatgccatgaaacttaggttaacggctaaggatataaatctccctctgtgctccctggagaacctaatcctgtggccagggttaacagtagagaagggagcagaatttgtaaaactgggtgtaggcaggtttttccaagggtggtttggaggaagagaaggaaaagaatcttaaggagtgggagcaggaagtgaaatcactagtgctttttattctgggtctcatcctagacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtaggcaagtgttaacaactgtttttattatcaacctgtttgtttttatcatcattgtggtgttgtaagaaggagctagtagcctcatatcctctgagagctatgagcaaaacacacacacacatacacacacacacgcactaggaaggtggtgtagaactttcttccaaaactttagggaccttgtctcccaggattgttcctcaagctccacctctcagtatggcacagccccattgtaacccctgggaaaattatttttctttaggccagaggaagcttacaggtatgaggtcttcctgattgaaggtaaggaaccaggaatctttagatcaccaaggggtgggcaaaggaattctaatgcacagtcaaatcttgaagccactggccaagtggaagtggaaaggaagagaagatcaaatggggagctcagaaacattttctgggggagagggtactgggtttgaggtcacttctcactctggtctctggattggtttcagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggtgagaggataactcttcagaggaatgcccctccataccccagggatcccagatcagtgcccagaaagatatgggaaagggagtcagaggcctgaaaatcagagcccttgggtttcagcacccttcccctggggtggtctcacaattcctcaaaggcagttagcaggataatttcaaggctcccattctccatgaaaaagaaggccacttctgcctcaccttctcaatataagcactgtcagtaaccagattgtcctcaccccatgaatgtattcacctgcccctgtccccatcaaggcctctgattctggtcttctctggccacaggctatctcacctggaattacgttctgaatgaagctatcaggttgtctctaatcatgcagcttgttgccttgctgttggtagtgctgtggataaggtggaagtgtcggagactcagaatcaggtaactgtcttgtcccagccccctgttccccaacctaacagagtctgaagaatgagtcatgccctagttgagacaagccacagaggcaaaccctatagaacccctatcttctgggcttagggaacaagactttctcaccccacctgtctctttcgcctcacagaggggtcagcactcaagccagcgggtggagaaatgcatagttctcagaggcaagaggagtaatcagaactgcattcactgacatcccccccggagggtgcccaaatctcgcccacaaaccatcctgccctcagagatgattgatgtctccctcattaacttgttctggatttttcctcttgtaagaagccatgctgtcctgtctcccagactgttatccaactcctatcccaacttttcacccttatccctagctctcaggagctattaagccttgtgacgcatcctagttgccttagtaaccagtctctgacactgtggcctccaaccacctgtgcagagcattctgggaatatagacttgacctggatggccatctgatgtgatattggacggggcaacagaatcagactgtttcctctgactcacaaactcacaggccaaacagattctcctgccatttcctttgattctgtggtgtgctctgggccatctgcctctctcatccccatggcttgtgctcaggctactctactgggaacaaggagagaaatgaccacttctgacccagtagggatgttagctcctgaataccttgtctacttccccctactccctgcttctggctgtaccccccgccctgcaactgtggtcagtgtgtctggaagtattcaatgcacaatggattatgattatgattacatgtgtctgtgttttccactggaatctgagggacagaatacttgggcaatcagaagggagccacctaagccttctgcaaaaaccaccaccctttgagttttcaaaaagtttcagcaggggtcaagttctacttctttccggaacctgacctgggtcccgtactcattagagtaatctccaagccagtggttagaaaaaaaaaaaaatgtagctttatgtgccccaccccagcccagcaacactgcatcaaagaataagatcaggaaccagatttcagagaaagcagcttgaaaatcatgttttcctcaccaggaaggatggtcagtgttttctaagtaaaaattgtccgatggattttgggttaatatcatctaatactacaagactcatgacccaaagctgctgcacatttctagttataatctgggtgaggggagagtttctactctctgaaaagcttggctcggcactgccaatcttctagtaattcatcacagctgcctaggcaacccttccataacaaaggcaggtgaggcaggtgggtctgaggaccaatactgccacaacaactgcttccgaacttaaacttgatgactgagaaatactcacagtttctccctccacccccacacacaccacccagagctgccgatcacaatgagctccaggggttctgagagctccaaataatataaaagcattttcccatctgacatctcaattccagcaacaacctaatcaggggccatggggagctgacatatgatataggctgcggagtggggagggggcgggggggacacgtgggtcatgaaagagcaagaggtttgtaggtggtaaggccctcaaaaagaaaagtcattgatgtcaaataagattatatcccattatcttggccatatccagtccccattgggtagcgagtaagccaatgacataaattgccgccccctttcctccaccctccccctcatcccagcaactcctctcatctcttttctggtctcactagagaagcctggttgctgggaacagctcaaggggtcaccatgctcttcatagtcacggcccttctctgctgtggtgagtacaagtgggggaaggggccccgggcagaaggccggggtgaagtcccggtgggggagggggccgagtcctggcagcaatttcttttgcaggactgtgcaatggggtattgatagaagagactggtgagtttttcctgctccagactgggacattcctccctggagatccgaaataactacagagcgtcagtgtcattggccagggagtggctggttgggagggaagggcagccaggaaggggcacttgctaaagctgctggcaaaattcagcctccaactttgcctttctgcctgcaaaatttcctccaagcttctgcacttttctgaggctcagctataagacaccagcttcccctttccccagcacctgaggaaggaaggaaagaaggaaagggtttggatttgggttgcaaggggaggtgggcagtgtgatctgggtagagggttcaagggcaaggaggagggaggggaagggaggcgggaggatggcttcattaattctgctgtttctagaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacaggtaagaaaatgtagagggtctccgggagttatccccagtgcccctgggactccaacactgctcctgggagtgagggaatgaactcacagggaccctggagcccaaggggctcgtgctgcatgtaggagaggaggggcactgaaatggtagggggttatggggtagggggaggggcggaatgggaaagagagtgtgaggagactgactggaagagcctagggccagcccagaatgaatgtctttatttgctgacaaagtgaccctgagtatcccatctgggcaactgcaaacttctgactcctttttcaccccattctgttttccagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaaggtagagctgaaaagggtgtgggaggaaagggggcagggtggagggaaaggcaaagccctgggtcagacactcctctccctgcagcaaactttgctgctggtcctgagagcctgtgtccaatcttagagccaggcaggcgtggcgctgggagtgccagggcctctggctgcacgatattaatagccataatcgttattaatagctttggttcgtggagggtgatttaatttttctaattattttcacatcaattatctcacttcaccatagagcaactcttcaaggtgggtgaagcaggtaccattttccccttgtccaaatgggcaaactgaggctcagagaatcagcagaaccccaagaaaaattctacctttttactagcctccattgcctgccctgatcacactgaggactcatctggaggtagtgaggggtggggttgaagggtccctgtgtgagaagtccatctgcaaagtggatttaccttactttttaaatgcacttacttaaaagcaaagaagcctccgagaaccaatatttgctatatttgctttctctctttcttgttcttaatttggttttgtgttgtattttgttttttgtttttgtttttgttttttgccttctagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacaggttaggaggggggactccaggtagaggtggtgccaaccctgggatggtgggtggaaggctgtcagtgggagaggaagaaatgtttcttctaaaacacactgagaacgtgcttaggacagcggctggcccatagtgaccagtccatgatgcacagctgctcatgttattattacaggaacaagaaacaaaggcagtggggaggcaagcaattcacttctggggaaataaatgaggtagatgggggtgtctaatcccaagagctcggttcaacttgccctatttctgcacatttttatggcttggcattgagctttaggctcaatgtccactttttctctagctgggctgtcagagaccggtgggctggatggctctcagagaaagggagaagaccttgaaatgtcagctgcatactacacaactacacaactgtgcataagtggagtcccaattatgtaaacagttatagctacatggacatgggaatatatggaaagaataaatggcaattaaatattaaaaatatttatctttgagtggtagaattgtgtttccttcattagtttttttttctatattttctaatttttaacaacaaacatatattgtgtcttacaataacactttaaaaggctatttgcaggatgtgagggctgggtttatctcatgctgtggtctctttaatttcagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactggtaaggaccgaccggacatgggactgggatggagatcattggagaaggggttagggagagtaattcctcctggaaggctaggctaggccacggaggggaactaccgtgcccaagaggagaaagatagagtgttaatttaagcaggaactcataagtttctatagtcaccactttacaaccttggtctctttctagacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggtaaggggaagaggctgtcgagtgggcatggaagtgtagaaaggagggaatagactagttcatgggagatagttttcagagagctcgaggagaggcaaccaattgcctttcctctttattgagcagagaccccaggggtgatgcactggaaagtgacctcttctctttgaccaggagttcatttcttccaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactggtaaggtcctggagacttcagtacaagtcacgattttgtagtttttagcagtaagcaataagggggtaaaaggctaagttcaggatcatttcttttaactctgtgtccttgttggttgcagataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcaggtaagagaataatctctccatggtcctggtgtgacacacctgggatcccagggacagtccccatggagacatcccaaatcaggagaatggaggagctttggagccagggacctgaagtgtgtcatctttctcctaaggatgatgaggaggtgggaccttaaatatatttgaagatagtgagtgggtttcttttcaggcctcttttccccaaggaaaggagggctgcttctgcttcagcataaactctgccactgcccaccccctctgtagtctgaacagatggctcccacgtgaaccctaaagaaggccagagtgtggggcaataccagatcaaggggaacatacacacgctaatctccatggcctcggtttctcctctttcatcaccacagggcctgttgctcaggagtgcactgtagggaacattgtccgaagtagcctaatcgtggtggttgttgtagccttgggggtagtgctagccatagagtggaagaagtggcctcgactgcgaaccaggtaaataaatgcctcattatggcccccttctgtgaaccaggtggtgctagaaaaacaatcatacaaatgctcccctagtatctgagccccaccgtgcaatctgttttcagtttctgggtcctcccttactcatgtctttttctttacatagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaactt

SEQ ID NO: 5024 - DNA, 15717 bp, human
gccttcaactaccgtaagtacctacaaatgagcgcatagttcagtggctgaatattaaatactggccaccggatcctaaacaaaaccccgaaagagtctccttgctgtaattaattgccgtaaatcaaactgctccccagtctgtccccccacccgcttcattcctgcctttctcctttccttcccggatcccagacctgcctcggtgagaatctctgggcactgtagatatctccccttttccttctcagtcttccctccaaaccctcagctgagcatgtacccggcaccccgccgagcccaacccctttgattcctggagccctcaaagctatgcagggggcgagccattagacatttcagatatgtcaccctcaaaagcactgcggcgctgcctaagggtggggaaagtgcttggggtggagtaggagggaagggtaaaacggctaggcagccaaagttgggggtgggggtggggtgaaaggccaaaatgggcgtggccaactaacccaaggcttggggctgttctcatgttcccccggtataagattcatcatctgggctgaatataaatggtacaatttccttagtgattgaggaggggtcagccatgccaaaaagcccagcttccctgactcccctcaatcccccagtaggcaaagatcctggtttaggggtccaagtggcaaggctgaaacctcagatggcatttcctgggtgtaatcccaggttgaacctctcccttggcagtggaacctggcttcccccaaaaactcctggcccaaagccccagggtaacaaagcaacagggtagcatccaagctttggcctggccctgagaggagtgggagcaagggactgtaggaactgagatggaaagggcatctttagggccctacaccagttggatgccccctttgaaaagaagaaaaaataagcatctttttaaaatgtaatgttcactatgtgcctggcactgtacatgtattatctctaacccaacacaacaataatgttaggtcgatattactcctccactttacagataaggaaaattcagagtgggtaatctgaaaatcctttgatacaaagtgaaaaatgtacaatggacctatgcttccttggatttctcactgtccacttgttccctacagtccagatattttgaacacgaaatatcctcctcttcctgctcctccatcctacccagtgttagcactggggcaagtttgaggctgaggtccaaggtcagtctggaaaagcaaaatcagttcctttctctattctgggagctgcctcttccccactcttctgagctaagatttaataacagctggagtcagccaggacttcagactcccagtagaaagttggtggaagagaattagcttgagtttgcgtggctgggacataccttcccttggtgaaaggttactgtggggggaggtggagagaggcatgaaagctcaagagtctaccttgtgtatatgcaaggcctatggtaaataatgactttggtcagggagaatggaaagcctccctgaactcaaatatctttgccgtatttcctgagattcaaacaattccatttcccttagaggcaatcaacaaaactgtttagaagttaagggcaacgaaagaatcatttagaccttatgtaaattaactcaagcagcttgattttctaacacatgcttgacactggggtattgagcttttaggggtaggagacaagaatgagagtaatattggatctaaagcattctatggaagggaaggatatccaagggatcaagtgagaggggtaagggagggtgaagagggagtgaagggtacctctgggagtttaaatcattgttttagatccataggccttggagttaaacatggattctaatttgggctctaatatttaatatcttttgactttgggcaaattatataacctctctaagcctcagtttgttcatcagtaaaatggggatggtagtaatgccccctctcttaagttgttggaggactctctctctctctctatatatatatatacacacacacacacatatatacgtatatatatacacacatatatacgtatatatacacacatatatatacatgtatatacacatatatatacgtatataaacatacgtatatatatatatatgcatatctgaaaaggtgactctgcacctcccatctcccccatcctgtggagcttctgcaggctattctgggcttctgagatcccagagacaaatccatatttcaacaaatctgacatctttgataccaacaaagaccttgagcaggatagggaagtgagggaaaggagcaaggagaggaagcagcaggtgaccttgtaataccctgcatgcctgtgaggaagtacaatgtagggttgtcaagtgcaatttagccatctaaactaaactttaaggagcaggacaagtcctctgagtaaaaacaattctgcttttagatcccaccacctgctgaggagaaaaattcttcaagactcagagcacacagccagcaccagaggccccatgaccctggacagaccaggggagggggccaccatgctgaagacattcactgttttgctcttttgcattcgtgagtacaaggaaggggtgaggggcaagtgaccctgtcataggtacccactcattaggggtgggagaggaaagtattgaggtttgagcacaggatggagacaacaagggagctctcctttaccataatctctcttttcagggatgagtctgggtatgacatcaataggtaagtgagtcctgccctctcaggcacctccttcctaaaggatccaagatgctggcgtgtctccatgaccttggacataatgccttgagattccagagatagattgggctgattgggaatcagaggacttggtttcctatggcatggtgaaaaagctttatctcagatggaaaagagaccatcagactttattctccaattcatttggaccccttgacaaaatatcttggggttcttatacgatgccccacaggagcacactcctgtccccaagggaagacaaaatgagggatctgggtccgggctaattttaagggacattgtgggacatgttatgggagggagagggttggactgctcatatctttttgatctttgggaataacagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggtaagatgacagtgatactcaagaatcaactccagctcctgagattcaaacttgccttccaggggagagtttgtttcacaaatgcatgcaagcatgcatcccacagttagtaaataagggcctactttgtattgggcaatgcagaggggggatgcagactctggagcagagataggagaaggaggggtggcaaacaaggatcatacagggaaacctcaattaaagtagagctctcctctgctgctccctagacagtactatccttgctttacctaattccagttcattctatccttccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatattaattttgttagtatagctttttattgaggatcaaagaacaaaaactgcctgtttgaactgagtgtatgaatgtttgttgtactcatgccctttcagcatagattccactaaaatacacttccgtagttacctgttcaccaatatcccccaccaaccagttcatgagctttttgctagcggagactgtgtcttctttactcatacacacctagacctacatgacgcttgatgcatactaaatgctcagtgagcatatgacagagctgatccttccttaatgaatagataagtgtgcctggcattggggtgggggtaggaaggagtggtaggaggtgaggtttgccctcactttcatgtaaaatctccttggagaaacaattcatggaaaggaatgtgtggccccataacaaagatttatttgggtcgcagacttactggccaaaccctctttattggcttctttcagtcttgttgtagaagtagggtcttaaatgagcttaatgtattcaaaagctctccttaatatttcagtggcattcatgctctgcaaagatgaaaacaatgttattttcagaggtttggtttttctggtggttgaaagaactacatttggcatttcaggggcctaaagatacagggaattatagatgtagatcttccactgagatacacccctacacatggttagagctcagtgaagctggcagattcttgagagagaacaggggcataagtgaatctacccttgattatgttacagaggcagagatccaaggaagggatagggaagagaaggtaaacttcagctaccacttcttgttcaaagaaattaagaaagagaaaacagaagacaacaggaaagaatcatcttgcctctaactttagggtctcttccgtttgtaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactggtaagagacgggtatgccatgaaacttaggttaacggctaaggatataaatctccctctgtgctccctggagaacctaatcctgtggccagggttaacagtagagaagggagcagaatttgtaaaactgggtgtaggcaggtttttccaagggtggtttggaggaagagaaggaaaagaatcttaaggagtgggagcaggaagtgaaatcactagtgctttttattctgggtctcatcctagacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtaggcaagtgttaacaactgtttttattatcaacctgtttgtttttatcatcattgtggtgttgtaagaaggagctagtagcctcatatcctctgagagctatgagcaaaacacacacacacatacacacacacacgcactaggaaggtggtgtagaactttcttccaaaactttagggaccttgtctcccaggattgttcctcaagctccacctctcagtatggcacagccccattgtaacccctgggaaaattatttttctttaggccagaggaagcttacaggtatgaggtcttcctgattgaaggtaaggaaccaggaatctttagatcaccaaggggtgggcaaaggaattctaatgcacagtcaaatcttgaagccactggccaagtggaagtggaaaggaagagaagatcaaatggggagctcagaaacattttctgggggagagggtactgggtttgaggtcacttctcactctggtctctggattggtttcagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggtgagaggataactcttcagaggaatgcccctccataccccagggatcccagatcagtgcccagaaagatatgggaaagggagtcagaggcctgaaaatcagagcccttgggtttcagcacccttcccctggggtggtctcacaattcctcaaaggcagttagcaggataatttcaaggctcccattctccatgaaaaagaaggccacttctgcctcaccttctcaatataagcactgtcagtaaccagattgtcctcaccccatgaatgtattcacctgcccctgtccccatcaaggcctctgattctggtcttctctggccacaggctatctcacctggaattacgttctgaatgaagctatcaggttgtctctaatcatgcagcttgttgccttgctgttggtagtgctgtggataaggtggaagtgtcggagactcagaatcaggtaactgtcttgtcccagccccctgttccccaacctaacagagtctgaagaatgagtcatgccctagttgagacaagccacagaggcaaaccctatagaacccctatcttctgggcttagggaacaagactttctcaccccacctgtctctttcgcctcacagaggggtcagcactcaagccagcgggtggagaaatgcatagttctcagaggcaagaggagtaatcagaactgcattcactgacatcccccccggagggtgcccaaatctcgcccacaaaccatcctgccctcagagatgattgatgtctccctcattaacttgttctggatttttcctcttgtaagaagccatgctgtcctgtctcccagactgttatccaactcctatcccaacttttcacccttatccctagctctcaggagctattaagccttgtgacgcatcctagttgccttagtaaccagtctctgacactgtggcctccaaccacctgtgcagagcattctgggaatatagacttgacctggatggccatctgatgtgatattggacggggcaacagaatcagactgtttcctctgactcacaaactcacaggccaaacagattctcctgccatttcctttgattctgtggtgtgctctgggccatctgcctctctcatccccatggcttgtgctcaggctactctactgggaacaaggagagaaatgaccacttctgacccagtagggatgttagctcctgaataccttgtctacttccccctactccctgcttctggctgtaccccccgccctgcaactgtggtcagtgtgtctggaagtattcaatgcacaatggattatgattatgattacatgtgtctgtgttttccactggaatctgagggacagaatacttgggcaatcagaagggagccacctaagccttctgcaaaaaccaccaccctttgagttttcaaaaagtttcagcaggggtcaagttctacttctttccggaacctgacctgggtcccgtactcattagagtaatctccaagccagtggttagaaaaaaaaaaaaatgtagctttatgtgccccaccccagcccagcaacactgcatcaaagaataagatcaggaaccagatttcagagaaagcagcttgaaaatcatgttttcctcaccaggaaggatggtcagtgttttctaagtaaaaattgtccgatggattttgggttaatatcatctaatactacaagactcatgacccaaagctgctgcacatttctagttataatctgggtgaggggagagtttctactctctgaaaagcttggctcggcactgccaatcttctagtaattcatcacagctgcctaggcaacccttccataacaaaggcaggtgaggcaggtgggtctgaggaccaatactgccacaacaactgcttccgaacttaaacttgatgactgagaaatactcacagtttctccctccacccccacacacaccacccagagctgccgatcacaatgagctccaggggttctgagagctccaaataatataaaagcattttcccatctgacatctcaattccagcaacaacctaatcaggggccatggggagctgacatatgatataggctgcggagtggggagggggcgggggggacacgtgggtcatgaaagagcaagaggtttgtaggtggtaaggccctcaaaaagaaaagtcattgatgtcaaataagattatatcccattatcttggccatatccagtccccattgggtagcgagtaagccaatgacataaattgccgccccctttcctccaccctccccctcatcccagcaactcctctcatctcttttctggtctcactagagaagcctggttgctgggaacagctcaaggggtcaccatgctcttcatagtcacggcccttctctgctgtggtgagtacaagtgggggaaggggccccgggcagaaggccggggtgaagtcccggtgggggagggggccgagtcctggcagcaatttcttttgcaggactgtgcaatggggtattgatagaagagactggtgagtttttcctgctccagactgggacattcctccctggagatccgaaataactacagagcgtcagtgtcattggccagggagtggctggttgggagggaagggcagccaggaaggggcacttgctaaagctgctggcaaaattcagcctccaactttgcctttctgcctgcaaaatttcctccaagcttctgcacttttctgaggctcagctataagacaccagcttcccctttccccagcacctgaggaaggaaggaaagaaggaaagggtttggatttgggttgcaaggggaggtgggcagtgtgatctgggtagagggttcaagggcaaggaggagggaggggaagggaggcgggaggatggcttcattaattctgctgtttctagaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacaggtaagaaaatgtagagggtctccgggagttatccccagtgcccctgggactccaacactgctcctgggagtgagggaatgaactcacagggaccctggagcccaaggggctcgtgctgcatgtaggagaggaggggcactgaaatggtagggggttatggggtagggggaggggcggaatgggaaagagagtgtgaggagactgactggaagagcctagggccagcccagaatgaatgtctttatttgctgacaaagtgaccctgagtatcccatctgggcaactgcaaacttctgactcctttttcaccccattctgttttccagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaaggtagagctgaaaagggtgtgggaggaaagggggcagggtggagggaaaggcaaagccctgggtcagacactcctctccctgcagcaaactttgctgctggtcctgagagcctgtgtccaatcttagagccaggcaggcgtggcgctgggagtgccagggcctctggctgcacgatattaatagccataatcgttattaatagctttggttcgtggagggtgatttaatttttctaattattttcacatcaattatctcacttcaccatagagcaactcttcaaggtgggtgaagcaggtaccattttccccttgtccaaatgggcaaactgaggctcagagaatcagcagaaccccaagaaaaattctacctttttactagcctccattgcctgccctgatcacactgaggactcatctggaggtagtgaggggtggggttgaagggtccctgtgtgagaagtccatctgcaaagtggatttaccttactttttaaatgcacttacttaaaagcaaagaagcctccgagaaccaatatttgctatatttgctttctctctttcttgttcttaatttggttttgtgttgtattttgttttttgtttttgtttttgttttttgccttctagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacaggttaggaggggggactccaggtagaggtggtgccaaccctgggatggtgggtggaaggctgtcagtgggagaggaagaaatgtttcttctaaaacacactgagaacgtgcttaggacagcggctggcccatagtgaccagtccatgatgcacagctgctcatgttattattacaggaacaagaaacaaaggcagtggggaggcaagcaattcacttctggggaaataaatgaggtagatgggggtgtctaatcccaagagctcggttcaacttgccctatttctgcacatttttatggcttggcattgagctttaggctcaatgtccactttttctctagctgggctgtcagagaccggtgggctggatggctctcagagaaagggagaagaccttgaaatgtcagctgcatactacacaactacacaactgtgcataagtggagtcccaattatgtaaacagttatagctacatggacatgggaatatatggaaagaataaatggcaattaaatattaaaaatatttatctttgagtggtagaattgtgtttccttcattagtttttttttctatattttctaatttttaacaacaaacatatattgtgtcttacaataacactttaaaaggctatttgcaggatgtgagggctgggtttatctcatgctgtggtctctttaatttcagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactggtaaggaccgaccggacatgggactgggatggagatcattggagaaggggttagggagagtaattcctcctggaaggctaggctaggccacggaggggaactaccgtgcccaagaggagaaagatagagtgttaatttaagcaggaactcataagtttctatagtcaccactttacaaccttggtctctttctagacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggtaaggggaagaggctgtcgagtgggcatggaagtgtagaaaggagggaatagactagttcatgggagatagttttcagagagctcgaggagaggcaaccaattgcctttcctctttattgagcagagaccccaggggtgatgcactggaaagtgacctcttctctttgaccaggagttcatttcttccaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactggtaaggtcctggagacttcagtacaagtcacgattttgtagtttttagcagtaagcaataagggggtaaaaggctaagttcaggatcatttcttttaactctgtgtccttgttggttgcagataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcaggtaagagaataatctctccatggtcctggtgtgacacacctgggatcccagggacagtccccatggagacatcccaaatcaggagaatggaggagctttggagccagggacctgaagtgtgtcatctttctcctaaggatgatgaggaggtgggaccttaaatatatttgaagatagtgagtgggtttcttttcaggcctcttttccccaaggaaaggagggctgcttctgcttcagcataaactctgccactgcccaccccctctgtagtctgaacagatggctcccacgtgaaccctaaagaaggccagagtgtggggcaataccagatcaaggggaacatacacacgctaatctccatggcctcggtttctcctctttcatcaccacagggcctgttgctcaggagtgcactgtagggaacattgtccgaagtagcctaatcgtggtggttgttgtagccttgggggtagtgctagccatagagtggaagaagtggcctcgactgcgaaccaggtaaataaatgcctcattatggcccccttctgtgaaccaggtggtgctagaaaaacaatcatacaaatgctcccctagtatctgagccccaccgtgcaatctgttttcagtttctgggtcctcccttactcatgtctttttctttacatagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttca

SEQ ID NO: 5025 - DNA, 126192 bp, human
atacaagtgatgccttcaaatttgagctcagtttcttatggtcgtttaggagcatgagggtttctgcaataatctaccagtgaaatgatgatcaagatcttggaaagcactctactggtcaagcagaatagtgagtattgacttctgctgtctcagaaataatgtcacaaatactcaaagggggggaactatctgtgaagatggaatgagttaacatttttgccctattgttacctcattttcaataattccttgggcatgatttggaaaagggagagagagtgatatataattccatagcatggattgttttttttctaagagtttgtagtcctgtttcagtaaagagcatctcttgacgacacccattttctttctccctcacttattcattccttcaataaatattatcaaacaccttttgcagactagacttttacttttttccctttgttccttttatttctgaatttttttttaccttctttccccaccctccccttttccttcagcatttacattttcaatgttatacctggaaaatggtgataatatttgagaagttatttaaagtaagaatgtagatgagaggcagggttggagaattttgtggatttgtgtgttttgtgtggtatcattttatccatatcatccagttttctcttattttctcgcttaaagagtgtctaaagaacttttaactacttaaggataattctcagcttgtgccagtggaaaattcacccatggtgactgacttcatctttctcggcatgacagataactctcagcttgaagtcctgctatttggagtctttcttattgcttacatcatcactgtgttggagaatctaggccttgtggttctgatcagagtcagctcccgcctccacaccccatgtactttttcctctctaatcagtccttccttgatgtctgtttctcttccattacaattccacagaatttagcacatttgttttctaagctgcagtatgtttctttccttttcccgtataacttaaatgagcttgtttgtaatctttgcctctgctgaatgcaattttttaaacttgcatggcctatgaccgctttactgccatctgtcacccactgttctaccacattaccatgtcaagaggccattatcttttcttggtagcaggatgctaccttggtgggttagttaagatggtcactgtgacaacttccatcacacaactatcgctttgtcaaccatgtgtcctccctgccttcttctgtgacattccctcattgttggtactggtttgctcagatccttggatcacctcccgatcttggtggttggctgtgggggattcaccctggtcacctctgttgtggtgatccttgtctcctacatgtcttccctcatgactatcctaggaattcccttagcttctggaaaacagagagccttctccacctgtgcctcccacttgactgctgttagcctgtactatgaaacaactatgtacacttacttgcccgcctcgcgacatggatccggggcaggaaatcagattgtgtcagtattttatacaatggtgatccccatgttaaatcctctcatctatagtttgagaaatgaggaagtgaaagttgccctatgaaaaacattgagacatagtccttaatcttctattgagtgtctcaaaaatgcaaaatattctgtgaagacttgctcacggttttattcacagtgtttttcttgcctgcaaatgaagtcttcttaagaaaaactgaattactctaactaattgtttaaaagtagttgtctagatcaacagcaacaccgtaggcagaaattatataaacaaaataatatatattttatgaaacaattgtctgataagaaatatttaggagggaaatatgtatgtgagtataaatatgtcagtttgagtggtaagcctgtgtgataaccctagtcatgagttaaaataattccaagataacaaggttaggaaactatataatttgactgtaagttatagaagagaacatggatgacaactgggatgcaaataactttgctgtaccatgcatgtccttatattgaggatttacttagtgctccaaagactgaattaagttcagtacgtgtctgtcataaagattcaggacacttctaaatgtttctattccaaatgctctaccaccactgcactgtgagacttaaaaatgtaagcatatacatgaattctcatgtgcaattattgagatttgtaggggtgaatcttaaatagggtgatagctaaataatagattgggctcactaattagagtttgcaaatcctttgtaaagaacaatgaatcattggttagtaggaactccaggccggaattgcagctataatttttctatatgcaaattctgagtggaccagggccaagtccattgctattcttgaatatacttctaacatacaatgcaagtgtaaataaaaccccaattaattcattagtccatggctaactcattctcagaatttgtaaggttgcatgaaattcctggatattgctattttgtgtaaatatattgaacaacaagatatttttataagcttacaatcttatatatgaataatacaaaaccttaagctcttttataaatgagaaaactaatgcctaaagaagagaaggtgaccaaaatcaaacaactagttggagagaaataatcaaattggtcaagctgcaaggaaaagcagaaagtagcatttatctatatctaggttagtgcctaatctataatctagggatctttgagttctaagaatagtttttcttctgcctctactactcccagaaactatatagccctagtagccatcttccaaaaaaccctaaaccctagttttgagtgtggcagtgcggtttacttggtagccatgtgaaacccagttcccttagagcttcagatccttatatccaactaccagttggaacctgcaattggtagcttctcaggcacttcaaatttattatctcaaaaattgaacccttctaaacctgatgctcttctttccttgtcccctacctatgtgaatggcaccatccagttttttgagccctaaacttgagtcaacccttaacacttcctttccctccactcgctacattcagtcaatcaccaaatcctgtcaattctccctcacaaatgcctccaccatcactggcacactcttttttttttttttttttttttttttttgccaggattagctaaatggtcctttaacccttctccctgaatccatcccggattttgtgaaatctactttcacacaacaaccacagaggtttaaatgtaaatccgaccacatcagccttcttctaccctccaaattgcttaaaatttccacgtctctctttgcctataagataaatttgaaactcgtaaatatgatatgtaaatctctccatgccctgtttgtccaagttctattcatttactaaatccaaatttaaatcctatcttcgtttctaggtagcttttcctgacatttcagaggaaactgagtgtgcatattctgttctcccattgcactttgcatgccttttgtagcattatgacgcttgcccttcttatgaaattctttgtgcaattttctgatattctgttttgtctgcctagattgaaaccctttaagtggatagagccatttttttttttttttttggctcccacctaggtcccacacagggcctggttatctggtaatggttcaaaaaacattagcagaattgaaattcactcacagctaaccttccttattcatccattttctccaccaggcatggttatagcttgttgtgcaatggaggaaaggtagaaaatcttacctcctgggacaccagcttctacatggtccttgtggtttggcagatgtttcttgttgacactgtcgctccaaaataaggaatctgaacctctttttgttcattgcttttaccttccagctcaatactacccaggtcaatcccttgtcctccctggatttctgctcttctctggtaactggctcaaggacatggaagatttttttcctggaataaaagtgcatttgtttcctttgtgaggttcatgattagaaactctcagaatctgaagtcagaggtgaaagggcccatagtgagaatttagactgatggattttaattttttaagcattggaatgattttttaaaaataattttaaatacagaacaaaaatttacaaaacatgaaagtggaagatgtttggctgaagaaagtatggggcacccatagcctagtactcacttctccatccctgaggcacctctacagaaactcaagaacagtttgaaaacactagagtaatcaaatctgctttttttcacaaatgagaaaacagcatccccaaggaaaggcaccattctggagatcactcagctagtcagtggcagaggcagaattagcattcagatttcctgattcacgaccttagaatactgtctactacagccctttcatgttgtgtgatgcttaacaagctggaagggtgaacaaaatgggccttatcagactgaattgcagacactgacttagcatctatctctttggctagttgaagtgtcccccaccctccaaacagccctagaaataccagagacaactacagcctcatcagccttcaccatttctatatgggaaatggtagatctcagaggatagcaaaattctttagtaatagagtgtccttgtaggcaggactagctacataatttgtaggcccaatgcaaaatgtaaatgtgaagctccatgttgaaaaaaacaggaagaagtgctattaaaggtgctcagatataaagctttgtttttctctcttctgcagtctctctctcaacctgccatgctgtttttgttatttaatgccacacctgcacaggcacagggatatttgtggagcaagtgcagaacttcataagtgggcagtgattctgcccagtgactcgctgcccatgtgcatgactcacttgttactggatttttccttatatcagcttctgcacagataggtgcatcatgctctgttcagcatggaggaagtgaaaccaggtatatcccgttcccatgggcaggctgccccaacccactgtggtcaggcaaccaccaagagtattacaacttctgcacagtatgcactaggtgtctggattggagtgggcaataggctctgctggataacctgccaaatgcaccatgacactgctcacttggggccagattgctgttatcatgtccaactgtgagattttgcagagtgtgtatgaccccaattctccttgtgccctggctcagttcccttgtgtggagggttgtagctattactgggcaggatagagaaggggaggctggatggggtcctgagtactaagaaagaagcgagtgacagctaaaaacctaccccagggaagtggagaggtggtgaaaagtgggactgtgtgttatcagatattccaaactcccagtgaatactcgattgtcccattggattttgcatttcacttatgctaatattcaaattatttaaaatttcaagacagtgacattaaactttaagtgcagagcactcctaagctcaaggtcttgtacaatcacatgctcatgaagccagccctgctcacagagaggggtttcttttatctttgtcaggcagtataatgtagtggttaggagtacaagctctagaatcagactgccagactttgaaacccatttctcttacttccaaattctgtgatgttagacaagttacttaacctttttatctctcagttttcttatttgtaagataagaataataacattactcacttcttaaatttgctgcgaggtttaaatgcgatgatgcattcacattggttagaatagtatccagacatcgcacacactcaataactgtttcatgttatcatttatagcttgccagattcaacattttttagatgtccaatgcaggtatcaggttttatttactctggatctgctgcagacctgtgctccaaatggtatttacccagcttctacagcgtataaccagacttggtctccagtggcctctcaggctccagtggcctctcaggcttaaggggaactccactagatctgtacaaacaaagcgaacccagtcaggtttctctggtagagttttttccttcacaggctcagcacccatccaagtcagtgtttggcctcactatgctaggtctcaagaccaccaaattcagcctcagggacaacacacccacttctgctgcttggccaacatgttctcaggaaagggatatcctattgtctcataaatagtggtccctggtcatttggctactggaaacagctatgtaagtgaatctctggggtctctacctcagtcctgctgcaccagtgccagcccttaaaggtatggacattctaggggacttggagttagaacaagatttttaaccagtggagcctaatccaggcctttaggggggtaacaaggcctcttgaagtgagaggatgagggagtgtgggcaatgggtgagggaggtgggggacaaggactctatgagacatgtcagcaactctgtcccctcaggtgttacaagaggataaatactgacccctctctccatctgctggtgacagtagcagaagaagctgagccttgctttccagggagctctcagcacatctgcatggtctcctctgccccccagcacactcagggtgagctcagtcagcttccctggtcggcagggggtgggggcaggggggctgctccagctattctgggctgggcatccctccctggtgctgctctgggtggtggtgctcagagcagcatctggtcctgggctctctgatagaaggaccctgccgagacagtccctaggctggatccggggacctgagcaaatgagcaggtattgagggaaaggatagtttggggggcccagtggcaagatgctataaccccaaaggcagggcagcagagtcagctggctgtgtggtccccagcttctgtccaaggcaaggacatcccagagactcctttggcctaaagctgacacttctgtcaacccactgggattcttggaggtatccagtcagcagcatctgattcagggaggaatgttcgagactgggtagtgactggcctcctgggtagtgactgacctgctggccaagcccccatgagtcagggaaaatggctggcgtaaacctggcatccttgcaagggccctggagctcggaactggctggggtctacctcacactgcaagagtgaagatctaagggtggagttctgggacccagggcactaagcaagagcagtagggagagataccaggcttctgaggagtaaggagccatgttctatgattctgaaaacatgactaggatgagatttagtagaaaacggaaataaccaagtccattaacaaacattttctgcgtgcacatcgtgtgcactgacttattcttgggtgtatagcagtacaggaaagagagtggggagggggtgggagatgccaaaggaaataggagacatggccctttctcttggggagcataaaataagggccccagaagagaaaatgtttaagcacttgaagaaaaagcaaaatagaaattggttttacttgaaaagtgatatgtaaaatgattctttcaaactcagtaagtttccacttccattttaattttagagataggttcctactttaaaaagtaacctcaattcataacaataaaggtgttaatttctcttcagtaagaattgtcaccttttccacacatgctggttgaccttgataactaattgaattatctaaaattactttttcctgactataaaagaattacacactcattattgagaaattggaaaatatggagaaggaaggggaacatataaattgatcaatcttggcacctagagacaatcactgttagcactttggtgtccttttaatcttccatttaaaatatattcatggggggtgtgtgtgtgtgtgtgtgtgtgtaaatgtgtttgtaatagaataataatgtaatacggttttttaccctgctcttttcacttaaaatatatcgggaaaaatatgcacatcaataagcatttttccccttgagtttaatgattgattgtgtaatacaacaatgtatggatgaaccctgatgactaattgttaacaaagaactttgaaaagactgattgataggaagaacacatagctgacaacagcttctatcaatatgctcaagcaagagtgaaatacacaatttggaatttgactgcattttattaaatgcagaaataaaaacataggctaaatgacattactgggaagatttgccttctatgatcaaacctctcgtaaacacaaaggctttaaatgaaacttcagtttgaacaggcggacaggagaaatgactggaattctgaaagattttaccagacatttgtcctcagattatgcagtggaacatgcagactaccttggcacgggcactgaaaccagcctatctcagcccagtaagtgtctaccccaaggatgggggtcaaggggaatcaggcaaacaccctgagtctatagcacaggctgagagcagtcaggtgggaggtgaggggtagaaggacatgtgcatgatctggagcagagggccaactgacaatgttaagaataatgaatccttatggatatggtatagtgggaactaaaggcttccaagtcacagaggaggaggaaagaagaccaacttgaccaaaggaggaatatcacagaagtcatcagtagtgggagttgcagaacagatttgtaaagacacttttgatgcttggaaaataggttagacaggaccctggccatgggaaccgaaagtgggagaaatctaagcaggacagagaggtaaatggggagtgaatccaaaaagcatggcggtccagttgccttactatagtgatagcatgaaggagaaggagcagcccaaaagaaaaagataaaaagaaaggtaaatctgaggaggattattcatctctagaatgaactttaccataacactggaattacctcccacaggtaccaaatgacaactaggacaaaacttctaagatgcaaactcagggacctgatagatattctggctcagtcacctctttcaagtttctgaagatttcagttcctaatactctgagttgtcacaaaatcaggataggcactttgcagttatcccaaggggcaaaaccaattcacatcatctcaaattcatttaaagccatgtttaattaacataacatttaattctactttaattacttttaagaacccacatattgcttcagggaattaataaaattagacaaaattagcatgtcacaacatgaagcatgttgggaatcattagtctaaaccatctggatagataactgtctcctttgtacttgattattgtccacattgaaaaccctaattctacccaccttctcttccacctacctccagtagatattgttttgagagctgggaggtcttttgtttgtccaacaatgttcacttatctttaaattcagcctctgatcaatccaaaggcacgatagtctcagtttcctcatataaaacctaaaggtaatcacagtttctttctctctaggttattgtggaaactcaataagattatgtatacaattggtattaatgaaaaaattgtcattactagtagaacttgtgcctgggggagatgccgggcagtatgtcttcatttaaatagtggaaaaaacagaatgcaataaggataatgaccactaacaggagacagctttgggaggctttgcaactccattttatgaaaaagactagtggatagtagaattagaattattcttaactgaagggtatgatctccacatccatactcacaagacacaaacatcacctgtaattccttacaacatccattgagcgtgtggtgtcctggtcccaggctgcagaaaaaccaacaagacatcttcaaaaccgcagagcccatgtgggtgggaaaggctaaacagggggatgcagaaccttgggaatgagatatcgctacttctttgaatgtgattggaagtgataaatggcacagtggtggcagatgaacatagattcaattcagggtaaaggaagagccatcctcttcaaggatcagatatgacttccattgttcagtgcctgaagttgggactttgttatttctgcttcaacagagaaaggataattttggtagctttcaatctcattaagtgctttcctatcctcttcctctaactcacttttccctcatttccattttaaaaatttctcatagagaaatataatacagtgggaagagcaggggctctgaatctaggcaggcataatatctaaactacttgaagttttggttgctatgaatccatgagccttccaatcctttgtttgtttccttgtctctgacctgattccctgactacttctctttctcatgatcctctttggtttctaggttcctgtcatctccattaagaatcagcttattggccgggcgcagtggctcatgcctgtaatcccagcactttgggaggctgaggcgggtggatcacgaggtcaggagatcgagaccatcctgtctaacaaggtaaaaccccgtctctactaaaaatacaaaaaattagccaggcgaggtggcgggcacctgtagtccaagctacgcggggtgctgatgcaggagaatggcgtgaaccctggggggcagagcccgcagtgagccaagatcacgccactgcactccagcctgggtgaaggagcgagagtccatctaaaaaaaaaaaaaaaaaaagaatcagcttattagcaagaatgtggagaaactggaaagttcaatttcccattgtggaaatgcaaaacggtatatccactgtataaaacagacagtccctcaaaaggttacatgttgattataatttaacatggttaaaatgtgacctagcatttcctttctggtgtatctagcaaagaaaaaatggaaatatatgtccacacaaaaaattgtacaataattttcacagaaacattatttaaaatagcccaaagttgaaaagaacccaacatgtttatccatgtccatcaatggatgaatggataaacacactgtggtacatccatacaatggaatattattcaatcatgaaaaggaatgacgtactgatacatgccgcatgtatgagtccattcttgcattgctataaagaactacctgagactgggtaatttataaagaaaagatgtttaattgagtcacagttctgcaggctgtacaggaaacatggctggggcggcctcaggaaacttacaatcgtggtggaaagtgaaggggaagcaggcatgtcctacatggcagaagcaggaggaagagagtgccaagggggaggtgctacacaccattaaacaaccagatctcatgagaactcactcactatcacaagaacagcaaggaggaaatccaccctcataatccaattacatcccaccaggcccctcctccaacaatggagattataattcaacatgagatttgggcgaggacacaaatccaaaccatatctaggaatgaagtactgatacatcctgcaacatagatgaaccctgaaaacaccataccaaatggaaaaagccatatagaaaaggctgcatattgtataactctatacttatgtgaaatgtccagaataggtaaatctataaagacagaaagtagattagtgcctgccaggggctagggcagggagagaattggaagtgactgattatgggtacagggcttccctttgggatggtgaaaatgttctaaaactaaattgtggtgatggttgcacagttctgtaaatacattaaaaatctatacgttaaatgggtgttacgttaaataggtaaaatctatatgttaaatggctgtatacgttaaatgggtgaattttatggcatgtgaattttatctcaataaatctattaaaggaaaaagaattgtcacatcatcactgttagcaatcaatggcaatgtgaattgagtcactatgactggattaatatttaaggtttcccttaagagtatggttggacaaacatgccagaatggctacctaaacaaaattactttcatgattttaagcaggaaaaagtctgttaagtttggacgtccagatatatatgaattcagaggctgcactcctaactcgttatgttctcacttctaacttttatatgcacaattatcaaataaataattagatttccttaaaaagcaaactatataatttgctacaaaacagaaaatgaaaaaaaaaaactcacagaatgggagaaaaaacttgaatatcatatgtctgatcaggctcttataaatatccaaaatatataaaggtatatgaggtatattacttcacactcactaggatggttataatcagacatataataacaagtgctggcaaggagttggaggaaacagaactctcacacattactggtgagaatgtaaaatggttcaaccacttcagaaaatagcctgactgtccctcaaaaggttcaacagaatttccatgtggaccagcaattctcctcctaggcatatatctaaaataattcaatacatagatatacacataaacgtgtacataaatgctcatagcagcattatttgtagtaattaaaaggcaaaaatgactcaaatgtccatcaactgatgaatggataaccaaaatatggcatatccataaaatggaatattatttggcaataaaaaatgaagtactgctacgtgctacaacatgaataaacctgaaatcattatgctaagtaaaagaagccagacacaaaagaccacacattgtatgaatccacttatacgaaatgttcagaataggtaaatccatagagagagaaggtgtattagtggttgccatgggctagggaagaagagattaggagtgactgctaaaggatgtaagatttggggaaggatgttaaaaatatcttaaaattgattgtggtaatggttgcacaactctgttaatatactaaaaacctttaacttgtacaatgtaaacagccaggtttgatgtaaatatgtgatctttctcaaaaaggctgttatctaagaaaataatcagtcaatctagctctgactaggtgtcattataagtagtgttattttaggagccatagaatcattctctgggactgatacttctaaccagaaggaaataatggaacatttgcttcatagaaggaagatctaccccctaaacaaactctctctgcttcttaagttatacaaggtaaaattccaaattgtgtttaaataccacattcatgtaagaaaacattttaaaatggtagtaaacagtcagactccacatcttgattggagtggcaaggatttgtgaacatgttttcaatccaccacatcaaatattttttgtttaatgactgcatgatatttcatagcataaatgcacaataattgaatcagtctcctattgatggacatttaggttatagtccatcttttgctactgcaacaatgtacaataaatatccttttgtataagtattttaaaatatgtgtaggtatatctgtagtgtaaattcatcaaactggagttgctggaccaaataaaatgtgatttcagagagtttacagctccatcaacaatatatgaggttattttctcatatttttattatattatcataaattaatatattatcaaacctcttaatcttaacatttggagtatgtaaagacatgttcagtgttctgtgaactgttgctcattttcttttgcccattttttgaataggctgttggtcatttttcttattgactgctaggaactttccatatgttaagaaacttagtctttgtaataggtgttgcagatattccccccccaccaaagttttatattttcaacattgattacagtagagtttctttttctatgaagagttttcaaagttttcgaagaataaatttttgtttattgattttctgtattgtttttctcttgtcaaccctattgacttctgctcttacctttattatttccatccttatgcttgctttggatttattttgctcttctttttcttgtttcttgaggtgggagtttaagttattgattggagactatttcctcttggctaaaataaaaaattactgctgtaaatttcctgcttatcactgcattagctgcatcccaaaaattttgatacattgtattttcatttcatttacttcagtgcatttatttacttccctcgaggctttcttttggctgatgaattacttagaaagatgttgtttagtttccaatgtgttttgaaaatttgctgttattttttctatgttccattgtggtaagagagcatatactgtatgatttcaatttttaaaaatttgtcaatatttgttttatggtccaggagatggtctatcttggtgaatgttccatgagtgcttgaaaagaatgtgtattctgctgttgttaggtggaatactctataaatatcaattagatgtccttcagtgggtgaataaacaaatagtggcatattcgtatcatagattattagtggccaataaaaacagaacaatgatacgcagaacaacttggatggatttcaggttaatttgctttagttgaaatagccaataccaaaagggtacatgctgtatgattccatttttataacatgctactaatgacaaaactaaagatgaaaagatttctgattgccaagggttagggctgaggagaggttgtgactatgaaaaagtagcatgagggagtttgcattgatgcaacattctgaatctcgattacggtggtggtgacatgaatcaatatatgtgttaagatttcttaaagctacatataaaaaacaaacaaaaatgcatgcatgttaaaactggtgatttccaaataaattctgtagttaacagtattgtaacaacttcactttcctgtatttggtaacgaactatgcttatgtaagttgttatctttggaagaggctgggttaagggcattcaagaactctggaatattttggtaagattttgtgaatctaaacttatttcaaaataaaaacttacaaaaacaaaaaaaatatatcaattagataaaattgatagtaccattcagatcatctatatttttactgattttctgcctgctcgctctatcaattactggcacaggtgttgaaatctccagatacagggggaggagccaagatggctgaataggaacagctctggtctacagctcccagcgtgagcaacgcagaagacgggtgatttctgcatttccatctgaggtaccgggtgcatctcactagggagtgccagacagtgggcgcaggtcagtgggtgcacgcaccgtgcgcgagccgaagccgggcaaggcattgcctcactcgggaagcgcaacgggtcagggagttccctttccgagtcaaagaaaggggtgacggacgcacctggaaaatcgggtcactcccacctgaatactgcgcttttccgaccggcttaaaaaacagcgcaccacaagattatatcctgcacctggctcggagggtcctacgctcacggagtctcgctgattgctagcacagcagtctgagatcaaactgcaaggcggcagcgaggctgggggaggggcgcccgacattgcccaggcttgattaggtaaacaaagcagctgggaagctccaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagccggagatctgagaacgggcagactgcctcctcaagtggttccctgacccctgacccccgagcagcctaactgggaggcaccccccagcagcggcagactgacacctcacaaggccgggtactccaacagacctgcagctgagcgtcctgtctgttagaaggaaaaccaacaaacagaaaggacatccacaccaaaagcccatctgtacatcactatcatcaaagaccagaagtagataaaaccacaaagatggggaaaaaacagaaactctagaaaaactggaaactctaaaaagcagagcaacactcctcctccaaaggaacgcagttcctcaccagcaacggaacaaagctggacagagaatgactttgacgagctgagagaagaaggctttggacgatcaaattactccgagctatgggaggacattcaaaccaaaggcaaagaagctgaaaactttgaaaaaaatttagaagaatgtataactagaataaccaatacagagaagtgcttaaaggagctgatggagctgaaagccaaggctcgagaactacgtgaagaatgcagaagcctcaggagccaatgcaatcaactggaagaaagggtatcagcgatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattaaccaggagaacttccccaatctagcaaggcaggccaacgttcagattcaggaattacagagaacgccacaaagatactcctcgagaagagcaactccaagacacataattgtcagattcaccaaagttgaaatgaaggaaaaaatgttaagggcagccagagagaaaggttgggttaccctcaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaactggtaccagccgcggcaaaatcatgccaaaatgtaaagaccatcgagactaggaagaaactgcatcaactaacaagcaaaataaccagctaacatcatcatgacaggatcaaattcacacataacaatattaactttaaatgtaaatggactaaatgctccaattaaaagacacagactggcaaattggataaagagtcaagacccatcagtgcgctgtattcaggaaacccatctcacatgcagagacacacataggctcaaaataaaaggatggaggaagatctaccaagcaaatggaaaacaaaaaaaggcaggggttgcaatcctagtctctgataaaacagactttcaaccaacaaagatcaaaagagaaaaagaaggccattacataatggtaaagggatcaattcaacaagaagagctaactatcctaaatatatatgcacccaatacaggagcacccagattcataaagcaagtcctgagtgacctacaaagagacttagactcccacacattattaatgggagactttaacaccccactgtcaacattagacagatcaatgagacagaaagttaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagagcagaaattataacaaactgtctctcagaccacagtgcaatcaaactagaactcaggattaagaatctcactcaaaactgctcaactacgtggaaactgaataacctactcctgattgactactgggtacataatgaaatgaaggcagaaataaagatcttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaaaccaggagctggttttttgaaaggatcaacaaattgatagactgttagcaagactaataaagaaaaaaagagagaagaatcaaatagacgcaataaaaaatgataaaggggatatcaccactgatcccacagaaatacaaactaccatcagagaatactacaaacacctctacacaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctatcagaggtgcaaggaggaactggtaccattccttctgaaactattccaatcaatagaaaaagagggaatcctccctaactcattttctgaggccagcatcatcctgataccaaagccgggcagagacataaccaaaaaagagaattttagaccaatatccttgatgaacattgatgcaaaaatcctcaataaaatactggcaaaccaaatccagcagcccatcaaaaagcttatccaccatggtcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacgcttcatgctaaaaactctcaataaattgggtattgatgggacatatttcaaaataatgagagctatctatgacaaacccacagccaatatcatactgaatgggcaaaaactggaagcattccctttgcaaactggcacaagacagggatgccctctctccacagtcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagtccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagatcccgcatcgccaagtcaatcctcagccaaaagaacaaagctggaggcatcacgctacctgacttcaaactatactacaagcctacagtaaccaaaacagcatggtactggtaccaaaacagagatatagatcgatggaacagaacagagccctcagaaataataccatacatctacaaccatctggtctttgacaaacctgagagaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaacaccctagaagaaaacctaggcactaccattcaggacataggcacgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaataagtcaggaaacaacaggtgctggagaggatgtggagaagtaggaacacttttacactgttggtgggactgtaacctagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatggactggattaagaaaatgtggcacatatataccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactgtggggactgttgtggggtggggggaggggggagggatagcattgggagatatacctaatgctagatgacgagttagtgggtgcagcgcaccagcatggcacatgtatacgtatgtaactaacctgcacattgtgcacatgtaccctaaaacttaaagtataacaataataaataaaaaacattaaaaaaaaaagaaatgtccagatacaattgtggacttgactatttctcctttctattctatagtttttgctgcacacattttgtatctctgttatttggtgtatatagatgtaatattgttacatttttcttgtgaattgacagttttatcattatgcaatgtccgtctctgtcactggtaattttctttgctctgaggctatattaacatagcttctcctgatttcttttgattaatctttgcatggcttaatattttctgtccttttgcttgcaacctacctatactactacaggagaagtgagtgtcttttaaacagcatgtaattgaggatttaaaaaaacacgctagtactttgggaggctgaggaaggtggataactcaaggctaggagttcgagagcagcctggccaacatggtgaaaccccatctctactaaaaatacaaaaaaaaaaaaaaattagccagatgtggtggcatgtatttgtaatcccagctgctcaggaggatgaggcagcagaatcacttgaacccaggaggcagaggttgcagtgagctgagatcaggccaccacactccagcctgggtgacagagtgagactccatctgaataaaataaaataaaataaaataaaatataataaaataaaataaaaatccactagcaaatctcttttaattagtgtatttatacaatttatgttgaatgtaattattgctatgttagggcttaattacgctattttactgttggttttctgttctctctgtgttttgtttctctattttctttttactgtcttcctttgtgtttatttaactttttactctttttttagaattcaatttttatttatctgtagtatttttatcccttcttggccttttggctaagatcaagtgtagtatctatagtgtttctgagtgtatctctttgtataacttcctcactagttgcattagttattacattatatatacataacttacgtaattatacttgtgccagtattttacctgttcaagtgatgtatagaaaatttacctctgttcacatattttgatcctcctccatataatatataattgttttaaatgttttctacaccacaaacacatttgagagtgttcaattatatttatccgtatattccctctttttattctttcttccttcctgatagtccaagatttaaaaaaatcatttctattctttttagagaacttctttagccattctttagggtaggtctggtaaaaaaaaaaaaatctcttaggttttctttatttgagaaggtattgatttctctttctttcttgaaggatgtttttactatatatagattattgagctgacagttcttttctttcagcacttgaaaaatattgtgccactttcttgcaccttcagtagtttctaatgaggaactccctttagttctaattggtattcccctctagataaggtgtcatttttctctagtggctttttaatttttttctttgactttagtttcctgaagtttaattatgatgtgcacctttgaatttatcttgtttcgggtgtgctcaacttcttgaatctgttggtttgtgtcttctgccacatttgggaaattcttttaaaatttttattatatattatataatttacagaaagggatggggtctcactatgttgatcaggctcatctcaaactccaggcctcaattgatcctcctgcaaagtctcccaatgtgctggaattacaggtatcagccactacattgggcccaaatttgggaaattcttggccattatatattcagtctttttcctttttacctaaaacttcaaacttttaaagttttccccactcttctgagattctaatgaccagaatgctagttattttttttatagtgccgtatgtccctggactcttttcatttttcccctgttattcaaagtgattaatttctattgttctatattcaagtttaatgatttcttcctcagtcctgtctattctgctgctgagcccattaactcttaaaatcagctattgtattgttcatttctaatatatccatgagctgtttcttatatctttaatttttgctgagaatttctattcctttgatgagactttctacttttttatttgtttcgtgtgtttgtaattttgtgttgaaacattattataatgtatgatgataagtccctataagataattatatatctgtcgacattggattggtatctgttgatttgattgtcttactttttgcaagttgagatttttctagttcttggtataattttttgttgaaatctggatatttcagttgttatgatattcttgattttatttaaattttacgttttaactgacttcctctgacatctgctaggttagggtggaagttcaggttttcatttggtctttattggcatagggtagtatgtagaagagatcctcattactactccctatgtggccaatattatcattatgtctcattattgccaacagtggtggaagtctctacttcccactggcctatgacatcaccctgacaaggatgtcagggcaccttgttttagtgcggggaaggtgcaagtctaagttcttcatttggtctttgctccaggagtgggaatgggtcaaacattttctgtggtttgtggtcagagagtgcttattgtctaaaagttttcttttttagctagagagaataggcttttcttaccacttctttctttggtagtggcctttgatgattttatatttacagtgtctttgttacctggattggaaataagaagcaaaaagaatactcaaggaactcaccacaatgccattccttggtcctgaggtctctatcttgtctgcctttttcttttcacctttctgtcttcttgtggttgtttcatatataatctccagggattttatctgtactttgcaggagaaataggaaacaatacatacattccatttttccagaagaagttcatacatatttgaataattaatttatctgtcttgtcttttatggcttctgggtttgtatcatacttagaaagttctccactctggaattgaagacaagataccccatgttggcttctagtactttgttttcatttttaactcacacctttgatccacttcaaatttattttggcgtatggagtgagattgggagccaactttattttttccattggaaaatccatttgtctcagcaacatttgttgataaagccatctattatttttcttacttaagtgccgtctttttcatataccaaattctaacatgacttgggtttctttttggctctctatttcgtctcattgatctcatgaaccagtgtcgttgagatttgctttacctttaccttattatacatgaaatgttgtatttcattattgtttcattattttttttttggtagaaaggccttggttgtgttcttcaggttttttccagagaaatttttaaataagcttgattaattttttttaaaatgttacctgttttaataggatcacattaatattataattaaattttaagtatatctttccatttacttaaatgtagttttatgacacaacctgatgttttaaatatttttcatgtgggccctgcacatttctcagtagctttattcctagagttcatttttttggtgtttgctattacagttgcaactgtaaatgtaatgtcttttttcatgacatctaaaaaatgtatttatatagcaacacatgcatttttaaatttttatctttatgtcatccatcttactaatttctgctatcctttaaagaactaagtataccagcctgggcaacatagcaagaccctatctccacaaaaaaaaattaaaaaaaattagccaattgtagcggtatgcgcctgtggtcccagctactcgggaggctgaggtgggagaatcacttgagcctgaggggtcaaggctgcaatgagctgtgattgcaccactgcactccagcttgattgacagagtgagagcctgtctaaaaaaaagaaagaactaaatatatatataagcctatatcttacataaataaactatacattttgattaatttcttattttttttgttctttggagacaaggtttcattctgtcacccaggctggagtgcagtggcacggtcatgtctcactgcagccttgaactcttaagctccagtgagtgatcctttggcctcagcctccaaagtaaagtagctgggactataggcacccaactaattttttatattttttaagagatggggtcctgagtttctggtatttcaagcattagccactgcattcagcttatttggattaattttgaatgatattaaaatcttaatattaaaatgataatcaccttttgtgctaggaaaatatttatagtaatcattttttctacttacagtatatttatttcaatgattttcttaggtctaaattacaacgttgtgtggtggggctttttatataatttattttgaaatattgcaaccttattaaaaattgaaaaaactaaaaaattcacatattattttactcatattagacaattgctagcattttagcatatttgctctctctttttccccctctctctccacacacacacacacacacacaaacacacaacccttttaaaatgagtactactgctctttaaaaaacaaacaaacaaaaccactactcacttaaaaatattctttttaaaaactaattgaattgagagcaaggttcagacattatgcccaactgccccaaaatatgccactgtgtgcttctcaaaagcaaggacattatctttcatagtcacaaatagaaatatccaaatcagcaaataaacattgatacagcactatgacccaacccaaagactttattcaaatttttccaagtatcccaaccatgtctctttctattctgtggtccaggatccaatccagagtcacgtgttacatttaattttcatgtatttttagtctcctaaagtctggaacatttcctcagtctttcttgactttcatgatcttgacagtataaagagtacatgtctttcattttgtatgatgtccctcaacccttgtttatttggtaactactcctgtccaaactcaggtcatgtattcctggcaagaagactgtagtaataatgccatactgtaagcagagtaatgcatcaaggggggtattatggcaactctgttccaccagtgatgatgataatgttcattacctgggcaaggtggtgtctgccatgtttccccaacaaggagtcacattttttctccttgtaattgttatgtattttgtaagaagatcctctgagtctattctactattctgttcttcaaacacccactcacctgccttagcattcattgatgatcgctgcctaaatcaaccactactatggtcattcttaagtggtcatgtttatctttatatcattccttctacattcattagttaacattctactctaaggaagtttcacgtcctcattttctttttatttctttcattttgaaattttgatatggactcatggatggattcctatattattcacttgattgttatcctttactaacattatttattttgacactaaaattatcctatatttggatataggagctagtgagagacctttcagacctgctccagtgttctttacacacatccctatcattctttgatctcctccttactttcaaaaacaacaacatgttccaggatcatgtactttccctgctccagttctagaatcaatcattttacaaggatccctgagtccttttagagggggtgatatttagaacccaagatctgttcacttagtggcctctaacagacataggaaatatgtgtttgtatatgtgtgtgagtacacaacacattcacactgcacacatatctatatttctctgtgtgtgtgagtgtgtatgtgtatgtgtgtaaagcatgagtacatatcgatagctccaattaaaatcccaaacaccaggaatctttctagccttttccctccctacatttgtaaatcactttctgacagcgagaaagctagctcctattattctcaatatatttactaatatgttcaatactcttgtatataatcaatctcctgactacattagtgacctcctcagctaatggacctattgccatttcctcagcctgttgcctcctcactttgccaccttctaaatctattacaccaccaactccaagagaagaggaaggaaaaagaagagaattttcttactgtttttaatgatttacatgtatttcttctgttgctttaaggtaaacaattatatcatctatgaaaaatgaaaattttaactactttccaatgttgatggcatttttagaaatccttatctatttgtactaggaaatgcccccaaataatgttaaataatagagatgatagtggatatccttgccttatttcagactttaatagtaatacttctggtatctcgccatttagcaggttgctagtattttccttcctcactttctgtttctttttcaatctttctcagtttattttgtcttgttagtaatagcttccatttactaatcaagcatgaccatttaatttcataaaataaatactgttgtttatggaaatgattatacattttttccatgtttaattgtgttaatggatttcctaatattgaaatctctttgactttctggtataaaacccactttcttggtgtatttttcttttaattagttgatgggttctatttgctaatatctaatttggtacttttgcattagtgttaataattgagaattgggcatagttttgtcagtttttggtatctgtttggaagcttttcttctttctctatgctctgaaacagattaaatagcattaaagtactctgttcctttaaaatcgaatagaattgaagacttgtagtttcagctccaatatttaaagagcttgaaagtcatcacttcctaatagacttaaaatttttcccagtaataacagtaacaatgtattgggtgattttagcatatttctatacactagtattgaatgattcaaagaggaaattaagaaaacaatttcatttacgatagcatcaaaaagaataaaatacttaggaataaatttaaccaagaaaacacaagacttgcctgctgaaaactacataacactgctgaaataaattaaagaagacctaaataaatgggagacacctggttcaagaattggccgactacatattgttaacaatactacctaaaaaaaatatagttttaatgccgtctcaaacctaatctcaatgccctgttattgttttgttttatttttgcagaaatggagaagctgattctaaaattaatatgggattgcaagggtgacaaaatagccaaaacaatcttgagaaagaaaacaaagttggaacattcatactacctgattttacaacttacttaaagttacagtaatcaaaagggtgtggtattggcctaaggacaaaaatatagaccaatggaagagaattgagagcacagaaataaacactcacatctatatcaatttatatttgacaagggtttcaagaccattgaatggaaatagaacaattgtcttcaacaaaaagtgctggaaaactgaaatattcacatgcaaaagaatgaggtttgacccttaactttaatctcataacaacattaactcaaaatgaaccaaagacctaaatttaagagctaaaactgtaaaacttttagaagcaaatggggaaatctgcatgacctgggatttgtcaatggtttcttttagtatcctccagtaaaaggaatcaggactccttgaagaaattgctgattctaggaccaaggcaggaattatataaaatgagactgaagcatcttgcagtgtcagaaaataggaaagtgcttttaaaaatccctaaaaaaatgggtatatgtcaaggggacatgggagccaactaaaagagctctgaatgggtaaaaccagaatattttttgctgttgttgaatcaataaccaataccacacgttagtttgttaatgaaacatccccaagggtctttcattggaagggatcttcctccctgttttaggcctttgtacatttttaattccacatgtgttacagatttatcaatttctgcctttcactgtactcacataatttatgtttccttttaaattaattaacttttaattgacaaataaaaactgtacatatttgttatatacaacattatgttttgaaatacgtataaattgtggaatgactaaattgaactaattaacgtatatactatctcacatacttatcattattttgtggtgagaacactcaaaatctacagtcccagtgactttcaagaatctggtacttgttattgactatagttaacatgctgtacaatagatctcttgaactaattcctcctgttaactggaattttgtatcattttaccaacatttctctaacccactccttccccaagaaacaatttgggcctggtgctttcaggggagaatttgtcttcaacaattttctcaatttcttatttggtaattggtttgattatattgtctatgtgttctgggagtcagtttggtactttctattgtcaaaaagttgaaaattccaggttttcaagcttgtttgttagaagtacaataggattttgagacatgcaagcagcatcagtcccataagctcccaactcaatacctggaccttttcctgctcctccagctaggacaactaaatcccccatctgcaagctctgcctcagtttctccactccagacttgcttttctctctagtcccctcattataagttggtcttatggtatggagtccccaagtccctatattaacttcctatcaacatcccctccttccttagcaatatatcagtacccgggactgagctgggtttttctgtcttctgctggatttgctttcctagaccttgcagaactggagctccaaacagacacccgcaccctcaatgctacctaattttattatccagagcaaattcatgccctactctggtttcaacatgtttgctagacctcctctttgccacctgttttatttgctaccagggaaccatcctttggagccttctccatgtccctccaattgtaagtggcacccaccggagttatgaaacatggcagtcaccgtccgtttcctttttcaggaatcctttctggcactcaagagttttcaattcaatcctgatgaatgaatcattatttgataccagcctaagtgaagactctgcctggtgacttttgcaaggtaaaagggagaattattttcattcacaaatttctcccctatttcctcctttgaaatgaatttttgattccagccttccatactaggtaggggtttcttggggcttacttgcacaaattttcccttcaacagaaggtgccttaaagcaactagcaacagcgaagagcaatttaagaaaatactgctaaagcacagaagctaaagcagattgattttagtttccaagctgccctcagcagctgaccaccaatatatctgcctgttcagggatgcttgaagggatttagcattttgtttgggcttttgtagcaagaattctgagatcattgccttaatagaagacacacacccaggggagcaactacaaactgctttagcaaaagaatctctacgaactgttttctgaaagagagagcatcactttcaaaggacagtacttttacaacagaaaactttgcaaatgttttaaacagttcttttttaaatgttaccaatcccccaggtggtttctggctgcaacatgggaagatttgggatcagtgagatggaagagatttttctggctactagcgttcctaagaaaggtgatgggggttgaaatagctgcctggtgggtggtgggttctatattctataaaaagtggggagggctggccaggcaggtgttagataagcatgtactggggttttgtgaaggggattcctgctccaggtaaccatttgtattgattggtttttgggagccctttaaaagcacacaattcttgttttttgtttttttttttttgagatggaatttcagtctgtctcccaggctgctgggcttgctgcaacctctgcctcctgggttcaagcgattctcctgcctcagcctcctgagtagctgggattacaggcatgcgccaccatgcccagctaatttttgtatttttagtagagacgaggtttcgccatgttggccaggctggcctcgaatccctgacctcaggtggtccacccacctcagcctcccaaacaatttttgcttttatgttacatgaattcaaaaggaggagaaaatcaatgagggctgacaacactgggaaacttcttagaggaggtggaaatggaaatgctgggacaaaatccagtctggagtcttgtctgccgatttgctgaatcaaaacaaactgtagggatttcattaagatacagattcccaagcctttactccttcattctctaacctttgtaatctaggaggaatctaaaagattcactctgaaatctgtgtagtcactagaagcttggttccttgatagaaaacctgggacacagcacgaaggccccaggtgctcattggctatcccagagatgagttggaggtggagtcttggcatgagcagcaaactgtggggcaaaggagagtgatgtggaggtggggaatagtggatgggtaaacatctgtgcctcaagtggagctgcatctatccacaatagaataaaaggcttgtgaattttggggagtatttttagggtcttgttacccaaatatcggtgcaacagctccacatgcaagccagtgagcttgatgaaacctgcccacaagatgtgctatcaaacttgcttttctctgaatcacagatggcttgattcaccagaacattttaggctcagcacttgctgccatatctctggcattgatgggtgtggttgctctactaattcctagggcagggcagcgctgattagggtttgccagacttgtagacctgtattttggcctacctgttgctttcatagctttggatgctcagagtggaaggtgcttaactaagtaggcatttggatatgtgagtctaaagccaagaagatttcagtgtcgctctggtgaagttggataatctccttatagaattattgcatgaaaagacaagggtaccaggttgctgctgaattttattgtgtcctcttgtccttctggtcagaacctccctggaattttcttcctcaccctttcatggccttctgtcatgcagaagggaggttttgagttcgtatacagatctctcaacagcatgagtcagtagagacagagttaatcccacctgccctggtctctaaatattatttcatatgcttcctgtaggcttggtgctctcacctcctgctgttaatcagaagttttattattgcctcgcttagccaatctgcaaagcactcactccctcttccccagacacgcgtcagtgtctctagcccagggcttctcacgaagctggtgctcagctgttgaataaagtcatgacttcagtgctgcagtgaccacttgtaaaggccatgttttcgttttctcagaaaaacaaactgcaatttaggtacactatcactaggtggaactagtctgttagagcaacttatgtccaagtttgagctctggctatgttgcagataaataagtgcactgttcagactttttctagaatcataaataagtccctttattaaaactgttgaactccaatttagacagcagagtagataattcttttaaatgcaacgagcaccccaggtagagtctgttacctttctttattgatctcttcatttcccttcatcatttcaactggaatcttaacttagcatcaagagtctcttcggtacttttcattcagccttggagctactttgacgtcaaagcccctcagatgcgtatctctcaatgctagcaaagcctgaagtgtaggtctcagtcacaggcagtctattcaccttgcctcgactgtttgagctaattatagagaacaacctctttgcccactaaggaagagaaataggcttcacagaggtgtgatggtgctgaaagtgtacaagctaccccctcccttggtcacttttcttcaaatcagaaaatatactttcttacttgacaccttctagattccctcctcccatcagctctctgaactcgctgggggctgctggcttaatttccacaatagctgcagttaattagtatcccagggtaactgacttcccttagcaacagaagtaacaatggcttcggctcacaaattaccttagctatggttttcttccgctggtaaaacatatttaatactcaaacacaggttttgaacagcaaattaatgtgatgtctactcatcaacaaatatttattaagctcctactgtgtgcaagtcagagaactaaccactgagtatagagagttgaatttgctatggtcctttctcgtgaggaaccaaaaaatgaattgggaaaagaagatatgaaatcaagtaagtctacgacatgatagcattaaatgcagggcttggtttgaagacttggaagttgtctgaggagagtgaaggtctttggggctgggtgaggtgagtcttgaacttgacagcccaactctggagtctgacagattttaattcaaatcctaactttggcactagctgtgtgatcttcagcaagttacttaaactttatgagcttcagtttcctataaacagggaagactaaagttcatttcaaaaggcttatgtgagggttaaaaattacataaaacacctagcatattgctgtgtcaataattacccctttcatcattggtaactcagtgtcaaaggaggctcgataggctttatctaggtgaaggagaaggggatagagtttgcatttgaaggtagtgccaagagcaactgagacaggctaggaaggaaaggcagaaaaattagcttacaccgagaggctgggagtagtagggacattgtattggaaaggtagctgagattttgtcacaagaactctcagttaaaatgtcaaagctggaagggacctttaaaaataatctgatggtccaagcttttcatttgactgatgacacgactttcctttcatggatcctaagtttcctcctaagatttctcttttaattgtgaagtagagttttacttttaaattaaatgtaaaagttaatattcatcttctccatattattcatggttttaaacttccctcacgtttcctctcaacagagctttagtgtttatccagctattggtatgcagacaactatacccttatgagaaacactagcagagaagaagagttcttgactgggtctgggccatgaaactgaccggataaaagtgggagaagaagagatgttgaaggaggagtttgctgttttctcagtctcctgagaaattccaggtttggatgcttcctaaggccattcccactctcctctatctaaaccagagagaacgattgcttgtccttatcacattatccttgctttcactgtaaatgatgataaataataatctctacacttgcatttgcatacagcactgcgtgctttttcaaagaacactcaagtctgttctcacatttgattctcacaccaggcttggagatatttgaggcatctcctccccccaaactcagttggacagatcagaaaaatgaggtccagcaaactgaaatgacttgctccagaactcacagacaattaatgactagaacccaggtcttctaacttcctaccaattattgtgaggagagcccataaaggagaaaaggacaagggatgatctatggaacattcaaactcctgtctctagttgcctttttctggttgtttcttggatatcacgcactctcatcagcagccttcctactcttacagattatcaacacctgtcccaaaatcctggggccagccatggtgcttgggctttttttcccacatctaaccattccgcagcatataacaaatccttgacaaatttccagtggaaaaaaatagcagaaaccatacaccctccatctgtgaattgatgtggccaagaacaggcttatttcaaagggtgcaccatagaatagtcgtaagactcaacccctccaagactagctggtgcttatcccgcccataggcagttaaaaggactttatttgcatcttattctttccaacagaaaggcaaacattattattacaattcagtaaatttccataaggaaccccattgatacatgttgtatattttgggttcttttgtttcatactgagcataccaacattatatcaatattatatttatctagcattctcccatattcatagaaatagagaactcatcagcctttaaaaagaactcaaatgcacacaaaatttcaccctctagaaaagcatcaatgaaaatgattttgcaaatatatatacttttcaatatgtaagtatctacaaaaaaattgataataattaaatacctgtaaagtgccatgcactttacctgtatatctcatttaattctcacaacaaccctgtgaagtaagaattactacgcccattttatagatgaactagctaggagtcaaagacattgagccacttgccacacatttacagcacggagctacaaagatctgggacttgaatccagattttctaactccagagccaaagcttttcttaatatgccacaggagcaagcacaggagcttgctccaaaagtcaagttaatttttaggaaagaattaggtaagcaaatattcatgaattagagaatgtctttaatttcagatccaaatcacttggtcacttaaaaataaaagacaataaatcataagggattctacttgacttattatctaaagtgattaataagaatgacatttccccaccaaccccaaatgaaaaaatcaatttgggaagtttcccaataatttaaacttgaaacactaatctgaaaaagaaaatctatatatcaaaagtcttcatagtatggcacaaataaaacagaatcttaatttccaatttctattaaactgatttttcttttaaactggagccagaaagccaaaaagccttcaaatcaattgagcctcttgcattttatttaagaggtttcatttttcaaaccaaagctgggaagacaaaacaagcttatttaattcacaccccagaattgtaatttctctgttcaagccaatgtctaagtgcctgtattaagggcttcccactgaccataatgtgttaattcatcattgcacacaattttcctttgtacttttaagctactcttcattttccccttggttagggttgcctatacaacagaggacacccagtaaaacataaatttcagataaacaacaaatagtctttacataagcatgccccctgcaataattgagacatacttatacccccaaaattatttatctgaaattcacatttaactagacatcctgtatttttatttgctaaatctggcaaccctattcttgatccattgtgggtattcccaggacttcacctctaaactattatatttttcaaatacattatttgtatgttttgtggtgtgtatgtgtgtgtgtgtgcacgcgcgcgtgcctctcagaatggaggttctggagcatctctcactcttgagaccacagccatctatcactttggttatcaatgtgtcctctatcgtatatataattatgtattatgttatatatatatatatatacataatttagtgtgaaactagccaggaccattttgaaaacgaaaagtcagtggtgggaggtgggaaggagtgtgttgggagaaactttacccaccacgtattaaaaggtattataaatctatactgattaaaacagtttggttctagtatgtgagtagataaattaacaccacagaatagagattacccaattctttaccccaaaataagttctagaaatataaaggagtcaaatggaaaatgcaattgtaaagacaccaagagaaagcatggaataattatatgtagtcttgaagtgaaaatgatttttctaaggaagatgcaaaatccaggaagtaaaaagaaaaatttcataaatctagctacatataattttcaaaacttttttcatgtagaaaatataataaatgcagtcaaaaagcaatttaggggaacatcttcaatttatctcactcagggtggactaagttatttaatatgtaaaaatctcttgcaaatcaatagaaaaaaagcaaaatcatgaatagaaaaatgagtaaaggctataaatggacatttcactgaaaaacagccatacaagttaataaacacacagaaaaagaggcttaacctcactgatgattaaggcaatgcaagttaaagcaataatgaaacatcatttcccttcattatattgaaaaagattaaaagctagataatgtgtagtattgatggggatagagagatgggcatttcataacttgtagatgagattataaattggtgcaacgtctttggagggcacgattttgcagtatcttttaatatgaaaaatgtatttatccttgactaagtaattcccattctagaaatgtatattatgaaaatacttgcacagtatgcaaatgtatacaagtataagggtgtccattgcagtattatttgtgttaatgaaaaatgggactaaggcaaatgtctattataagagataggataaaaaatttagtgcatattcatatattgaaataatattgtcaattaaaaaataaaactgatccacatgtgtggaaataaaattatttcccaatttaatttgttgaaatttttaaaagactcacaatggtgtgcaggtgaatgcccttttttaataaggaaagatgcatatatgtacatatgtttgtatgtgcagaagtagactggcttttttatatccttttgtactctgaagctttctgtatgaattgcatgtattactttttcaataaaaaacctaatctataaaagatacctacttggggtcttttttttaagcttgctgaactcatctctgatttcttctcttgttcttatctcaagatctatttcccagttatcactgttgcgacagtggggccccgcagggagctgatgataactggtggcttgctccctttcataacacatcccagcaatcagcaattcaatttccttgtaccagaaaggccctcagttgatgttcgcatccaagaatgtaacttcctccaacccgaaaatcttagggggaagaatatatccctccaacagtgaagtttaggacattttgcacttcttcgatggtagcaaactcccacacccacagttcttgggttcttttctgactttccagcagatgccactctcctcagtgcctttctccatgttcttatccctttctagaatgccctcccttgcctagttggtgcttcaaattttacccatctcttaagactcaagtcaagtctcacttttcttccaagttgactttcatgattacttcaaccttattcaaacaccgtttttttctttctctttctgtcttattttcataaaaatatattagacattctaaataatactttcattacaacatttttcttacatgtaactaacacaacacaggaattaagcatatgatgttatacaaataacactggttttagagtcaaacgggtgcaaatttttttccaactcttacagacctttaggcaaattgattaaatcttctgcatctcaatttctacatgttgaaagtgtggataacatcatctaccgtatagggctattatagatactaaatgtaaagtgacttgcaccatacctcatacattatagatgaacaactcttaacctaggagtgcccccttctctgatccaacccctttactattattgagaaaagaacaacaaaaacttgtagttaataaagcccagaatgaaacataatgtgcatattgtagatttttttctttatttttgctcactttttttgtggctttcttattccttctccttttcttatctcaaaatctattcatgctctgcctctaccacttatcatctgtgtgaccttgggttaattaatgaaatttttagagcctcagctttctatcctaaaattgggttgataatgttgttcttgtaacaggtgttgggaagtttacaggggattatgtatgtgaatgtgtaaagtgtaaagtagtaaagtgctataacaatttgaagtgttcttattaaatgttcatgtagagtgagattttaaagtgaacaaaagcctttggagtcccaatgatttatttgcagctcagattgatgtgtcgtttttagttggttcacaagccatacttccagctgtcatccatcaacactttggccacagcctgttcttggctgcctgtctgtatagaattagttattcttcttagcacagcctagttttctccagacaaaatcccttctttccaaggacagatatctcaccgagtattcaactgacagacctcttcttttgaatctgccttgttccttcttgcacatttttttgtcttagagatgctaaaacattttttaaaaattcattaatctacttagtccacaaatatgtattgggcacctactgtttgccagttctgttggctaagttttggggatacagaggtaaataatgtacattcccagccctcagacttcacagttgagtaggggagagatgcataaacagatgtttatgattcattttgtgtgataaggataataataaaagtgtttacaagctaaggaaacagtaagttcaggaaaacttcctgaaggagatgtcattcaaattttaaaggatgtataatattttgataggcagataaggaagataaggatattccatacagaagatacaaggtatgaaaaggtacaaagttgtgaagcagcactgggtgtagcaagattatgaagagttatggaaggagtgttaggagatgaagtccaggccagttttatggaagtcactgtagctatgctaatgggtgtggatatagggaatgacaagacagtaagcgtttcaaaaaagagagaggcttaatcagtccacggcagtggctgtcaaccctcaccatgcataagaattacctggggatcctcagaaatatgatgttcagggcctacccatgagactcttacataaccaatctgtgttaaagcaaatattttggctttttaaaattgtcctatggcattcttaaggtgaatccagggttaagaaaatgaggcgctgtggctcacgcctgtaatcccagcaccttgggaggccaaggcgggtggatcacctgaggtcaggaattcgagaccagcctggtcaacatggtgaaaccccgtctctactaaaagtacaaaaattagtcgggcgtggtaatgtgcgcctggactcccagctacttgggaggctgaggtgggaggattgcttgaactcagtaggcggagtttgtaatgagccaagaatgcgacaccgcactccagcctgtgcgacagagtaagactccatctcaaagaaaaaaaaaaggaaaagaaaaagaaaatgagtgtagagttttcaacagataactttgatgatactatgaatgatgcattgaagttccagaaagggcaaggctagaagtaagcagacaaaaaggtggtgacatgttaaaaaaaatcaattgttaccttccccaaacacatcattagcttcataaagactcggactatatttcataatttttcagtgttgggcttataactatagtaggtactcaataaaaactttctaatagattgataaccaataaacactaaccacttaccactggtattttttttgttgtttcccttgctccactcacttggatactgctaagtgtgatttcatgtctccttcctagaatccattggtgtatacaagagccatagtatatttttaaatgtcacacctccagtaaataggaatatatatatattatctctctctctctatatatatatatctatatatctctatatatagatatatagatatagatatatatagatatatatatatagatatatatagatatatagatatatatatagatatatatagatatgtagatatatatagatatatatagatatatagatatagatatagatatatagatatatatagatatatagatatagatatagatatagatagatatagatatagatatatagatatatatatagagagagaggtgaggggagagaaagcaagaaagcaacatggtaaaatgtttataaagagtgactctaggtggagggtatatgggcattattgcacttctccataggtttgaaaatttttaacataaaatgttgataatgccactgaactgtatagtttaaaatggtaaattttaaattatatgtattttcccacaataaaaaatttggaaatacagattatgttgatgaagacaaggacaaatgagcaaatgggctgatgacccaaagctgggtatgaaaagagaggaacacatggatgggaatggaaaaggtggataatagaatcatcattctaaagaatatcagcataatagaatcatcattctaaagaatatcagcatactggtatgatgagtggaaatgaacaatttcttagtcttgcttaaaggtttagaacatcaactgcacatgtagaggttggtttgtcatgccagcaatcggtgtgaaaatgccctggggcttttcacttactctgagcctgatgtaaggcaagggtgtgacacagttgctaaataaagctatacaagttgagctatcagcaatagactctgaatgtccaaaacaatagacatttgagtctaacagtttgtcctgcaggtcaagccatacctggaacactgcattccccgaaagaggagaacttactgacaagtgagtcaacaagatggggaaagtttaagaagtcatccaattttagacatgggagagaatgttgtgtctgattacttgtctgcatgagaaggattgctcagaaagggagaagcaggtgcataggtaaataatctgtgtctgttacccagaaaacaagaagctgagttaaaggctgaataatccatagggttctcaagaactagacccaaagggttaacagtgcaaaattcccaaaagcctggccagcagctgtgaggcaggcccactgcagctgctgctcggagcttggccccacagccctcttctcactccttttgccactgtctgccaaagtcagggtagggccctgagaagcttgagaagacaagacagaaaaggaacatgaaaattcccttcaaaatctatagggctaggtggcaattattgctaagcccagtttacagatgaggaaactaaggcttagaactgaacaaaagtcacattgctaaggaatggcagaaatgaaattgaaactcagtatgtaaatctattatgtgtcaataaaaatatgtaagaatataaaactatgaatccaggtcatcattcctttatgagtttatgtaatatttattgagatctacttatggtaagcaccagagctacaaagatgaataatacatagtccttgccctaaagatgcttataaataccttgaaacagtgcagtcagggttaaaataggggtcttcacattatgttacatacttatgtggtaaagaactgtattttaactggagctgaagtataagacacatggagagaatgatgggaagtacatctggaaaattgatttgggcccagattttgttggtctgactgtgctatgccaaattgggtggactttgtgctgtatacagtggagaattataaacatttctaaagcagaggaatggcatggtcaaatcttcttaacaagataactctagaagcaggtggaggatcaactggggggagctgggaagaaagatcactaaagtggggattgtagtagctcatatgagagaaaatgaaggccagaagtaaggcaataacagtagaaatatgcaagcatgggtataaacaaacgtgagaactttttggaaggctgagtaagttacactttgtaaccaattagacatatgggttaaacataaggaagtcaatgatgatgtcagattggtaaaacatttgacagttaatgaaagtggagatccagaaagaagaccaggctgaaggaggtagatgctatttggcttgggatacactgatcttgagatgattctataatatccaagaaagaaagtccagtacagctagaaatggtactgaagttgaaaaggaatatttcgtaaaagtaagagttttgaaatgataagctcttggttgaaactaaaagagaatactgagtctgttttaggaagcatagagaagagagaagagatgaggggagaagaggggagaaaagcaaaggggagaaaaggggattggaagggaaaagcagggaagggaagggaaagcagtcatggacaacatgcatagactgcgttatgacacgtagtaggtatacaacaaatgcaattgtaaattaaattaatgtacaaatgagtgaataaaagaagcccaacaattgaagattgagtagaagaggagccagaaaaagactgagaaagggcaatgaaagaagtagatcctcctacaggaaatggagttgtgcatgccaagggagaataaaattttgagactagaattggatgaagagaagaataaaacggcaatgaacaattgccttaagaggcttgggatctagttaagggcctgaattcagtcattcatgatagcagcatacatgattaacatgatacaattaacatgatcattaataaactccagaaacaataatgaaaggagagaagggatactgacacagcatcaagcagagaagcttcctctgaaggagagcattctgactgtaacttaaaggaggagaagcttgaactgctgagaggaaagaaaaggaaaacacagatgagtgaattggtacgcataaaggcacagaggctggaattgactcaagagagtaagaagttggaacttccttaatatttggattaggaaaacctcgcatacaaccaggcagacccattgtggcaccatcattgtcctaatgtcccagtctgatcaacagaagattgtaatattggttagaatcctgttcttctcttctcacaccaggctctgctccccaacatttaccccagggataggtacacagagtcaggatagtggagtttcttacccctcaggccttaattattgcactccctcagccaaagcgaatacaattcttactgcttgaaatccccactctaggtttctaaatatgggcagtaagtgtcaaggctggaaataatttggaaagggttgtggaaggagagccttgaatgtcaggctgtgaaattggtacttgatcctgtaagagtggggagacattgaattctattgagaaggaaatggcacagtgagaactgtgatttagaactgggaaactttggttttgagggtccttaacttttaggtttggattattacatgaaagccacagcgagactgggccccagatctgacccctttcctgctatctatgtcaagacagaagttacagcaaggaagaaaggcaagagtgaggatgcagtatatctggtctctttacagcctcctgggctctgcagtcttctcccagcttcactcaatttcactgtcatctcccataattttatggcctgcccttcccagaaggaattaaaaataaaccataaatataaataaatgtggagttcaaaacattcttatgccataagagatcactgaggttgaacagagacattagaattaggattgacaatcataaattgagaccctcaccaatctaaagacaagaagatctctcaaattagatttctatctggatctctgagtctgtgacttgggagttctctcccagatgccttttggaaatcatgggagagaaatcccagtgtagcagaaaagtgccttcaagggatgactgattcctctcaccattatctttagcttaactccctctcttcaggctgttaatcctcttgtatactatcattacgatagggaatttgggcacggtcattctcattgggatcagtctcggtttatatgtctgtctcgcctagatttctgctattcactttttccatgctcagagtcctagtaaaatgtttttgaagtacagtgctgcccttctctttctggagtcttgaagcacagattaacttcttcagcatcttgtgtatcacagagttctttcccttggccacaatggcctatgatgacaatgttgccacttgtgaacctttattccaccctttcaccagtttgagactcaactggcatttgtttgagaaaaactgtatcttagagccttcacctcagccctcccctcaactcttccgttccacctccccttcttcaattcccacttgtgctcacttcagtgacattactttctgggtcaagttgtcctctgaaacatgactcccaactttaaactccctgatttctctaactccaatgtgaacttagtaagcctgtgctgtccaaccatctgctgctaccccatcattttaaggtcattatcatcccataactaatctgaaaaacaaattattgataatcattttttttcagaattccactcattgctctttattttctgttcagatgaaaatgtttattaaaccatttgaggtatcactgactagttcattaaaagtaaacattgtgtacatattcccttaatgcagattctttatgcattttacaagcattaaatttaatacactactagcaatggaagacttacttgataataagaggcatgttcaaatcttggttattaaaatgtcaatatgcaaattgggcctactttattgtttttactgaatctcagaaatctctgcatgacttgcataggtgcaaacttgtaccattttcttcagtgacatagctgatttcttatatatcatgataccatgaaacaaagtccatcatacagtaaactgaggctcagagaggttaaatctcaaggtcacacaaatggtatgatggtggagctacagtaccactgggatcctatgtatatttccagagcgtgtgccttttccactatatatttgtgacctgagatcagggagattcctattaaatgagaattagcttggcggtatatcatcctacggtgctttaaaagagcttgaaatttaaagtggcttgattgaccatttgacttgcttctgacagagattatgagagacttaaaccttatatgtagcaacaaagtcagcatgttttttgaatcaacaatttgcagcctggaatgtgatgtttatgttagctggagtgaaataaaaatcctacctctctccagtcgtaatggcagtcagtcagaaaatatgattttatgtatggcaggctattttctttacacccaacttgttatgaatgcactttatctataagccctgcatgactgggacctgatttcctattgcaattacttacacatttccttgttgtataataaatcttaagcgtactagtccccattgctgtgttagtgcacttcatagctcagaaggcactcaataaatgtccaatgactgcctccctgaatcatgtttctctatttcccaagcccttccattccaccactagaagtcctcatccacaacatggcagtagaatcaccttgactttccttgaattagtcaaatacctttattttgttatctgtataccttttacatttatgtgcatttgtctgaggctttaagagcctccaaggcataaatgttcttttgctgagtattttccaatatatggttgtaccacagtctgtttaaccactcaccctttgaaggacatttagattgtttccagtttttcactgttatgaacaaagctgctattaacaattatgtccaggttattctctgaatatatgtttttattgctctgggaaaaatgactgagaattcaatgacttggtcatatggttaagtgcatgtttaacataacaaggaactaccaatctattttctagagtggctgtaccattttgtattcccagcggcaatgtaaaagaattccagttgctccacatcctcaccagctcttgtactccagtatttttaagacattctaatagttgcataatgttaccttatcttgcttttaatttgcattcacctaaaggctaatgatgttgaacatcctttcctgcatgtatttgccatctgtataccctcttcagtgaaatgtctgttcatgccttttgcccattctctaatttgatgattttactgttgagttttcatagttatctatatactctaaataaaaatcctttgttggatatatgaatggcaaatattttttctcagtctttagcttccctttttattttcatgacagtgcccttgaaagggaaaaaggttttaattttaacaaagaattatttatctacttttttggttttaggtattgtgttttgattttctctctaagaatttttcatccaaatgcaggttatatgggtttttacctatgtcgtccaaaagttttaaagatttgggtttgatttttatatatatccaccattttcaattaatctttgtgtaagtgtgaggttaaagtcaaggttcattttcgattttttgtgtatgaatgactacttgttctatttgttgaaaagactactctttccccaatgaattgcttttacacctttttcaaagattaaatgtccatatttgtatgggtctatttctgaactctccattcttttccattgatgtgtttatttctttgtcagtgcacactgtattcattactgtacctttatagtaagtcttaaaatgagtagtacgagtccttcaactttgttcttttttttcaaaattgttttagctattttatttttcttgtcctttcatacaaattttataatttagagttttagaaattcctgttgtctacagcaacaatagcaacaaaaaacctgctgggacttttattactattgcattaaatctatagatcactttagagataattgatacctttattacattgaatcctccaatccatactcatggtatgtcccaccatttatttaggtcttttttgatatctttcatcagcattatatagtgttcagcatacagatcttgcacaaattatgttacattaatacttaactatttcattgttagagccattttaaaaggtggtgcatatatattgttatacttttgattctcaattgttcattgcttgtatttagaaatacaattaaattttgtgtcgaccttgcatcctatgacactgcgaactcatttattagttctaggaagtcttctttttacattccctggattttctacatagacaaccatgttgtctgcaaatagagacagtttcttccttttctatcagtatgtccttccttccctcttccttccttcctttattcccttccctcttttttcttttattctgttctattaatttaatttaattttttaaaattttatcatttaacagctttattgaggtataactgatatacaaagcactgcacatatttaatgtgcataatttgattaatgtagacatatgcaaacaccaatgataccatcaccacaatcaaggtattaaacatatccaccacttcccaaagtttctttgtgtccctttgtttttgcttttgttgttatgataagaacactcaacatgagatctaccctcttaacaaattttgaagtgcacgatattgtattgttaactataggcactatgttgtacagcaaatctctagaactttctcactttatataaataaaattttaaacccattaaacaattccccatttttctctcctcccagcccctggcaactactattgtgttctctgcttctatcagtttgactattttcgatacctcatataagtggaaacatggttatttgtccttttgtgactggcttatctcacgaaatatgccacttaacttattggtgtgcttcattatgccaaaatactccaggttcatccgtgttgtcacaaatggcaagatttccttcctttttaaggctcagtgatatcccattgcatagatatactactacatttcattatctactcatctgtcaatggacactagggttttgtctatatcttggctattatgaatagtgctgcaatgaacatgacagggcagatatctcttggacatattgatttcatttcctttgtatatgtacccagaagtgggattgctagatcacatagtagttatatttttaattctttgaaaaactcccatactgttttttatagtggctgcaccattttgcatccacagcagcagtgtacaagggtttcagtatcaccacatctttgccaacgcttgttatcttttgtttcttgatatggtatattttcttttttactccattccaaatattttctaattccctttgagattgcctctttgattcatggattgtttaagaggatgttgcttaatttccaagtgattaaagatttttttgctatctttctcttattgctttttagtttaaatcaattatggtcagatactatatgtaatttcaattattttcaagtgtgttatggtttggtgtatgatctcagatatagcctattttggtaaatgtatccctctattgttggatggagtgctctacaaatatcaattagttccacttagctgatgatgttattcagtcaaatacattttattatattatgatcttaacagaaaatgttgtttactgagtactttctatgttaccagtgctgtactagataattacatgcattatttgtaatacttatttaaatgctacaaggtaaatatttcattttacagattagaaaactgccactcagagatgttgagtaccatgcctaagataggacaaaaataagactttgagaccaatatttgatctaagttctgttggactctgaatattatgttcttttcattataccacccacttttggcttggtatatgtactagctggcatgttgtttagggaatcttcttcatcttattcataagtgtatattttgtcttgccacttagattgtaagctctctgaagttaaagaaagactgtcttttttttccttttacttagtgcctgttaaggcttcaatgtacagtaaggacttgatagttgctgactgaaaaactgacggaaaagtccttccaaaagcctcagcgggagcaggatgatggtgattgtagccagtgtccttgaaggggcaacatgttgaactccagatccagattatctattgttgtttctcaataaaggtgttattgccatgtggagtgaaatcactcttattataagaattgctcaagacagtcctgagcactatggaacatttagcatccctggacagctgtggtttaataataattcttctgatcattttgtcaatcaaaaaaaattcgacacaattccaaacatcctttataaggggaatatcacctcagccaagaacaactaacagtgcctggtacatatacatttgataaaagtttgttacataaaagaaacagaaagtaccgctcaatgaaggtaccacatatctttgaaaattatgatagagcgtgtatctctcctaacctctttgtggggaagggatgaagatggtgcctacagtcactcctgaaatgccttttacttcataagattccatgagtttgtcctgtgttgcaggtcactatttcaatccatttcaatgatggccaagattctatagataaggaggcacttgtgagaatgcaaagataacagtccctagccattgtgaaaagaccactccctgactgtcgtattgagtaaaagctacaaattcttgctcagatcctgtgaggaattaagcaactagggctaaatatgctccttctgaacaggaaacaggaaaaggaactcattaccccaaactctaaattcagttttcaatttggtaatttattagagtcacttgggaaactttttacaaatatggatgcccatgccccaaaccagacagcagaatctgaaaatggaacctgtgtacagtatgttcttaagctcttagatgagtttaatgtgcacccagtgttgagaactattcattttaaagaaaaatgctgagtagattggcaaatacattttcttaaaagatgatttcagtgttctatggcagaaatagcatacgttgtacagtcagaaggacttcaataatcattcctggcttagttacataccacccatttgatcctgggaaaattatttactttatctggttcactttcttcatctgtaaaatagaaataaaattgtacctatctcatagggttgttgtaagaataacatgaaattttgtgattaaatttagtacaattccttctactgactggctcaataaatcttttaaaaatatgtaacatgaaattgtaacctccaagctacacaaaacacattcaggagccagggaagagtaggagaaaatttaatttgggacagcaaatggccagatgacatcataactaagagaggacattcatttcaaggaggacagtaaaaccttccatgttccaggctccatgaagatgaattttctggcctcattcaatgcacactggtgaaaggacatctccagaatctgtccccagtataggtaactcctccttcaagccatcagcacagcaatacaaaatagggggaaatgcatttgggtatcatcaagcctattcttcacgtcctctcaaaatgcatggcacagatggagaaacaaattaacgtcagaaaggtcacccacttagacattgctagaacggaaatggtttcaactatgcataaatccacaggcttcacaatttggaggactaatttgctccactacccccaccaaatagttaggaatggtgcagtgctcagtagaaaacacctatcagaaaaaagcagggactgcactgatgccgtggtttgaatctttataaattaggcactttatggcactatcagaattttgcttctatccactgagagacctttggagtttgaaaaattgatagcgcacaggcctgagtgcccagaaggtattacttctacgttattcaaatgtctacaggcagcgacaacggatcaagacatccccattaatatatcacaatgcgggaaagagatacgggcctctagatgaaaacatttgggcaccaatttggtctgctgacacattacctcattcatccctgagcattaatgagttagcctttaagttgttatcccatcacctccatttcagcaaaggctgctgatgcaatgaacaaaatggctcattttatcctatgtggtggtgatgtctcaagataattaaatttggggacagagttcttcaatacataaagtcagctcatcatgccacagcagaatcccataaactggttcaaatatcacctaatgtactacatttaacttgagaaaaagaataatttctctacttaaaagggctacaaaattctgcataaccaagcaatagaattaaatgaattggtccacaagagagatgtttataaagtccactttttaagcaattttcttgccttaaaatcaatagctcgagcccttaaaatgcataataacttgatattttctacaaaagctgctaatgacctagcactagagtgaggctgcttttgcctttcaaaaaacaaaagactttgtgtgtatatgttgtgtgtgtgcgtgtgtgtgtgtgtgtgtacttatgcacgtgtgtgtgcatgcaggcatgtacttaggagtgaaaatggagtgtacataggagatacaaattaatttacttttgattttgtatccctggctcctagaataataacaagtacatgagagatggttaataaacatggatttaattgacaaaataaagcaaatgcatggaaataagtcttgcacaactcaaatctgatttgagaaaaatggaaaaggatggtacaaggcaactggcagccacatacacccgaagtacaagaatatttattaaaacactgagtggcactgaggaactttactgacctcatgaaaactaattaaataattctttgatgcttaaaagtaatttacagtttataaagggttgcataaacaaggtgatatgagaggtcataaaatgaaatatattcttagtagatcttctgtattggccattttgcacataaatcctagaatccctatgtttgggaagagagctggtattttaattgtggctgagactttttaatatgactaagaaggcattttagataaaaagtttatatcacaatatatctcatactcaattttattcttccaactgttcctaaaacatctcagtggtgactacaggtccccacactctcagtatgagtcagtgaaaacaccccattggggatggctctgcttaatgctccagccatgttggacgtcacagctgctcagcccctgggcttacttttctgggcatcccagtagaccagtcaagaaggcagaaactttgctatattaatgattctgccagttacagggaaatggccaagcctggaggaggaaatggggaaggattatacattggagcttagttccagaggctttactgttgtggcacatgaacttttctgtgcctgccaagagaacatctggaaaaagcccaactactgaagctggcctgaagcattttggatgagtacagaaacaagaaagtggctagtgaatactcataacttctagagacattcaaagaaggaaggtgggtgataaaggaaaggaatgcttgtagacaagagtttgaatgtcacacatattccatacccctagtcaacctctactttggccacacttccaattgggaacagtggccctgtgtagaatttaggagacctgggctctatccttgacttcgtcactaagcatttatgcatactctggatctttttatggctagttcctcaccattcagatttcagcttttaatgtcacctcctcagtctttccctcccactctacctaatgttgctcttgaaaccctgagatctctctagtttgttagcttgttttactttctttgcaattttattgagatgtaaaagcatttctttatttgtttgttgtctatctcttcctttagattgtgaagtccaagagaatagagacttgatcagtcttgtttactcctttactcctagtgcctattgcactgcctggcacacaccaaggacccagtgaatatttgttgaatgagtgaatgtatgtatgcccatggacaacgcatttaactttctgtagcttagattgatcatctgtaaaattaatagaaaccacttgattatttccaagattagcatgataaaaagaaaggataaatttgtaaatctcttgaaaaaaaccttcataatccttaagtgtatgacactatgttcagaaaagtcaacatgggtaaaacaatagtattcgaatgttgcagacgtctgcttaaatgtcagttctgacatgcacccagctatgagcccttgagtaaggcactggaattttctaagtctcagttgcttggtttgaaagatggtagtgataatagtaattacttcttaaggttgttaggattattaaataaaatgatttgtggcaattgcccaatataatgtgtggcacctattaggtactttattaatggtagcaatttctacattcaggataaaatgtaagtttttaacaaccagtattatactctgtggaaacttcactttccaaaggcagccgtaaaggtcactgtaatagaacaccaaccaaaaacaggcaatcacagactcagagggacaggggcacccaaaatttccagagaacaatctaattttatcttctatagtctgaccaggagcccagaagaagatggaggccagtgttatgaaatccaaaatgggctggcaggtaccagggaagcagccaggaaggagagggctgaagagcagtaatttaacaattgtcatcgaaagttttctaaaggtgatttggttctcagtaatactctctgagtatctgctctgactatatttatagtttacaaagcatttttctagagactttcattggatctttgcagcaaacctgtgagattagagggcaagtgttattattcttattttacagatgaaggtcctatgactcagatagaatttactaagcactatagagctcaaatagtatatatcggaactcaaacttaggtgttctgactctaaatccaatgatataaaacctttttgcagtgctatagtgtgtccttccctaccccacgttctgacagaaaaaaaacattaagataaagtacagtcctcactcataggtgggaattgaacaatgagaacacttggacacaggaaggggaacatcacacaccgggcctgtcgtggagtggggggaggggggagggagagcattagaagatacacctaatgtaaatgacgagttaatgggtgcagcacaccaacatggcgcatgtgtacatatgtaacaaacctgcacgttgtgcacatgtaccctagaacttaaagtataataaaaaaaattataaagtacattggcattctccttgattaagagaaagggtagacatgaccttaagcagaattcatgattgctatttcttaggaaaccatgggtgaaacagccccctgtgttctggtgaggacaaaggttccatatttctgaaagaagagaagtcggaggctgtggtccctagggtgaagaatactgtagtcagggcacctgggttgcagtttctggcactccacaaacccccctgggaaactgtgggcaatttttttccagatactttgctaagtgctttacacaaataatctcgtttcatcttcacagtaaattaatgaaataggaaatacttggtactcgcatcttacagatgaggaaactgaaactcacacaggttgtcatttgctcaaggtcacacagctagcaagttagaaatggattctaacccacacatggctgaccttcgagcttgtccttttacttctgtactatagtatttgatattgcccttcaacctaccccctgctccctgccaaccaatatgaaatatgataatgaaaagactaagaagtttctagggtccttcctatgtgtaatatttgtatccttgactttatgtttaggctgggcattacctgaggacaggttcaatgttgggatgaaggagagtgtggaaagaaaaagataattagaactcattgagaaacctgctcttcttctcatgccatgctagacattttacatacactcaccaccaccttcaatcctcacaaccagtcttacaaaataggtgttttatccctgtttacagagaagactcagagagattaagatagcagccctaggttgcagatagtaagtggcaaagatgagattttgatccattcttctgactccaaagttcatcctcatgcttttaaaccttgtagccaataggctggagggtggcaagagaagagtgagccagatgcagcacttgccatagtaaacacatatgacgtgtcatggcctggaaagcaaggcccagcccccataggtctctctttaaagacttgagctctatgtgtctcaccattgtgatgcattgtgaattcttcctcatggacttgactgatgatcctcagcttcatcccaccttctctgccctcttcctccccatctatgtagtcatggtgatggaaacctgggcctccttgccttcattgtggtcagtccccaattcctcacccccatgtatttcttcctcagcaactggtcctctgttgacttctgttattcttcagtaacagtcccaaaaatatcaatggggttcttttctgactgccaagtcttctccttctctggttgcatggcccagttaagctgcttttaaaatatttgctgacaccgagttcttcctcctggcctccatggtctattaccgctaagaggccgtctgcaatcctctgctctaccatatcaccatgtccccaaagctctgcttgcagctggtggccaccagctatgaacatggtgctccctagtagcacaatctttcatctgatcttctgtaagtctgtgccatcattcattaattctgttatttcctcccccaccgaggctttaaaaactctcctgctctgacatgcaaggccttcaacttcttacctttgcctctagtagctttaatgtatcggtgtcccggacaatcttccttgtctccatttaattatgagaatgccctcggtttgaggcaaacacttgtgcttcccacctgacagcagtcagcctgtgctatggaaccacagtgttccttcacctgcacctatccttgaagtgttcaccagacagagatatgctggtctctgttttacacagtggctattctcatgctcaaccccatggtccaaagtctgaggaacaaggatgtgaagaaaacatttgggacttcctcatgaaggtttacaattcctctccttccccacgcccaggtccccacgctgtccaaaatagtaaaggagggtaagggaagggaaagagatggaagtgatatattttggtagccaaatgtgtctcagacattattctaggaatttaaaacaggtcgtgcattgaattttcttcacaactctagaagtcaagagttattatctccacattagagatggggaaactgagactttgaaagatttggtgatttgcccaaggtcgcacaaattctctgcagtagaatttggatttcaattcaggactatttgactctgtaactccctttatattacatatccctgtttcagtataaggcaagatgccaccctctctccatactcttagggtccatgatttccacattttttccctctgagaaatttgcctatagtaggtttcatgtatctgtatccctgacaatcatcctggtctctttttaatcatgagaattaacagtccagactctccaattataataaattcagcctcctaagacccactccctttcccatagttggttcctacatgcggctttagatcatgcccaaccaggccacaaaataaattgaacacctattgtatacaaaaccctacaccagatgcaaagttgaagagggatgaggaagaagaaagctgtggtcactaccttttgtcaacttccaacccatttagggactagtgaagatcccacccataagaaagctgaactatgaccttttatttaacatggatttaatgctttttatgtgctaaatgctaaatcagttatctcatttaatcctcccaggaactctgtgaggtagttgctattatttcttccatttttgccagtgagaatgctgtagttaggaagggttaagtagctcactcaaggtcacacagctagtgaatggtgaatacaggatttgaatccagatctgtttgtctaaagagctcatgttctttccactctggtgtatcacctcctggattattgaagtgccaaccagcaagcacctcctagatttaaactgtgaggctgggactcatgaggagggacataagatagattgggttcataagagagtacttatgaagaggtaggtggcttgaataaaatctagaaaaagtgaagagggatcagcttggagatgagtagtgaagagaaaaaggggaaatagagatcataggctgagatagaaggatttagatgcatagaggcctggtttgtctagagcagggcggaaggcatagttagaagtaaaagacactgaggaaatgaggagatggttgcctagggctgatatctacagtaactttctttatagacctcactatttaccaccatttgtgaaaaggatcttaactggttcctagtttccctaatttgacccaagatggctttgagtatatggctacttagagttgtggtaagagtaatgtgttgtgcagaccaagacccatggctttactctgttctctgtctagagtccagacttttcagattgaccagatgaccagcaaatttgagcccttggtgacagaggccatcaggaaattacttcctgagtcaaaactcatgccagggtacatttgggcagaatctaagcaagtgtgtctaagtgaagtagcttcaagtctaaaggcagccagacttaggtgggtagggtatatctagccccactactagaggatcttacttcctgctgctggcttccttgttagagattcctctgtccgagaggaggcttttctctattttgtcacttgcctggactatgcagtagcctcctaactagtctcactgcctccaaacttgtcccttatttattcatcctccacactgctgccttatgaacattctaaacactcttttcttggaactttaggaccaatgattacagcatgcaatcattctatactcctattgtgctttattctattttacttttcttatatccttattttgcctcctttactagattttatgccttgagtgaaggaccaacatgtctcagacctgtgtaaccaccttagttgcctggaaacaaattgacattcgatatatgctgttcataataagaatgatgactttgcaagtactgtgaatatgtacttgaagctacttcactatcatattaataacattttaatcaaactttgataagatagaaattaatgaaaatatcaaaaataatttttaatctaagaaatttccataaatttggacaaaaactcttctaaacaaaataaagaaaagataatggaaattataaatattacttaatgacatatactgcattgtagggtgcaactaatgtcatatttataagaaaatatgatccatgaaatatgaaacaacataactgaatattcatatgctgaacattcaactcaagaagttagaataataaccaggaagccaaccagaagaaagttaaagaaaggaaataaatatcaacacggaagttaataaaataggaaacaataacaaaaataaaaatgctttatcaagccaaagcataattttttttctttttcttcagtttaattttttttaaaaaagtttacgttcagagggtacttgtgcaggtttgttacgtgggtatattaaatgtgatgctgaggtttgaacttctattgatctcatcacccaagtagtgaacatagtacccaacaggtagtttttcaacccttcccttccttcctccctcccaacttttggaatccccagtgtctcttgttcccatctttatgtctgtgtctacccaatgtttagctcccacttataagtgagaacatgcagaatttaattttccctttctgtgttaattctcttaggataatagcctctagctgcatccatgttgctgcaagggacatgatttcattcttttttaatggccacatagtattccatggtgtataggtactgcattttctttattcgatccatcagtgatgggcaccgaggttgattccatgtctttgctattgtgaatactactgtgataaatgtgaatgcaggtgtattttgggtagaataatttattttcttttgggaatatacccagtagttggattactatgttgaatggtaattctacttttggttctttgagaaatctccagactgctttctacaggggctgaactaatttacactcctataagcattcccttttctctgcaacctcaccaaaatctgtaatttttgactttttgataataaccattccaactggtgtgagaacagataaaaaggaaaatgtgcccagcccattttatgaggctagtgaaatcttgataccaaaaccagataaacttgttagaaagatgaaaaattatacaccagtatcattcttcataaaaagtcttaaaaagtcctaattaaaatattagtgaattgaactcagcaaatctacaaaaaaaatacagtgtgaccaaacaagcttgattccaggaattaaaggacagtctaacattagaaaatttattacaagtcactgcttaagctaattaaagagaaagcaatgcatactaacctcaatagatacagaaaaattaaataaaattcaacacttctgtattgtaaaaaagtgtaaacaaatcaagaatagagggaagcatttaatctgacaaaggatatatatgaaatacctataattaacattataattaatgtagaagcttaaaaagcattctcattagagtcataagacaagatatctactctcaaaactagtatctaacattgtatccatgagatcattgttatttcattaagacaagaaactgaaatagatttaagcactggaaaggacgagagtgtcattattcatgaataatttggttgactacatagaaagctaaaaagagttttcagaaaaactattttaactgttaagaaagtccatcaatattgatgcatgggagatatgttttaaaaatcaataatattcttaaacagtagaaaagcaattagaaaatataactttttagaaagttactattaactagctaaaaataaaataaatagcctgtaatatcaagtgttgttcaggataagggaaaactgcaagaatttgcataccctgctgtgggaatgcaaaatggtgcagtcattttgtaaaagcgattgacaatttcttataaagttaaacatacgcttactatataacccagcaatcccactctcgggaatttacccaagagatatgaaagcatgtccactcacagacttggtatgtgaatgttcatagtaactttactcattatagccaaaatctgcaaacaaccatgaactagtgaatggatcaacaagcttgggtacatccatacaatagaatactactcagcaatacaaaaagaaactgctgatacaaacaaaaaggtagactagtctcaaaaacattgtgctgcaccaaagacaacaggcacaaaggattatatgtcatatagcttaatttatatgaaattctagaaaagggcaaagtattgtgacaggaaacataaaagtgattgccaaggactcaatgggaaatgagactaacttcaaggagaatggggtttttggagtggtggaaatgttctgcatcttgatcataatgactattacacaattgcatacatttgccaaaactcataaaatcaattgtttgtaaagtatacctcaataaagctaattaaaataaagctcccattcacaataagaagcagcactattaagtacataagtctaacaaatgatgcccatagtatttatggaaaatattgtatgtattactgaaggatattaaagaagaccttaattaagggagatagataccattttcatttcttttcttttcttttttcttcctttcctttcctctccctttctctctctctctctctctctctctctctctctctctgtctctctctctctcttgagtcaggctggtctcaaactcccgacctcaggtgatccgtctgcctcgggctcccaaagtgctgggattacaggtgtgagccaccgtgcccagcctaccattttcagatatagcaatactcaacttaaagatgtccaatgtcccaaaaactaatctataaatttaatgcaattccagacgtaatttcaaatgaggtttaacaagctgatcctaaaattcatatgagtaattgaaggaccaagaatattcaagataattatgaagaagaacaagtaggaaggacttgtcctacagctatcaagacttagaaaactgtaataattgaaacagtatagtacttatgcagagagacacaaacagatcagtgggagaaaggaaagacctagacacaaatcagagaatataaggagccttggtatatgacagaattggcattgcaaatcatgggagaaaaggatggattattcaataaatggggtaagaatgattgtttattcaaatcagaaaaaatacaattagattactatatcacatatagaaatcaatttcagatggatttaaaaactaaatcttaaaaacaacttttaaaatttaaaagatacttagaataatatgatctcagtgtaggaaaggatttcttgaataagacacaaaaaacacaaattgtaaattacagattaattagagcatattgatagggaaataaagcctctgtctttctgtattataagataaagataatagacaagtgacagacttagagaagacatttgtaacaaatatataacaaatcaatatggacgacataaagtactccatttagttaaaaaacaaccaacctaaattaacagtgggcaatatattaatgaacaatgcacagaagagaaaatctgaatggctagtaagtagataaaaacatacttatcttcataaataatcaaggaaatgcaaattaaactagcatagtgatactattccatagccatcagattgccccaaataaaaacatctgctaataccacatgccaacaagaatgtgaggaaacagaaattgttatacactgcttttgggaatgtgagtttatacatccactttagagaatttggcagtacttagtgaaactgaaaatatgtatacactctgagccagcaatttaactcttaggtaccttaaagaaatactggaaacaagttcaaggacattccttacaacacttgtactggctaaaatatgttaacataaaaaagtctataattttctaccaccaaaattttttcatgttttcaatttattttctctttcaatttataagaatctcccacacttctattaatgtatccagtgcaacctcaaagaaaggatctgagaaaaataattacacttgtaagactgttatttttagcaagtatgctataaggaaaaacaaacaaaccactagtattcagtataatgaggagcaaggtaaatcaacaatgaatgaatgagaactgtatgtatcaacagggctaggtctaaaaacaaaatgtgaaatagaaaaacaaagcaagttgcaaaaaactattatttcatttgtgcaaaatttaaaacagatgtaatattaccacatattgtttatggatagagtcatatgtaatagaaggataaaaaacatgaacatagaggacacatatcgtcttttaaggtagtggttgcccccggagctcagaagacatgggattggggacgaaaggaaattttactgtacctataatgttttatttctcagaaaacaagctctgaactaaaaataaataaataatggcccatccatatgctagaacactatgcaattgtcaaaatgtatgaggttgatctctatgtgcagatacagaaaaatcaccaagatatattaaatgaaaaagctccataaaatatattaagtgaaaaagtatgatcatttttatataaatatggaaaaatataaatgtatataaacgttggtataagcatacaaaatttcttaaagcacccacaacaaactgtttttagtacttgcctctagagagagagactggaggtctgggattggagggaggcttagttatactgttttaattattcaccacgtgcaaattatgcattgtgcattcaacttagttttttaaaagttcatgagcttaaaatcaaagacgacaccttgtgtgatctttaggttagtattatttgcatatggaacattacatgacacttattggattttcttttaatcaaagttaattttgaagcttaaagaccagcaagctgacaattaggcaggagatgtcactttgaggggttgacaagctgaaagattttctcatttccttcaaggttaagagttatatctgagacatccttgcatctcccactgtatctagtacagagccttgcctgtgctagtaaactattctcatgtgtttattccttaatttgttcacctatgcattcagacaacaaatgttactacagaacaactatattttactgcaaactcaaccatttttcaagcaccttgtgctctctatgggtttctctgggatggccagggatttgggattgctgttatttctatgggaaatgtgagttgacatagaataaccaaatcgcatacgaatttcagggttacgatccatctgtatattaggggatactcagtaaaactattttcttccagaaattgcatttgataaagttgattgtaatgaaaggagaagatggtcttagtgacaatgacagtgatataactaccatctgaagctgtttcctcctctcccttcccaatagccaccattctttcttagattgaagccacaaccttctcactgaactgcctgcctcaaatcttttcctttacttataacttatttgcatagccaccaaaagtatatagctttctaaaacaaaacatacccagcagtgggcttgctggataatatagtagctctatttttagttttttgaggaatttccaaaataaaggaaatcagggtgtcaaagaaatttctgcatgcctatatttgttgcagcactgtttataatagccaagattctgaagtaacctaagtgtccatcaacagatgaatggataaagaaaacgtggtgcatatatacactggaatagtattcagccagaaaaaagaatgaaatgctgtcatttgcaacaacacagatggaaccggagatcattatgttaagtgaaataagccaggcacagaaagacaaacatcacatgttctcacttttttgtgggatctaaaaatcaaaacaatggaactcatggacataggagtagaatgatggttagcagaggctgagaagggtagtgcggggctggggagaggtggggatggttaatgggtacaaaaagtagaaagaataagacctattacttgatagcacaacggggttgactatagtcaataataacctaattgtacatttaaaaataactaaaagagtgtaattggacaatttgtaacacaaaggataaatgtttgaggggatggataccccattccccatgatgtgattattttacattgcatgcctgtatcaaaacatctcatgtaccccataaatgtatacacttactgtgtacccacaaaaaattttaaattaaaaattaaagtaaaaaataaaacacaaacataactattccacttcccgatttgaaactctttaatggctcttcactgacctcacaataaagtccacactccttaggatggtgtacacagctcctgatcatctggtgcctgcctatttctctagttttctctcctgcctcttagtagcacatgctattctttctgactgaaactctttctgtctctagttggtttaacatacttctattcctccttcaaaacccaaggcatcataaagattaataaaataataaatgggaaattgtttggggaaataaacaagaacaatgccaatggcagtcctctccaataggtcttcactggcactacctccctgcaaactgatccggaaattcctttctctgtgctacacctacatgttataaagagtcctgttgttgcacttgtgatgttgcaatttgattgttcatttacatgtctgtcatttccgctagacattgagcctgacctagtggagtgacctgatattgtgtgtgaatgctataactgaatggcgacaatggtgatgttctgagataacagagataacagtcatatctgtgcaagtactctgttttacaggatgctcacacagccatcaaagaaagagaagcctcactaagagctctaaggaaaggttccactccccaaccatttctgtacagcctggaaagtagtgaaagcatataaaaccagcactgaggaaacttacccaggaggtcagatgcaatctgtctaccaaggatggaaaaatgacaaggtaactgttcagaaaactgcctctgacagcttgtgtaagaagacttttaatttgattataaaaaccaaactataacagttgtgcttttaattagatgtgcaattcacttaaggttgactgaaggctttgaggtaaggggatttggatgttttagggtatatttaatgatgtaaaaaagtaagagctctacttccagttctaggagtccaggcctctttgaaccctaagacaaaactatcctcaacttctgtggatgtcagcaacataattctcatgttcatcaagtatgttcctagcatgaagcatgaagctttgtagttaataaagtggtttcccatacagcatctcatttgagtcctacaataaacttgtgaggtcagcaaggcaggagttattgccccctttcacagcaagaaaaactgggactaagtgaagatatgtgacaccaaattgcacaggcagtgggagatctaggtctagaacctagattcttttgccactagtttcagtacttctcacatggtacacttcccaaactatagctctgagctttcggcagcctctggaggccctggcctagagagatcgtggctctgacccatttgacatgtcagatactccaatatccaatttcacaccattagtcagcagtcactgaatggacgttcaggatgtcatgagaacctgacatcgatctctcaattaaaaagcaaagctcccctgagagacaaacctaaagataattggatttcttgtttgaactgtatgtgccagtccctgcttgcagaaggttgttggagcgcttaaaagataaataaagtggcaagcattatgctccttctaaacccaaaggaggcgctgtaggggctaaaattgcttcggccactaccatgtgaaaactaaacgtgcctttgggtgacatactcttagttcttccttgtagaagccttttgagctccagggaagtcagagagaaaataataattgtgcaggtatgaaaggaaagattgggaaactatgattgttaaggtcatgagtgatctttgtaaagaatatataataagataatctgtcatgctgttgctggatctacttcaggtcaaacaacacagtagtggtacagctaaccagctacttgtcttagcaactcactttgggctccactagaaaaccaattatctttaagtttggctcccaggggagctttgctttttaagtgagagatcgatgttgggttctcatgacatcctgactgagcattcagtgactgctgactaatggtgtgaaattggacactggggtatctgacatgtcacatgggtcggagccacgatccatctaggccagggcctccagaggctgctgaaagctccaagcaatagtttggggaggctaagtatttggggcttcacacatatcaatggaataagaagccaggctctaaggaaggaaagtgaacatctctaccatgggctcattaaatctccaaactcaagtggaaggaaaatgatgaggtaattatcttcataatcaatccccacatccatgtttactctctttcctttttcctaaatgatgacctttcttttctgcctgaagacaacgcctccacttgtgtatttccccatcccgtcccctccaacctcctcagagactccctttgcttcatcattcatcctcttgcatgtatttcatatttccttctctctggacctagattctttgcgtagcatcttggccaagtttcttcttcactaagacccaaaacacaagaataaaaatactctctgtcctctcttccacccttagctttttggtgctctctctgcctcctttacttcatcaacaatcttcttgaaattataacccacatttgttgtttttccctttatccccccaccaccaacctcacttcagttgggattcttgccccagctctccaatattcatggcaccttctttattaacaattctgatggctccacttctcccttggactctatgacatcactctctgtttctcccacttctatgacacaattttggaaaatctttctagtctttttttctccaaaaaaatatgagtttccctgcctttcctgtcatctgccccctactcattttgtccaaacactccaaaatcaatggctgacatggtcctcaagttactggacccttttgaccattattctctctccatggaatattctctctcttcttctcctaagaaggttctacttttgctagatacccaccatggctctgaaacagtttatttcattctgccctccaaacccctttttcctaaagcaagttttttttgttacatctccatcatggaaactacctcaatttctttcatttgttgttcagttcagatggtggtaatctccatatggctcctattatccagttacctgacaaaaactcctggctcgtaatataattagcatcttgtaaattcaaaattacatcaacatgcataagattaactttttatcttcaggaaaaaaaattaaaattgaaatacaagtacaatgtgctgctgtagtaatcatcattatcagatttctcatctgtaaattcagcgagacaaatcaaagacctattctcaaatacctcacaagatagtttggaagattaaaaataataatggatctgaaagttatttgaaaagtattatgctccagacatgtaaattactaaaagagaagtaagtcttccttcacagacttatgtagtatacattaagatccttgttcagggcactgaaaggagatgaaaagtgagtaaaaaatattacagcatgttgtaatggaaggagcaagaactggaaaatgagacttgggtgtcagttcttgccattactagctggatctgagattctaagaaagacactttacctctttgaatcttctttttcagttataaaacttaagcgtttatcaaatgaaactttaaaagtcctttccgtctttaatatcctatgacttcataatcagtggaagtgggaaagacctcatatttatcatgtagtctttcattattactttttttgtgaaaatatctcaattttcttgtcctccttttcttccattgttttaacttggcaaatcccaaacttgattttaaaccaacgatatctacttactctaccctgttagctaaacattgccaaagaagaccactcaagaaagcaatctggtttcaccttcttaaattcatgatttcaatgatcaaatttcctctcaatattacccgaaaatcatagtatttgttctaagtagtaaagccttctcacttccagatatgactattttagttttccctctgccctcaaactcccaacatgccctccccacccctcactcttatatcatgaccttttttcgtacttcattgaggaaacaaaagccatagaggcaaactcagtcatcttcctaagattaaatgttgcaacttatctacaatggcatctgttttctctggctttcctcctgttaaaaggatgaagtgtttctgcttttaccaaaggtgaatgccttgacttgtgttctgtatcccatcctctctcactttctaaaagattttgctccaaaaatttatttcttattttcatatgcatcatcaatatcccctctatgctgggtcattctcatcagcatacaaaaggtagggttaatgctcatctctctatagttaccacccaatttctctgctccccttcagtccccatcactcatcactctactaaatctattattcttgtaactaaatgtaagagactgttttttgtcttcatcttaatctcacaacagcttttattaactcagtcaacaattctcttgaaacatggattctgttatttgatttcctcctggttttcatccaatctcactgaatcctccttttttatctcctttcctgccttctcctattctgttagacctaagggagactcttttttttttttttaattaatttatttttttttattgatcattcttgggtgtttctcgcagagggggatttggcagggtcataggataatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggataagaatttttcttagtacagaacaaaatgaaaagtctcccatgtctacctctttctacacagacacggcaaccatccgatttctcaatcttttccccacctttcccccctttctattccacaaaaccgccattgtcatcatggcccgccctcaatgagccgctgggcacacctcccagacggggtggtggccgggcagaggggctcctcacttcccagtaggggcggccgggcagaggcgcccctcacctcctggacggggtggctggccgggcggggggctgatcccacctccctcccggacggggcggctggccgggcggggagctgacccccccacctccctcccggatggggcggctggccgggcagaggggctcctcacttcccagtaggggcggccgggcagaggcgcccctcacctcccggacggggtggctggctgggcggggggctgacccccccacctccctccctggctggccgggcggggggctaaccccccccccctccctcccggacggggcggctggccgggcagaggagctccttacttcccagtaggggcggccgggcagaggcgcccctcacctcgagagagacccttaaagcttagtgcagcacatacttctttatctataatatctccattcccatggatttcaatgttatctatattcagataactcctaaacttataccctagtccagccctctcttctgggctacatactttcaaatctagctgtctgtttcttccttttacccagaattctcatggacacctcaaacaatacaaattgaatttatgtttcccctaaattttctttttatataatctcactatccaagtaaattgcaccacttactcaaaccagaaacccatgagtcatctctgatagtcagttttcattactctccatatctgatatgtcagtaagtcctgacatttttacctcccaaatatgtcttgaatctctcttttttctatcttttctgcaacaacattattcaggtttactattacctcttacctgttccactgaagtagttttttaattgtcttactctacccatgaagttctctctctaattcatttatcagatagcaggaaacatgattttcagctgtaaatttcatcactactgcttaacatcctccagtggattcctacagtctttaaaaacatctaaattctttagcatgatctgcaagaacctgaatgatctggcccttcctattttttctatcttctctcattctctctctctctctctctctctctctctcttctctgtctctccacaatatgctggtctttttaagtttatattagtttttctaacactcaatgtttgcatgctcatggcttataccctttgcctagaatgttctccctcacccccacttctaattcttgcattattatctccttcccatttttttaggtctcaaatttttaggcttttcttggccactccgaacaaaatacccctctcccaaacacacacacacacacacacacacacacacacacacacacacacacagagagagcatattttatattttgggtccttgtttgtttacattcatagtaaacaattcacaattctttatgggtctctttccttgtttttagtctttcttctttctctctcactgaaatgctaactccatgaaatgtagagggtattcctgatgtgttaaaaaagtattgactttttttactattttattctaagcacctaagagttggcacagagtaagcatttagtaaatatttgttgaatgtatgaatgaatgtattgagtacctaatatggaccagtaattgtgcaaaatgtgttacatcgaattcatatactattctatagatgaggataccaactttcagagaagtgatgtgacttgctccagggtacacagccagtaagtggcaaagctgggatttgactttaggcatgtctttttccgctatgctataccatctccccaccatcagtagttcacccttgctcttctgtgcctcctctactaatgtttaacgaattttctatcaaacaagtttaaggattagacatcctttgttatgatgaaataaagcactataattttaccacaaataaaaatataattcaattggtatagaatttctaaaacaagaaacagatttaatcattgctcttatgaaatttacacacaggtaattaggaatattcattgttgatgataacaccagcacagcagtaggaacaaccagttaagatctgaaaggatcgagcattttccaaaatacatattggaaaaaatgtacatatttatgtgtcacagttacagttttaagagtctatacattctaaatatgatgggataattgaagtcatggattaactttccaaatggcccctggaggactggagtcaaatttattaattaagtgtaataatcctggacttccagaaagaagccaattatgctcggtatgtgtgacactttaaagcagtttgatgtttttctaaaaaaagtatcagatcaatggttattcttcaaatatttatttttttttagatccaaatcatggctggaactgaagaagaaaacacgattcaaatttcagaaattatctttttgggttttggggatctccatggccttcagtttcttctttttgggatatttctggccatctatgtggtgactgtaatgggcaacattgcgatcctgtggtgtcagctaatcatttccttcacacgcccatgtttttctttcttggtcacttcttcctagagattggctgcaccagtaccattgagcccatgaggctgaggactgccatcagctcatatgcctttttactttctagcctgtgtttcccagttttactttttgccttggtggctacagaatgcttcttcctggctgtaatgtcttatgattgctatatagccacctgtaacccactgcaatacttcagcatcatggaccactggagttgcttacagctagctagtgcctcatgggtggctggatttctggcattcactctcctcattgtcctcatttttcacttaacattctgttccaccaatgtggtcgaacacttccgtgatttgaagcccatcatgaaactggtttgcactgacactgaagtagctcagatgacctcttttatatgcacctctttatttgtccttggccccttcctgctgaccctggcttcttatgatcacatcatcactgccgttctgaggattccttctgccacaggaaagcagagggctttctccacctgttcctcccatcagactgtagttagtctctattatggggtactgagcattgtttatggcttcccatcaagacttattgaagtcttgtatgaagacttattgaagttactttctattctgtatacagtgcttacccctgccctcaaccatatcatttacaccttaaggaacaaggatgggaaggtagttctgagaaaattggtgcaataaggaacatataactggtccaaaaagagtttgaaatttttagtggcttttggcaccttctgaaaaacctcaaaaaagtggaaatgtttctatagtgtcaagaatcgttactgtgaaattgatgagttttcctttgttctatcaactttctccacattagtgaataagaagagtgttaaatgttcatttgtcgaacatttcgtaggtgacaggcactatgctaagtcctttgcatggattgtcatgctaaatccccacagcaacaccatgaggtagctactgttattatccccattttacagatgctataactgagatgcaaagattaactcacttgctaaagaccatacagctagaaaatagtgaaaccagaatttgaatttgatcccaaggtttgcctaacatcaaacccatgatcttttcactaaatggggggagcccacaatcttggattgcccaaaatggctttcttggatcatagaagacattactgcagataactttctataggggaacatgggttaatgtgaggtgagaagaagggaaaaaaagtaatacaataaaataatgcaatttaaatcctagtctctctcctttcttcacctaaagtcttgatgaaaatgcatgagataaaaaatgtcctaagattaaaattagttttttaaagattatttgtaagaacaaaagattaaaaacaacctaactagtccaataaattaaagcacattcacacaatggaatataatacatccataaacaaacaaacaaaaaagaacaaatcagctcttcatgtgttgatatggaaagatctccataatctattgcaagtgcaaaatacaaggttagtgcaatgtgcacagtgtggcacaagttgtgcaaaaacagtaaaagaaaaatatttaaaacttaattatagattaatagactgttctagaaagaaatatatgaatttggtgatattgggtgccttttggtagagaaactaaatagaggggaggtgtaccttttgaggtgggaattatgtaaataaattacctattgaaaagtaatcaaagtttaacaaattattgcaaattgtacaaaaagcagaaatgttcaacaacccacatttatataccagtgtggaagcacttctagatacttgggaagcttcttttctctcacaggcaagttatcagctctgagggcaaggatcttgtcacttactgcttctatacttccctcatagtgccttaaatgccaaaaaaaaaaaaagtgtatagcatagatgtttgacttaacacttgtgctatcatccaacacagcatagctcaacatccactgagcataacaatttccaataacttggtgtgtttccatttctagagtgaaaaacccaagggagaaaagtgctagctgtatctctgatgcttttccatccatagcaatcataaaggctagcaaggggctggcatgaactaagaatggctttctgggctctttcttacattatcaccatagtgaacttcctatcaggaaaacatgactgcatccctctggcgtttaatcaacctctgccacaatgactcacaattaggaacagaataagggtctcatattctttgtgactctgtgattttacacatgctgtttctacttttgcctctgcctcattttctcacgttaactccttttcatccttaaaatatcaaacgtcaaatatcaaagtgtcacacactcagtgaagcactccctgatccttcaacatccctctaaagttaggccctattttttcctatgctattaaagcactttgtacatatttatattttacaccaattacattgtacagtaagtttttgaatttatgcctgcctcttcacctaataatgaattcatgctgacgtttatcctacatgtagagtagttgttcacctgcctgaagcagaggctgaactacttaatgtcttaaggataattccggttctagaagtttgatatttgtcttggagcaaattttacagcagaatttgtggtgacaggtggagaatcttgagaatttcctcttagtgtcaggaagcagcattatcttgaacccttggaaaggggacctaaagcattcattcattcacttgaaatatttgttaaatataaatgtaacatataagtatgttaaatatcaatttaagcaaaaacactgactggttagtactcttctaggcacaaaaagaataagaatcatgtgactttaatttcaaaactctcctgtctaaccactggaacaccaacatggtctcagatacggagcctgcacccaataaatgtttgttcaactaagccaaaccaaggtattatcaagtggtctgggaatacaactggcctctgttgaggagatcacaaactctggagttataggtcttggagatatgtggattgtatgaagtattgggggaaaaaaagaagtgtcatgaagaagaagagggagggctgtctccacctggaaaatttaagggtcattgcttccttcacaacaccagctgccatctgccaatgagaaggcaacacatccatggagagcaacaactagaactaattgggtttctcctgtttaatacctaagacagggccccattgagatcaggtaaggagatctattaaaggcaagctgttctctgcatatcacttaattcaaagtacttaatgaagctgattaaatgctatgctctccaaggatactgtagatcaaagtggtagtttgtgtaagtttaaggacttgattcttaaaccagaatgcaaataaaaattcatttgagaaaaacctaaattagagcatgaaagcaatgccttgagaaggggaagatatttttgtacaagccacagttcagtttggcctagataaagccaagcatcaggatacaggtgaaaaattcaggcaaatattcacctttaggggcactgcatatgccaaatttctaggtacctgactgtatatttcactatctggaagagttacaatattcaatagtacttaaaaatgggggttcaccactcagacagagtttgtgagtcttcgctctgtaaccttaggcaaataacttagcctccctgaccttcaaatttcttaggtgtaaaatggaaatactagtactatattacctcacaaggatgttaaatgaagattaaaagagataatgcatgtaaaactcttagcactcaggagatacttgatacacgttaattattattttagtggctatcatcattatcataattggatgtcattgggtcctttcttgttttgatatagtaaagaagtatggaccagggaggtatctgaataactgtgaagtgatctgaaagtagaggctagaaaaatagaggccgggcttctgagacttcttggttttgccagggtatcagtttactttcatctttggcaagcaagacacaagctgggtatcaaggtctttcatatgttagtttactgagcagctctgtggaaacgttggaccctttggtctaatatctggcctttaatggcagcccaaacaatatgaccagaccagatgcatcttgctctttctgcaagagccacatttccttctctctttacttaattcttatgcttttcgtactgaagttcttgtaacaagtcatgtgaaggtaaatgaaggggtgcttaatagtagtaaaaggcaggctaagggggaatggacctattaaactgctaagagtttgacccctgtataccactccaacttcgtcatgtacaattattctctctctgtggtgtggtcactttgagaccctctttcactttcttgaatttgtaaattcttttgtgccttagaatgtttgcatatactattccctctgcttagcatgttcttcctcaaaacttgatgtagttggctccttatacttctgctctctccttaaatttgacacccgatagagatttcctggccacctcttctaaatttacttccctgccaacaccatcacccccacctagttaggctctatttcaatatttcattattcttcttagcacctagcaaagtagtgattatgtaattatttgtatatttatgttctacatgtccgtctcccagaacatctgtgcctgtcccacgtaagtactcaatgcatacttaatgaataaatgaatgaacaaatgcctttggcattcttaccttctggttagtcaatgggtggatattcaatggttgtggtctgataaatgggtggctaaggagagtttaaaacatatccacaaattttaaaatattcctcccatcaataggtgggatcaatattctttccttttgaatatcaaagagagatgctctagtgactgcctgaaccaatagagcatgacaagagtaccaacgaagggtctcctaggcataatggtaggactcagaatggtgggagtgacttccaaggctgggtcataccaaatgaggaagctattgccttgtctgctgtaaacttgcttttggagcaccaaggtaccacgtaagaagtccaattaccctgaagtcaccatgctgttaagaccaagtcacatggacaaattgtgtagaggtgttccagttgacagtctctaaggagacagaagtgatatccatctaaggcccacagggtctatatcatatcttcaaattctttgatattcttcccattgagaagtggaatctatgtgccctcctttttaatatagaaggattgctgtgctttgaccaatagagcatgaccaggacagtaacagagggcaacagcaacaacccgcatcagctgcccgatatgtgagcacagatgcctctagatgatcccacttcctggctgtcaagtcccctccagtcacaaaattttccaagttgtggtccccgacattgtgaaagagagataagccattctcactatgacctgaccaaattcctgagccatagaatccatgagcataattcaattgttttattccactaattttggggcttgttatggaggaatggtaagtgggatagtggccatgaaatccatgtcatttgaggaggcacaaggtaagttcagaaaattcagctgtatgagaaaatgcctcttgacaaacactggcttaaaaaaaattatacaatttagtgtatttgtacactcacttcaaaacttgcttctctaaagagaagcttccctgaaccacccaagcagaagggagtacttcctccatcctgggtgttaccactgtattgaggatacccctccattagtgcccttgtcatgctgttgcacatgttaactcacatgtgctctcttcccttctaaaatatcttgcctaaatcacttatatcggtaaggcactgaggttctgctaatacatttttggtgatgaaatgaatgtttctaatgatcattttcatctgtcatctggcctggcttccgttttctcttaatgccaggtcttgccatgttccaggtcagcaccaaccttcctctaacaaatacgaatatagatgagagtctgagccatctgtgctgttctgtttgatttaaggtcattggtggcttcaccatccagatttcaccactagcatttcatacatttcctgcagttctgcttcctacagaagaaaacaaatgaagggaccatcaaaataatgaggaagctaaggctacaggtaaaagcaacaattgccacaatagtaataaatgcatccaacagttactgaaattttactatgctccaggctgtgtgctaatgttttatatacgtgatcctatgaaatcttcacaatggctgtatgggatagacactattattatcaccattttacagatgaggaaattgaggtttagaaagggtaaataccaaaattgtactgctagcaagttgtggcatctagatctatctgactctaaagtttaggtatgtattcctattgatatgctggctcccttgggattttaaaatttatttttaatggcaaagtaaaagcaacacctatctggagtttaaaggcatttcaggaaatagcctcattggaatggagggagcgatgttttgacggttaggatgaaatggcgttttcttttaagtgagaatgtatccccttaaagacattcataaagatgacagtattagtcatttcataggatcaggaacagggggaagggggttatatgctgaactcagtcattttcttgccctgtgatccacctgccccctaaaattcagagctaattttctcccctatgttaccatcactagccagggttttcctcattgtccccatctgaaatccctctggagaggacaggcagcaccccctgagttggcagaggataccacgagagagagctggctcttcatgggcacttaaggtgagagggccctgtgggtagcagccagaggaaactgttgagcaaaaagaccccagattttattctctaatggtaacaagtgcttgaagaaggcgatgattcacaccaactcagtatctgcactgctgacgtagatgcagatgagggatatacaagggctgacaaactcaggaaagaaactaagaatttggtttaactgtgtggaagtaattctaattacaggcatttatgtgaactgtttacaatttatgcctaattgccacccagtacaataacaattatgcatatcattaaatatgtgtcagattaattttgttgtaaattttaattataacagcaaaccctatgtgtgtatgctctgtctttataatttgttgcttagattgctcataagttagaaataaatgagacagaacattggctagcaggccaagagtggggaaggtgcagaggcggctgcctggggttgaatatttactatgggtggcgcacaaagtggataatcaaccaatgcataaatcccagcagcttaacttccccggagccctgcaggcagctccacaatcttttattcatttattgttgattctttggttgtattcatgcccacagcctgtcccaaaccttttctggtctccttggcctctcaacttgcctcctccgctctcaactcttactcaaaggaaaagaataacctcatcctggcttttgcacagcaggtctggccaatgcctccctagctggcatctcaaatttctttcatgttgtaggccccttctcctgtgggcgctggcctctgacaagcagatatgtcctttcctctgtgccctgggctcttcccctcccaccatcccaaagactggtttgatgtcccagcatttcaccatgcgttcaatttctttctctgctttttgccatgcacgtggtagacactcagtaaatatttgtggaggtttcctttagacatacatgagacacaatgggacacacacacacacacacacacacacacacacacacacacactttccttgctgtttcttcagctatcaccattttctctttatcctctaagttaacactatacttatacatcttacatatccagttagacaagaaattcattgcgggcaagggacttctatgttatttttttttctgatttcctagcacagcttgaagcactccatacatgctgaaagattagtactcatggatcctcacaggctgctgcttctgtagagggaagggaacatctggcactttcttccctagcttgcttttgtagaggctgagtaggataatagaaagcatggggctttggtatcagatagacttgagttccactccaggttctgccactcagcgactaagagaacttaggactgatttcatctttctgaggtccaattatcatccgaaaaatggggataataatagaacatatattacaggattgttgtgaagataaaatgacatgctgatgaaaagggcctgacacacactggtaatgatttttctcaggcagaaactttctgctccagtggctcactcatactgaatatttgttcctcctactatggtaatgatgagtcaggatttcaacaacctaaagcctcacttattatccatgtttatctttcattcttaactctagatcagtagttctcattcctgtgagacctaatactccctcttaataacaaatattttgtgactccctcttcactatccttaaatgaagtacatagatagtataacttacctacatacataatttcaaaaaaatcaatacagtgacctaactgaaatataaatgaggaatgaaaggaaagtaatttacaataaaatgatatgtatttcaatatataaatgcaagggcacgactccatcagacaacataatgaaatacatgattgcaccaacttatactgaataagttcatatttaagaaaagtaaaaggattgggaggcatcacataaaagatgggaaaacatacaaggcagagagagatacaggaaacagtaggataaaagctactgttaagacaaaattcgataactataaaccgttttctcacatacattattaaagctcactggaatatttgaaagctgtgtaggagaacagctcttcattatatgcgattatcccagacattcaggacagctagcatcactgttctccatccacttaatgtcaatagcacctcccaagcattgtgacaaccaaaatataccccaatgcttctgatggccttcttaggactctgagacacgatgtagagatgctgatggtgatagcaaccaactacagccttttctgtcttgtttgctactccagtcctactcctgcctcttgaatatctgtttctagttcagcactctcattgatcctacccattcagtttttagcccaagaaggcatttcttcctcaagataggtcaactggactgtacacagcagtagttctgtaacaactgaatattgtctaatagccataaggcctacagctactatttaagtttctaccacctttaagccctctccccaccagtcactccaccaccaaggctttggcacccagctagcaaatacatcatggcttatctgttttcttgattccatcttgatcagcttttaagtgccacattttaattttaatctgttttgatgcaaatttttccaaaacatactctgctttttaaaaaatcattctttcatactccatggattggttcaattaaaatggttaatttataagtatgttatttccagtttttaaacaaagatcttaataactttcacaaaaaagttgaaaataacttaaaataaacaactataagtatacaacctcaattctaccattaacgttttactgcagttattttatcaattatttatcagtccaaccatccttctctccatccatgaatccattttgttttttggtgcatttcaaagtgaattgcaaacatcaatatactcctcactaaatctttgagaatttgtataattaactagagaattcgtataattaactagagaattcgtataattaactagagttaaatcgttgcttatagattttcttttgatgtaaaatttatctacaataaaatgcaaaagcattaaatccacatttgcagagtttagacaaatgcatatatgtatgtcctaaatacctttcaaaatatagattgctactatcatcccagagtcctctccttccccaacccagtcaattcttgccccatacccccagaggcaaacatgttctgatttttttcccacagtacatcagtcttatctgttctgaaacctcataataagacagtaagtatgtttatatatgaggtttctttcacagaaaataatgtttttgagattcatccataatattccaagtagtcttagtttgttccttaatattgtgcatagtattcaattattttatgaatataccaaaatttgtttatctattctcatattaatagacatttaggctgcttcccagtttttgccattatgatgaaatcctctgtgaatgtttctgtgcaactttttattttgacatttttttatttactaaatataaaggcatgtaattagttggtcataatttggtattataagaaatgccagaacgtttttcaaagttgttgtgccattttatactcccacagtgtaggaaaattttgatcactccacatccttgcccacacttagtgttgacagttttctttattttcagtgctcaggtgggtgtgtattgatatcttgttgtggttttaatttgcttttctctgataaaaatgatattgaatacttttttgtgtgtactggccgttcatgtatttgcctttgtgaaaatgtctgttcacatttttcccccttaaaaagattagagataagtttagacttacagaagaattgtaagaatactacagagagtttcagtctaatttcgcccagtttcccctactgttaacatgttacataaccatgatgcttacatttaccaaaaattaaccttggcacatgactctttactaaactacagactttattaggattctaccagtttttccactaatggattttttttttgtcccagtgtcaaatccaggatgccacattgtttttatcattgctccttagtctccgccaatctgtgactgtcctcagtcttccttttctttcacaaatttgactcttttgaagagtattggtcaataattttatggaatctcccttaatttaacttttatgttttctccagattagaccagggtcatatgttaagaagaagaatatcacagaggtggaagtgcccttctcagtatataatatcaggaaataagattttttactcgtgatgttaaccttggccacttggtcaaggtggtgttttataggtgtttttacttgaaactagtcttcacagtaatacatacatacatacgtacatacatatatatgtatatatatatgctcagtacatacataatacatactcagtaacagttcatagtctttccattagaagcaagtcactaagtctagcctacagttatacagagaagaatttaactccacttcctagaagaagtacaaaagagtttattaacatatcttttaaaaccacagaaatacataatatttgggagggagatggaaatatcctatgtctccttaaaatttcacctactaattttagcatttattaacagagcttgcctgcagattattatgttgctattctaattatgattttctatttctctcatttctcctaccattattaactggaattcttctataagtgagaatcattttttattcccccattcatttattcaattatttatgtatatcagtatggactcatttatcctttgatttaaaatacaatactatcatcatttaatttgtcgttccaatttgttcaggtttgaccattgaggattctttcagcttgggtactataaccttttgacatcatcttatccttttggttgtggttgtcatttttgagcactttcagccactgtaagttaatccatgtctcttttgtatcagccctaaaatcatccatttctccaagaaaccctaactgcttttattagaggatagtgtttagaaaccaagatctggaactaagtttgcttgttactactgaggtgttactacttctatgtgctaagagctaggaaatctatgtatatatatacacttatctatactttattttgtatctacttgtgtatatattaaaacaaacttgagtttacactgctatctctgactttaatccaataatacagggtttattctattattcctccagtagtaggcagaataatggtcctcaaaagatgttcacatcctaatccctgaaacctgtgaatgtgttaccttacctggcaaaaagaaattaagattgcaggtggaattgtttctaatcagctgaccataaaatatggagattattctgggttgtctggatggacccaatgtatcacaagggcgtccttaatagtagatgacgagggccaaacagggagtcagctactatgcaagaaagacacagagagataaaacattgctggctttgaagagaaagaaagggtgccataagccaatgaatatgagcggtctctaaaatcggggaaaggcatggaaacagattatcccttaaagccgccagaatggaatgcattgtgctgacactttaattttagcccattgagaaccatgttggaattctagccctatagaactataaaacaaaatgcattatttgaagccactaagtttatgtaatttgttgtagcagcaataaaaagctaatacacttgaactgcttatttgttacttctttctctgatagaggaacttggctcttaccatttataatatacttgcttattttttcaaccctagtacatgtatagtgtagtttcagaattgctaaatcatgccaataaaagaaatatgtttattaactagattacagtgtttaggtcgttacttttgtttttatctttaaaatagtacaagacaaaccagtttcccaaagttattgtcagcttcttccctctccaccttctccaattaaggtatatcatatttctaatagagttatatacgtttgccatagtctttattccattctgggttctccagtcatcttggatgactttttttttttttttttttttttttttttttgatggagtcttgctgtcgttggcccaggctggagtgcaatggcacagtctcggctcactgcaacctccgcctcctggattcaagcgattctcctgcctcagcctccccagtagctgggattacaggcgcccaccaccacgcctggctaatttttgtatctttagtagagacagggtttcaccatgttggccaggctggtctcgaactcgtttttctcatatcttttcatcttcagttagtttttggtaagttctattttgagggaatctgctgaatttgttggcataaatttattcataatatcctctttttagctttctttttacagttttattgagatttaatttacaaactataaaattcacccattgtttaagtgtaacaattcaattattttattagatttagagttatcctgccatctctactgttcagttttaaagtattttcatctctctaagacgttttcttgtgtttgtttaatgttaatcttagcgcttacccaaagctctagacagccactgaccagccttctgtttgtaaaaattttacctttttattaaatattctagttgaatggaataatacatctgcagcttttgtgtcttgcttctttcatttagcataatgttattgaggtttatccctattatagtacatatcagtggcttgtttttaagttgccaaaaagcattttcatgtgtggataaactacattgcttttgtccattcatcacttgataggcacttgccatgttgccagtttggagctattatgaacaatgttatgaacattgctgtatatgtctttgtctgaacatatgtttttatttcgcttgggtagatttttgtgagtggaattgttcggtcacatgataactttacagtaaactttacagaaacttccacactgtcttccacatctatgccaacaattggtatagtctgggtttttttgatggtagacattccagagggtgtatactggtattttatcatggctttaatttgcatttccatgatgattaatgatatttagtatctttttatgtgcttactagccctttggttattttcttcagtgagttttctatttaaatctttaagtggtcaattgtgtcgtttgtattcttattactgagatattatagttttcataaattctggataaaaagatttagtggatgtacaatttgcaaatattttcctccagttctggtttgttttttcattttcttaataatggtttttggtgttcaaatgccgattttaataaaatgcaaattcacaaattattttttccatgtctttggcgttgtatcaaagaaatcatagccttaccccaaaatagaaagattttctcttatgcttcattctaaaaatgttgtagttttagctcttaaatttaggactagcatgcccttgagttaatttttttgtatgatgtgaggtaagtatgtaaggttttttttttcattttgtttgtattggggtatataattgtcacaatatctgttattgaaaaatctacccttttccttgtcaaattgtcttgggatctttgttgaagaggtatatgtgagaatttgtttctgaaaatttaatttgcttccgttggtctaaatgcctgtccttgtgccaacaacacactctcttgattactatggcttagtagtaagtttcgatactgggttatgtaagtcccctgactttgttcttttcttgaaatcgctttgaattttctaggtcctttcatttccatataaattttaccatcgattagacaatatctataaaacattctattgcatatggatatccagttgtcccagcatcatttttttttattattatactttaagttttagggtacatgtgcacaatgtgcaggtttgttacatatgtatacatgtgccatgttggtgtgctgcacccattaactcgtcatttagcattaggtatatctcctaatgctatccctccccactcccaccaccccacaacagtccccagagtgtgatgttccccttcctgtgtccatgtgttctcattgttcacttcccacctatgagagagaacacccagcatcatttgttgatgaaactactctttccctcattcaatagtcttggcacacctgctgaaaatcaattggccataagtgtatgcatatagttttggagcctcaattctattccattaatctatgtatctgtccttagaattatgttattttgattactatagctttgaagagggttttaaaaccaaaaagtgtgagctaactttttttcttgtattttaaaagtctttaggctgttcagtattccttgagattttacatcaattttaggatgcatttttcattttctgtaagaaaaaaaagtcattgggattgtggtagggattgtgttgtgtctgttgatcactttgaatagtattttcattgttttagtccattttttgttactatgacagaatacctgaggggggttattatttttttaaaagaattttattttggctcatggttctgaagggtaggaagtctgacatcaagtgaccatatctggttggtttttggtgagggcatcctactgcatcataacatgacagagaactgaaaggggaagtgggtgcctgcaaaagaaacaaaacacaagagacagcctcactttataacaatctgctcttgctgtaactaatccaattctgtgagagcaggaactcactgatccctgtgagaattaaaccactcccatgagagcaaccttactccctctttacaaactaatcaccccttaaaggctcaaccttccaacaacatcacactggggaccaaatttccaacacatgaattctgggggacacacaaaaaccatagcggtcatctttaaatattgttttccaatccatgaacacaggatgtctttccatgtatttaaaagttttctttaattttttaacaatgttttgtagttctcactgtataaatcttgtacttcttagcacaagactttataaattacccagtttattacatcctttataaattacccagttaaatttacttcaaagtattttattctttttgttgtatcataaatagaaagtttccttaatttatttttcatagtgttcgatgaaaggatatagaaatacatcaaattttatgtgttgaacttgcatgtgttaatcttaatttgttcattagctctaatagcttttagtagatttttaatatttcctttttatattttctgtatatgagattacattttctgtggctagagatagttttacttcttcctttcaaatttgggtgctttttatgaagaaatattttgaaagtcgccagagaaaaatgacaatttacatacagatggacaacaattcaaatgtccatggacttctaatcagaagctatggagaccagaagacagtggaatgaatgacatcttaaagaactaaaacacagaagcaaacactcatccaagaattccacattgagcaaaaatagttctcaagaatgaaggcaaaatagaaaatatttccatccatcagtaccgtaataacattagtcaccagcagacctacgctacaataactactgagggaatttcttcgggcagagtagaaataataccagttagaaactcagatattttggaataaatgaagattattgaaaagggtagagatcttagcaaatacaaaaaacttttttctcttaattaaaaaaataaaggggacttccactttcacccctaacatgtaaggagcttgaaagttgccattcgcatccttacaatgaaaaaatgctggacagtaaatagaaaactgatgacttttcttagcctcagagaattgagatggcagaacaacccaacatctcaaaagctggagagataggcgcattcatatctgcttatctaatgaagacctgctggaaaccataaacagtatgactatttaattaattctctagtaattatgaaaaattactggagattaaatgtgaactagtgtgagagtgagaagtttatgagggggaaaatcatagaggggctctccacacttttgtgggcttttcctccaggaattgcacaatattctcataatgagaattaggaaaatcctttcagtggctctgacaggaggaggggagaaaaagaacaaaatatacaataactataagataatatcaaaggaggtaaaaaatctagttagaatcccagaaagagaagaaagagaaaagatagcataagacatttttgaagcattaaatgaccaagaacatcacaaattagtgacagataccaaactacaaatccagtaagttcagagaacaccaagaaagataagtaccgaacacacacacacacacacccctgggcattttgattcagactgcaaaaatcaaatgcaaagagaaaatcttgagtgaagacaaagtgcagggaggcaaaacaccttatctatagatgaagaaaatgtaaggcttatagtagacttgtcagaatccatacaagtgagaagagagtgaagtgaaatcttcatactgtttaaagaaatttctaccaatatataattttatatccagtgaaattgtccttcaaaggtgaagcaaggtagtcagtgatcttttgggtgtgatttcaggatcccaaactggctttcatatgaccaataatagggtcccatattactgcagatgccaaaagtcaaagcacgataagtatgagtaaagtaattttcactttttactgtttgtagacaatgtccatctttcaattaaatagccagacttccattaaactctggtaacatgtcaagccctgtgctaagctggtgctctgtattcatttgctcaggctgccataactaaataccacagactagatggcttaaacaacaggaatttgttttctcacaattctggaggctagaagtctaagatcaaggtgctggcatggtcagtttctggcaagggctctcttcctggcttgcagacagctgccttttcactattatgttgcagggtgagagagtgtgtctcttcgtataagaatgcaaatcttactggatcaggaccccacccttatgacctcatttaaccttaattacctcccataatggccctatctcaaaatacagtcacattgggggtttcaacctatgaattttagtgagacaaaaattttcactccatagcaagctccaagataaatataagaatcattgttacataaaatcttcatgtacccaacagaaaaaggcaaatgaacctcagtgaggagagatgtaatctattaattttcactttaaaatttgataaaataaatgggaagagagggaacttaaactgcactttgagatttttacttgattcccacagatcatagcttagcagcagtgtatgtaaaagacagtttgaagttaacactcattcaataggtatccacaattagccatagataaaaaagctgctatctgtttagattatatttacaggagaaaaatttccaaaatgagggaggcaataaccctgctgctctctgtcctttcaagatgacacctggaatacagtactttgctcatttctggggccagaatacatgaaagttatgaataaactgccacatacccggatgtgtgaccagggggggtaaggaatgcaaaaccataccatataaggaatagctgaagaaactggtaagagctgacctaaagaacggaaaactaaaaggtttataagctctgcattgaaacatatgaataatacataaatgaaactttcattttggagacataattaggttaattataaacaagaacactcagtcagagctatctgaagatggaatgggttgagtttgaacataatgagttctctttcattaatggtatataagtaccagctagatgaccacaggcaaggatattatagaaggaattgtggtaacaactgggggttggactagtaaaccttgcagaattcttccaacttgaagattctcaaagggtatgattcttaagatcaccagaggattgtctcttttacaaaataatctatcaacagttcttatttaaatattaagtaactctgttggatttaatatgaaattgttttctaattgggtaaactgaggcacttcttaaaccttccctgctatgtttctttggtttttgtactgaaactcttctttatcgctaaccattttcagtagtgggtatgacacaagcccacctgcacatcacattttattgccccgtgacagggctcaattgattagtaagtgtttttgacaactcattctatgcttagcactggatagggcctgtgaggtgatagaagtctcagacagaaaccctgtccccaaggatttccattctccttcaggagtctgtacaaacacaaaggctcaagggaacggcccaggctctaggatttcccataggggaggttgatgtgaacaagagtggtcaagggtaaaaaacatgagctgatacgtccaagagtgaatttgtatttatcatctgcttctctttcttgtgtccccaacttagcgaatggtaccactatgcatcaagtttccaaacagaaacttgagagtcatccttgataccaccttatttcttctactgaaactatcaaatctatggatagataatgccaattttactcccatctcttaaatatatattttctattacacctgccaccactgtagtcaatgttgcttagaaaaatgcctcatctactaacttgtctccctgcctctccttattctattcattctccacactgtagattgaataatctttctcaactccaacatgaggataccactcttccatttcacactccttgatatgatgttaaaagccatttgtaacctggctcaagcatctctatccactatcattgtcttgtttgttttatcttctatgttcatgatgtacttaaattattttaaatgctgaaatttcttcccatactctcacttaccttcagacctttctgccttgtagctctttctacatggagtactctcccgactgtgcccagagcatcccaaagtatctttcaagtctcttcttagatgttatttccttcgagaatcaagtcctgattatctttccaagtctgcatggcttccttttgtccagactattaatatcctgtattttccgctatcgtatggccctttccaaactacagtgtaatgacctgcttaattgcctgtgagttctgtgaaggcagagactttagcgaatttgtttagacagactttttaatgtatattcagttactagcactttacttagcacatagtaggcattcaataaattgttgaataaataagggtaagacatgccagaacatggagggaaaccagcatcaaccaaggcaaattgattgaaataaacatagtatgtgtattataggaaagtaggcaggaagggcatgttgtatgaaatgagcagaactgcctgataatagtcaagaagatgcatgtaagaatgttggcagtcaaggttggagaggcagagtggggtacattatggaggaccttgaatgttagagtaagaaatctcaacttgattaataagacaatgaagaattctgtgaacaagcatccttaaatctccaatctctattttgggcccctagatatcttctttctacacacatcctggagaggggaaagaagtaagggcaacaccactagtagcatattgacctaggacatttgtttttgcttgtttatttgtttttattggcattattgatgtataatttagaattcaccaattgtaagcatacagttctgagttgtgacaaacacacatagacatataaccaccaccagaatcaagaaaaagaagatttccttttcctccaaaagttgcctcatttccctttgcagaaattgtgtacttctaaccctgaccagtggcaatcaccagtgtgttctcctacctatagtttcccgtttttaaaatgccacataaatggaattatacaatatataagcttttggatctggctcccttcacttaacatagtatttctttcagattcattgaagtccttgtatgtatcagtagtttgttctctctctctctctctctctctcctctttctctcttgctaagtagtattctgtagtttgaatgtaatacaatttattctttcctcagttgatgggcatttgagatgtttccagtttaaggctattgtaataaagttgctgtgagcattcgagtagcagtgctggtgtacttgcctagcccctctactcagagcaagtgtacctggaaagagatgaacgggtcctggaagagatgactggaccaagaactcatcaggactcacacttctctcccttttcacccagtctaatttatcagcactattacaaggatttgttgtgatcaaaattcgaaaaacaaccctgtagtttctcacttctttgatgattttatgaaaatggagacgtagtcactcaaatatttgcgtcttatctccctctctcctgttttcttattttcccatttaaatttatttttactctatttttgtacctcctttcccctcttctttttcttttgtccccttctcccctccctctcttttccatctgtccttcccttccctttttacgtgccctttctattttattgtttcatcttctcttccatctgtaactttctagcatagaaatttatgtttacaaaaatgtttaaatcaaggatgtagacaatttacatgaactgttacacaccataagcattttatgcactgccaactcattttatttacttgttttaactgtgaggatactgagcactcagtcctatttctattacatgatatcacatcagtcaattacacctaatttcccatagtgattctgagaatttcagccagatagagcttttatgttttgttttaaagtacgcagttgttgattcctacgttgcataccactgcctacccttcctgctccccattaaaactcttatgttttgacaaattggtgtcattaggatttcagccctctgaaataggtttaatcattcaggcggtaatgttctatgttcaagcttttgtattaacaaactcccccctccttttttcttggtaaatgggaacctgatatttaagcatcctagattagtgttacaggtgcactttcggcccacccatgaggagctgtgctcaaattcccatgtctaatgccaacaagtattagcgggactaaagaagttcattttattgctttattagaattgcttcttttgaacctgggccatttttttacaaggcctcagcttaagggtctgtgttagttaattcatattctatttcctttcccagggatatgaagccctttctaaaaagaagggttgaggagggggaagggacttactgtggttcagtcctgatggctgtgattgaggaggcagaagaaccagggagaaagaaaaaagggctgcaggaagtgtggtgtttagggtatgcatggaaataataccagtctcaaaaagccaaatttggtaaatagctttagagagggaactatttagggaggaaggataggagaaagaaatggagaagatgggaaataggggcaagagagagaaaagaaaaggttagggagtggagaggtttccagggtaaataagcccaagtctctcagcagcccctcaccagaatgatttccagactcttaggcaacctgctttctcccttctagatgccttgtagcttctggctgctacccatatgttccccccatcctgctattttcattgaatacttcaagtacaggtctgccaagcacagagctgggatgcactatcactcccttgtttccgactctatctttctactaatgcagatgaagatggatttggttttctatgcagccacaacacacaactgaataatattgagcttacagtccctaaaagcccctaaatcttttttacgcatgttgctacttagtcacatctcatcctctgcttgtgcatctggtgattttgggatccaaatgcaggattttacatttatgttccatatttgtgaacatttaaacattatttttgatgcattattaagcttatttcagagatttttgagaataactctcatcagttttatagtcatgtaaatgtaccattttgttctgttttcattttgataattaattttttcagaaagaaggcacagataattaagcattcaaggacatttagattttcataattcatctttaaaatgtaaatgttctcaaatttaacctgttgataaataatacattaaattttttcattttgctgtttgtttcaggcaaggtggaaaaaaagtggcatatgcctagactgtccccagcctcctaaaatggtgcaatgctgcaaaaacaaccataatccctcgttgctgggcaatggacagcgtcacaaatcaaactctcttcgtttttgcatctacttatctagcttaatgctgagacggtcacaaacaaagaagatattcgttatataaatggggtggctaatgtacttcaggaaatttttagatcttacttggtgtttatgtgtactttttgtgtttttaatgttgaaaaagatacaaattatttagagctgaaattaaaattacattaaaaaattcaatctaaccttattaccttgtgataaacatgagtcttagaaaaacctctctgttgatgttttccacatgaatgatttctagcagatgacctcaagttataaggtgacagatttataaaatcacagaatggtcttctcattttaagagaaaatttagattgttgtttgcttttattactctccctaaactctgagggaacacaaatttaaagaaaactttctcaatccagatacataattagtatatttccagttctcctcaatgtatgcctagtcctttatagctgctaagaatactattcatagcatctttcaaaagtatcataaggctgttatgtccattatcaattataatggctatattatatatgacgtatcaacattcagtccaaaagcactattacctctgaacagattgtttttctgcaattaggtgctgtacactaagctagctaagaaaataagcattggccccatgtacccaggctctacataatagcattgttgtgaaggaaaatgagcaaaatggatctatgagcactttgggggaaaagaaacaatggtgctatacatagacaaagaattataataaaaataataacagccatcagatctgacctaatgaaaattggacagcagaactaaaagcaatttcaaaaacgctaataactatcttcttcctcttctttttccttggttcccatggcaatccatattttcatatgaggcccacaatttgggccttttttgggcaattagcctcccatttgtccaattctctttacctgactcttcaaaagtcccctaccgactttccatttaaccaaatatccaagtcaattcaactaaacagctagttagctcagtaaaaatagtgtaattacattaagatgtgatcatttcaagatgatatttaagaagttgggcagaagtgaactcttcaaatgatattatcagtaatatgatcagttatgtaaactaggaatgggtttctttgggtgcaaatggcaactttaggaaagacagttaggcagcattggtgctaaaagaaggaaaatcaacagaaataagtgctacaggaagagtaaagactttattattctggtgattttaaaaaattatttctaaaattatgatatgtatatatgaaatgtaactcatcatatgaactataaactattcacttacacacactgtatagatatacattttctttctgctgctttgctttacctattcaaaccagtgtattttttctcattttaacataaatttctaaatatttaaatgtgtctttttgttgtttgttgtttgtttttgttttgtttttctgtttttgagacagagcctctctctgtcacccaggctggaatgcactggtgccatctccactcactgcagcttcaacctcctgggttcaagtgatcctcctgcctctcagccttccgagtagctgggactacaggtgcatgccatcacaccaggctaatttttgtatttttagtacagacagtatttcgccatgttggccaggctggtcttgaactcctgggcctgagagatctgcccacctcagcctcccaaagtgctgagactacaggcatgagccgctgtgctggcctattgtgtatttcttaacaacaaataattttgattatttaaaaattctgccctaaattgttacccaacttctcaaattttgtttttttaatcataaattatttgttgtagcaatataaaatacagggatgaagaaaaaagagcacctccaataattcttcactacatagaaaataaccaacatgtacattttgtgtgtcttctttgaagttttttctaggtaacctttacgggatattactctagatatttttaaaaatcttaacatttctcaaatactttataaaataattttaaaaatccagtatatgagagcttgtcttttacaggagaaaaatctttacatttcttagcttagactgaaaatacagtgacagtttctcgctctctctctctttcagtcttgctcttggtcttactctttctcccccaacagtttgcagattcaatggtttctatcttcacaatatctctttttcttcctcttttcattttcatttacttattctaagcaacaggtattgagccacaataacatgggttttagaatcagatgacctgggctcaaattacagctccacctctgactaatgttttcttttttttttgagacagggtcttgctctgtctctcacgctggcgtgcagtggtgtgaacatggctcactgcagtcttgacctcccaggttcaagccatcctcccacctcagcctcatgagtagctgggactatagacacacgccaccacgcccggctcatttttgtattttttgtagagacggggtttcgctatgttgcccaagctggtcttgaactcctggactgaagtaattctcccgcttcggcctcccaaactgctgggattacagtcgtgagccactgcccccggtctacctctgactagcttgtattatcttgggcaagttgcttaacctctttgagcctcagttatctcatctgtaagaaatggatgctaatagctataggaagttcttaaactggtgcctggctcatagttagcattcaacaaatattgtttgctcttgtggctgctgctgcccctgctgctgctactgctattgttataagcactgctccagagtgttgtgaaagaaaatgtgacaatgtttgtaagatgctcaacgtgatgccttgcaaatagtgagcacttcataagtactaactattattagcattatttctgtattaggcacaggagatacacagatgaataagtctctactgtcagagaagtaaccatgtagtatttacagctgccagatgaatccaatcatacttcagttcatatgtgacattacccacaaggctttcgctgatcccctcagatgagaatattgctctttgctaaacttccatgaccactttctctccacttttcttatcaaactttagcacatttttatttttatctgcttacatgtctttgctcctcttctagtcttttagttactagaagggcagtgaaaatattttgttaatcttttagctgctaatgtatgcctagagcgttttgcattctttcatccattcttccatccattctttgcccatcttattccaccaaatatttaagtgttccttgtttataatgggcatttaataaaggttggctaaataagtgagtattggagttaaccatttgaaattcaagaaagcatatggtattaagtctgccatatattttgcaaagcatataaaatttaaactgctttttagtttagatagaagtcataagaataaatttccacctcattttaagtctatgctaagttccacttggtaattttttggtgccatcttacagctatttcaagtgggattctttcatggtgtacatatttttaaaatattgtcatactgtgcccaggatagtcacagaacttccacagcaagtgctccttgttgaaatccagggttattaataatgaaaagtcatttggatactttaattagtgtccagcactatttccattagttaatatgtatttttaacatcatggtgcctaacaacaattgtagagtagatttccttggcactgcaattcctcaactggattatgccatcctaagtttctgaagatcttgctaaaaacactaagaagaaattttctgtaggtaaaggtcacatagctaatcaaaaggatatttaatgccaaatggccttttcctctacccccttttaaacatgctaagggctttcttctacacttctaccattcctgccttactttctcatttgattctgaacaaatggcttaagggaaagaaaattggatagggccattcaaaaatctctttagagtcatctacacccaaaccaatcccagacattgctaaatgacatccaagaattttgttgttatagtttggagcaaaagtcagttctgtatctttagtaacagtagagttataaaaatagccccttatattcaaacactagaaaatgtatttactcagatacctacgacaaatatttatagatggatatatggtttttttttctgttttctttgttgatatatctccagaactagaaaacaaagtaggtgtgcaattaatatttttgaataaatgcaggaatacataaatcccattttcctaagatctcacagttcctaagcactccaagcactaaagactatttttcggttgttttgaatgtagaaataccaagcacctgttctaatttttattaggttaatcctattaggtgcttatactaattttccatacgaattctgagtatttctgagaacacagatgagaatcagattaaatcaccttttgcatttgaatttaccagacctaatttcaattttcttttccctacacactatctcctcttctaaaatgttctcctacaaaccccattaaacgttatctgcttggatacattgaagtctaagacagagcctgatttaaaaattattagagctttgaaaagggtcaacactttcaaacatgggtgtctaatacatgtgactctaattgtaaactgtcccatctccagtttttgttttcttttgaaacagaaacctgaactactaggagactgaattagaggaacaggtggactgtcagctcagaaagtggcctctgagtcctgtccctgaggatctgtgcccaggatagcataactaacatcagggagagcattaggagctaaagaaggtcattttctgcttggttaaaagccctctgtttggacctagatcatgacctggcctttcatttggcacaaatatgaaattgtactaaaaagtgctattagggcacacatggtttgtaatgctctggctcctgtccaggtctccaacctcattttctgccactatctccacacaccatgcactacaatactttgtgattccttgctctgtattcccaaagatgtgaatcatatggtgggatgccaggaagacatcaggtgggtgaagcagatggtttggagcaggaggccataaaggtgacctcaccatgctcaatgatagagatgcttgagtctgggggacttgaacgaagaacttctaagcactgcaaattggaattaaatgctctcctctctatgttatgacaatgctttgtttcacgctccatactgtgttctgcattatatcgtccttagctgtgaatatgaatatatctcccacgaattcataaccttgaagatagagtgtatttttccatctttctataatactttgggtatagtcaaatggaatatttactctttaattgttcaaaaagaatctgggaactgagatggtatccatttgggaccttttcaggttccccctccctatcaagtcctatttccactcccaccaatcaaaatcccagatattcactgtaaaaagatatatttaaaaagtaatgattaggatgaggcaaacagaaagttctatattcagatttagctcacagttattgaatactcatttgactgatgaggagatggagactcaaataactttcagtagcttgccaaatgtcacactattacccagctagtaagtggctctgccaggactgaaattcgacccccgacactaagtcaaaatccctttccacaaacactgaaacatgtaggtaaactcctctcattccctgctttataattctgatatacttcgttgcttaatcacaaacatattctgtgaactctcagctaggcagaagctaaatattatgaacatatgagactcattttacgttcatatttatttctatgtctatgcacttgtgtgttcatttatattacttttgtgtgtttgtatatttatgtattcaggtagttagtgcacttacatatttatatgtgtgtgtttatttttatttatgcacttatgtacttctttaccttatctgtaaggttatgaagctcttacttctaatcctgttagatgagaacatcagttgatgatatcttaatttcctatagcatttctgaggatttcagcttaaaataggtcttgcatttcaataaaaagacctcagctcctgagcttctcggggagaggatagaaggagcagctgtgctccgaaccaaattgctgggctttgggaacactgacaaagccaatggaaacctcagctatgagagtagcacaaaaagaaaatgaaacctacctgatctagaatgagaaaaatgataaaaacaagtttagtagcaaccaataagtactgtgatgctgaggaggaaccaggaagcccagagaattcaggagatatggctgtcctggaggagcagcaggcagaacccagacaaagggccgaggtgagggcgttgatgcaagaccatgtggacattttaaaaagcacacagaaaaagctcagcaaagactgtggggcactactagtgaggccaaagaatggaaagaaaccctaagaaagaaatattgctgaataaatatcatggaagagagaatcagtacaaatgaggacaaaattgagcttcagtcttaaaagataaaacatctaagaaaacagttcttcatggtgcaagaaaacatgatagatctcaaaaacacatcaaggtggtacaatatttatgtatcttgcatccttgaaggtgcagaaaataaagagattagccttgaaaccattattaaggaaactgttgataaaaatttcccagagctaaacatagatctcgacttatatacagagaaaatttataagttcccactcaaatgtatctctcatactaaaagtccaaagcatattattgtacaattcttaaacttgaaagataaagaaattgtctcagaagctgctcaaaaaagaagtgattttcaacaagataaatataggactgacacctgagtataccttagtaacagtggatgagagaccaatttgaagcaaaatctactagttgaagttcctgggcttgaagccccatgtgaaccattcagctaagctatctttcttatttcaagatgagaggaaaatctttggcagtcaagatgacttcaaggcatttgtcagtaaaactcccaaactattggttttgctgaaaacagctgcagcccagggagaagatactcgcggagataagtgactaaattcactttcaaagccacatttcttaagagagtgtagatcttatttttataattaattgcgtttttgccagggtgattagcggaaaaggaagtaaaaatttacggttgtaccaagttgttattatgtgtgtatatctatagctatacacacacacacacacacacacacacacacacacacacacagaatgcatgggaaaggatgataaggaaagttcaaaaaggaaaatgggaaagaatgaaggagggataaacgggagggagaaaatgaaaacagcaagataataattaagcatgagttggatagggagacattgaaatatgatagattaagaaaaaaaataatttgtattgtctacctgaaagcaatcaattatatgaacttaacagacttttatggagaaagtatttcctcatcttctgtcaagggtacatgaatctttcagaaagtctgaccatatcctagatcacaaaacaagtagaattggaagagatgcatgtatatttaaataattgcctgtaaactgatgtttttaggaacagattataaacagttggtaatattgcaatgatgagtttttaaattgctaatttgtgttgctcttgcagtttagccatctttacttaattttaatcatataattgtttaatcatacaatacgtaggaataaaagaaccaaattattgacttctatagtttcctttggacaagtgattacgagtaaataaatattagagagaccagttgtgccttcccaagcggcattcccccctccccccccatccccccaccacaacacacccattcccacccctgccccaccatgcaaatgcctacaatttggacacactgggggcaagtcagactctgagacagaaaaaggctttcctggcactggtatctggaagcatccttcctggatcaggcctaaactgcttatagaacctgtgcctgcctgctctaggcagtgaggctgagcctacctcctttcattctggagccaccaacttcatccaacacaggaaaagggaatactgaaacactttgaagcccactttcggagctctcctgcattttggatatctgtctctgaacaccctcccccaccatgtactcagatacacactgttcctcgtataaacaaaagccatattgtgatgctaagagaattgtcatttggagacagtggactagtagattaccttttttggtaaatggtacataaaccaaaaagaactttgtgattctgctaacactgaaacacacacacaaaaatcctcattttctccctccacccattaaacttgttaaaatcacctaggtattcacattgttggtttgctttgtgacaagcacccagaagcctgatcatccaggcctctatctaatgtctaatgccccactatgagtgttttgattaaataagttttagttctaattcatcacttgaatttggtttattctaggaagcttcctgcacactcctgaaaatgccctcagttatagcttctggaaatgacttagtgccccaaactctgcccttaataattaaagtgcttgacaaaagataagttgaaattcaagctctgtgagttggccccagctttcctttgcagctttgacctccccacctccaaagcctaaccccctcctcatcaggtcttgccgttggaacctaatctgtctggttggacctcctccctgccccagaacgccacttgcttagtcccagctgagttcctcactggtatactccacattgcttctccattgcagaaagggatggggcctgggactggctgaggagtggggtgggatgctaaaacacacagtcaaactttgaatgcacagacctctccagagatctgacacagtcctcagatggcttactagagtagtgaggttggggacaggggaatggagcacagtgctcataactttcttgagagtgtatgaaacttaacaggatccttgagcagtttggaaaccttcctgtttcccagtaaaaatcactgtcctaaaacataaaactggaaaaaaagtggtttgctagtaaatgtttaaaaacagctccagagatgtgaaggttgctgggagaaacttgatttgtagcatttacttcttcagttgtgaaaattccctgactgtggtgaaaattctctgaccatggccactttcaagctactaccattatgtcattgaatgctgggatgagataagatgtgcacattgggttctcctgaaccatacagagctagccaacatcagtacaacactgggaagggatcaggtttgccctgggcttctcctgtttgggatatataaaacagagttaggtttaaaaaatatcatcatcttacattagactcgcttatggagaaaggcttcccacaacaccctgtgaaccttggtgcttcacctctatccttcaagctccactttcttgaagctcttctatactgtaaatgttttgaaaattggcatggatgttttcaccctgacagataataactattactgttgtcttccaaacaaccatcaagtttgtctaatgttgccttctcaatgttttgggaactctgaccctcccctccttctctgctactgctccctagtttaggcacacagtacaagcaaagtgcttgcaattatccaaacacatactatcatgacttacttgatgatcttttctattgcaatcctctttgattctcaaggctcctccttctctggctgcctcctacttcttctctagtatgatttatccttagactacaaactccttaagaagagaaactgtcatcctttctgaactgtcagcatctagaacaatccctgacacaaagaaagtacttaacatttgtgttgaatcaatggctgcttgctgtgtcctaggtgctatgtggtggcttacaggaaggtttccattcaatcctaccccaaacccttcattgtagtaagtgcaattattatccccattttacaaataagaaaactgaggcttggaggctaaataacttgcccagaaacacatctttttattcatatgcctattctattcattacacaataatctatagtttataatggaagccacaattgatatcacctgatgcatgaagatatgataatcaatttggctgtaaaagagctgttactttatttttacacagtttgttcttgaattaaagtgtttttcattagataatttgaaatcttttatgcaggtagaaaatgtacataaaaggctgggcatggtagctcacgcctgtaatcccagcagtttaggaggctgagcctccagaccagcttggccaacatggtgggaccccgtctctactaaaaaatacaaaaactagctgggtgtggtggtgcgcgcctataatcctagctactcgggaggctgaagcaggagaattgcttgaacctgggaggtggaggttgcagtgagccaagatcgcaccactgcacgccagcctgggcgacagagtgagactgtcttaaaaaaaaggaaatgtacataaagaaaaatttgtctattttttagccaattagtctatcatgttgatatttcttatcaattagtctgtgagcccattggatgctatactttaatctcatcatatgttatatatcaggagctttgattagtgtcttattcatacattatcattataaaaagtctttcataatcaacatttgtgaaaggttgctctatattattaaaatcatgttactctaagacatttggggaagggcttacagattaatagtagtagtagtagtggtagcagcagcaaccactaccatttattgagcacctactacatgctaggcctattgtgctgttagttttacttacatcatcccattgaggccttgtgaaataggttctgctgttttttgtttgtttgtttgttttttactttactgttggggaacctgggactcagagagtttactcacttgcttgaggtcacacaactattgaatgtaaaatgtggactaaaatatacatttgtatgtctctaaagcctgggcttttaccccaagatggactttgaaggctgtccaagttacttaaccctctctgagtttccgtttcctcatctgtaaaactgaggggagtaacacttattttgcagagttgctctgaagatgagaaataatggatcccagggcccaggggcacacagtaggcacttaaactgtggtgatgtttatgcataaatggggcgttaaaatgggcaggggaagatctgagatcccgataaaggtattggggagctggagagaaggatctacaaatcttcttgagagctggccttctcccccccacaatacagtgacccagtgaaactctgagagacaggcgagggggcaggggcctgaatttggctccagcaacctctgcagggagtccggagagaggcggggagctgggaggggcgtagaaatccccgtcgtcagaggactgcaggtgccaggcagagttggtgtaggtgggctccccgagcccggcgcagggaggggaggaggttggggcgggccggcaggcgggcgggggagagaggaaggcggggctcagagccgaagaggctgtccttagacagctcttctcatgccgggcagtttgctgcatctggaggagctcactggagaatctccaacatcggagcgggccttcaactaccgtaagtacctacaaatgagcgcatagttcagtggctgaatattaaatactggccaccggatcctaaacaaaaccccgaaagagtctccttgctgtaattaattgccgtaaatcaaactgctccccagtctgtccccccacccgcttcattcctgcctttctcctttccttcccggatcccagacctgcctcggtgagaatctctgggcactgtagatatctccccttttccttctcagtcttccctccaaaccctcagctgagcatgtacccggcaccccgccgagcccaacccctttgattcctggagccctcaaagctatgcagggggcgagccattagacatttcagatatgtcaccctcaaaagcactgcggcgctgcctaagggtggggaaagtgcttggggtggagtaggagggaagggtaaaacggctaggcagccaaagttgggggtgggggtggggtgaaaggccaaaatgggcgtggccaactaacccaaggcttggggctgttctcatgttcccccggtataagattcatcatctgggctgaatataaatggtacaatttccttagtgattgaggaggggtcagccatgccaaaaagcccagcttccctgactcccctcaatcccccagtaggcaaagatcctggtttaggggtccaagtggcaaggctgaaacctcagatggcatttcctgggtgtaatcccaggttgaacctctcccttggcagtggaacctggcttcccccaaaaactcctggcccaaagccccagggtaacaaagcaacagggtagcatccaagctttggcctggccctgagaggagtgggagcaagggactgtaggaactgagatggaaagggcatctttagggccctacaccagttggatgccccctttgaaaagaagaaaaaataagcatctttttaaaatgtaatgttcactatgtgcctggcactgtacatgtattatctctaacccaacacaacaataatgttaggtcgatattactcctccactttacagataaggaaaattcagagtgggtaatctgaaaatcctttgatacaaagtgaaaaatgtacaatggacctatgcttccttggatttctcactgtccacttgttccctacagtccagatattttgaacacgaaatatcctcctcttcctgctcctccatcctacccagtgttagcactggggcaagtttgaggctgaggtccaaggtcagtctggaaaagcaaaatcagttcctttctctattctgggagctgcctcttccccactcttctgagctaagatttaataacagctggagtcagccaggacttcagactcccagtagaaagttggtggaagagaattagcttgagtttgcgtggctgggacataccttcccttggtgaaaggttactgtggggggaggtggagagaggcatgaaagctcaagagtctaccttgtgtatatgcaaggcctatggtaaataatgactttggtcagggagaatggaaagcctccctgaactcaaatatctttgccgtatttcctgagattcaaacaattccatttcccttagaggcaatcaacaaaactgtttagaagttaagggcaacgaaagaatcatttagaccttatgtaaattaactcaagcagcttgattttctaacacatgcttgacactggggtattgagcttttaggggtaggagacaagaatgagagtaatattggatctaaagcattctatggaagggaaggatatccaagggatcaagtgagaggggtaagggagggtgaagagggagtgaagggtacctctgggagtttaaatcattgttttagatccataggccttggagttaaacatggattctaatttgggctctaatatttaatatcttttgactttgggcaaattatataacctctctaagcctcagtttgttcatcagtaaaatggggatggtagtaatgccccctctcttaagttgttggaggactctctctctctctctatatatatatatacacacacacacacatatatacgtatatatatacacacatatatacgtatatatacacacatatatatacatgtatatacacatatatatacgtatataaacatacgtatatatatatatatgcatatctgaaaaggtgactctgcacctcccatctcccccatcctgtggagcttctgcaggctattctgggcttctgagatcccagagacaaatccatatttcaacaaatctgacatctttgataccaacaaagaccttgagcaggatagggaagtgagggaaaggagcaaggagaggaagcagcaggtgaccttgtaataccctgcatgcctgtgaggaagtacaatgtagggttgtcaagtgcaatttagccatctaaactaaactttaaggagcaggacaagtcctctgagtaaaaacaattctgcttttagatcccaccacctgctgaggagaaaaattcttcaagactcagagcacacagccagcaccagaggccccatgaccctggacagaccaggggagggggccaccatgctgaagacattcactgttttgctcttttgcattcgtgagtacaaggaaggggtgaggggcaagtgaccctgtcataggtacccactcattaggggtgggagaggaaagtattgaggtttgagcacaggatggagacaacaagggagctctcctttaccataatctctcttttcagggatgagtctgggtatgacatcaataggtaagtgagtcctgccctctcaggcacctccttcctaaaggatccaagatgctggcgtgtctccatgaccttggacataatgccttgagattccagagatagattgggctgattgggaatcagaggacttggtttcctatggcatggtgaaaaagctttatctcagatggaaaagagaccatcagactttattctccaattcatttggaccccttgacaaaatatcttggggttcttatacgatgccccacaggagcacactcctgtccccaagggaagacaaaatgagggatctgggtccgggctaattttaagggacattgtgggacatgttatgggagggagagggttggactgctcatatctttttgatctttgggaataacagtgatggaccctcaaccagagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggtaagatgacagtgatactcaagaatcaactccagctcctgagattcaaacttgccttccaggggagagtttgtttcacaaatgcatgcaagcatgcatcccacagttagtaaataagggcctactttgtattgggcaatgcagaggggggatgcagactctggagcagagataggagaaggaggggtggcaaacaaggatcatacagggaaacctcaattaaagtagagctctcctctgctgctccctagacagtactatccttgctttacctaattccagttcattctatccttccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatattaattttgttagtatagctttttattgaggatcaaagaacaaaaactgcctgtttgaactgagtgtatgaatgtttgttgtactcatgccctttcagcatagattccactaaaatacacttccgtagttacctgttcaccaatatcccccaccaaccagttcatgagctttttgctagcggagactgtgtcttctttactcatacacacctagacctacatgacgcttgatgcatactaaatgctcagtgagcatatgacagagctgatccttccttaatgaatagataagtgtgcctggcattggggtgggggtaggaaggagtggtaggaggtgaggtttgccctcactttcatgtaaaatctccttggagaaacaattcatggaaaggaatgtgtggccccataacaaagatttatttgggtcgcagacttactggccaaaccctctttattggcttctttcagtcttgttgtagaagtagggtcttaaatgagcttaatgtattcaaaagctctccttaatatttcagtggcattcatgctctgcaaagatgaaaacaatgttattttcagaggtttggtttttctggtggttgaaagaactacatttggcatttcaggggcctaaagatacagggaattatagatgtagatcttccactgagatacacccctacacatggttagagctcagtgaagctggcagattcttgagagagaacaggggcataagtgaatctacccttgattatgttacagaggcagagatccaaggaagggatagggaagagaaggtaaacttcagctaccacttcttgttcaaagaaattaagaaagagaaaacagaagacaacaggaaagaatcatcttgcctctaactttagggtctcttccgtttgtaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtgactggtaagagacgggtatgccatgaaacttaggttaacggctaaggatataaatctccctctgtgctccctggagaacctaatcctgtggccagggttaacagtagagaagggagcagaatttgtaaaactgggtgtaggcaggtttttccaagggtggtttggaggaagagaaggaaaagaatcttaaggagtgggagcaggaagtgaaatcactagtgctttttattctgggtctcatcctagacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtaggcaagtgttaacaactgtttttattatcaacctgtttgtttttatcatcattgtggtgttgtaagaaggagctagtagcctcatatcctctgagagctatgagcaaaacacacacacacatacacacacacacgcactaggaaggtggtgtagaactttcttccaaaactttagggaccttgtctcccaggattgttcctcaagctccacctctcagtatggcacagccccattgtaacccctgggaaaattatttttctttaggccagaggaagcttacaggtatgaggtcttcctgattgaaggtaaggaaccaggaatctttagatcaccaaggggtgggcaaaggaattctaatgcacagtcaaatcttgaagccactggccaagtggaagtggaaaggaagagaagatcaaatggggagctcagaaacattttctgggggagagggtactgggtttgaggtcacttctcactctggtctctggattggtttcagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggtgagaggataactcttcagaggaatgcccctccataccccagggatcccagatcagtgcccagaaagatatgggaaagggagtcagaggcctgaaaatcagagcccttgggtttcagcacccttcccctggggtggtctcacaattcctcaaaggcagttagcaggataatttcaaggctcccattctccatgaaaaagaaggccacttctgcctcaccttctcaatataagcactgtcagtaaccagattgtcctcaccccatgaatgtattcacctgcccctgtccccatcaaggcctctgattctggtcttctctggccacaggctatctcacctggaattacgttctgaatgaagctatcaggttgtctctaatcatgcagcttgttgccttgctgttggtagtgctgtggataaggtggaagtgtcggagactcagaatcaggtaactgtcttgtcccagccccctgttccccaacctaacagagtctgaagaatgagtcatgccctagttgagacaagccacagaggcaaaccctatagaacccctatcttctgggcttagggaacaagactttctcaccccacctgtctctttcgcctcacagaggggtcagcactcaagccagcgggtggagaaatgcatagttctcagaggcaagaggagtaatcagaactgcattcactgacatcccccccggagggtgcccaaatctcgcccacaaaccatcctgccctcagagatgattgatgtctccctcattaacttgttctggatttttcctcttgtaagaagccatgctgtcctgtctcccagactgttatccaactcctatcccaacttttcacccttatccctagctctcaggagctattaagccttgtgacgcatcctagttgccttagtaaccagtctctgacactgtggcctccaaccacctgtgcagagcattctgggaatatagacttgacctggatggccatctgatgtgatattggacggggcaacagaatcagactgtttcctctgactcacaaactcacaggccaaacagattctcctgccatttcctttgattctgtggtgtgctctgggccatctgcctctctcatccccatggcttgtgctcaggctactctactgggaacaaggagagaaatgaccacttctgacccagtagggatgttagctcctgaataccttgtctacttccccctactccctgcttctggctgtaccccccgccctgcaactgtggtcagtgtgtctggaagtattcaatgcacaatggattatgattatgattacatgtgtctgtgttttccactggaatctgagggacagaatacttgggcaatcagaagggagccacctaagccttctgcaaaaaccaccaccctttgagttttcaaaaagtttcagcaggggtcaagttctacttctttccggaacctgacctgggtcccgtactcattagagtaatctccaagccagtggttagaaaaaaaaaaaaatgtagctttatgtgccccaccccagcccagcaacactgcatcaaagaataagatcaggaaccagatttcagagaaagcagcttgaaaatcatgttttcctcaccaggaaggatggtcagtgttttctaagtaaaaattgtccgatggattttgggttaatatcatctaatactacaagactcatgacccaaagctgctgcacatttctagttataatctgggtgaggggagagtttctactctctgaaaagcttggctcggcactgccaatcttctagtaattcatcacagctgcctaggcaacccttccataacaaaggcaggtgaggcaggtgggtctgaggaccaatactgccacaacaactgcttccgaacttaaacttgatgactgagaaatactcacagtttctccctccacccccacacacaccacccagagctgccgatcacaatgagctccaggggttctgagagctccaaataatataaaagcattttcccatctgacatctcaattccagcaacaacctaatcaggggccatggggagctgacatatgatataggctgcggagtggggagggggcgggggggacacgtgggtcatgaaagagcaagaggtttgtaggtggtaaggccctcaaaaagaaaagtcattgatgtcaaataagattatatcccattatcttggccatatccagtccccattgggtagcgagtaagccaatgacataaattgccgccccctttcctccaccctccccctcatcccagcaactcctctcatctcttttctggtctcactagagaagcctggttgctgggaacagctcaaggggtcaccatgctcttcatagtcacggcccttctctgctgtggtgagtacaagtgggggaaggggccccgggcagaaggccggggtgaagtcccggtgggggagggggccgagtcctggcagcaatttcttttgcaggactgtgcaatggggtattgatagaagagactggtgagtttttcctgctccagactgggacattcctccctggagatccgaaataactacagagcgtcagtgtcattggccagggagtggctggttgggagggaagggcagccaggaaggggcacttgctaaagctgctggcaaaattcagcctccaactttgcctttctgcctgcaaaatttcctccaagcttctgcacttttctgaggctcagctataagacaccagcttcccctttccccagcacctgaggaaggaaggaaagaaggaaagggtttggatttgggttgcaaggggaggtgggcagtgtgatctgggtagagggttcaagggcaaggaggagggaggggaagggaggcgggaggatggcttcattaattctgctgtttctagaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacaggtaagaaaatgtagagggtctccgggagttatccccagtgcccctgggactccaacactgctcctgggagtgagggaatgaactcacagggaccctggagcccaaggggctcgtgctgcatgtaggagaggaggggcactgaaatggtagggggttatggggtagggggaggggcggaatgggaaagagagtgtgaggagactgactggaagagcctagggccagcccagaatgaatgtctttatttgctgacaaagtgaccctgagtatcccatctgggcaactgcaaacttctgactcctttttcaccccattctgttttccagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaaggtagagctgaaaagggtgtgggaggaaagggggcagggtggagggaaaggcaaagccctgggtcagacactcctctccctgcagcaaactttgctgctggtcctgagagcctgtgtccaatcttagagccaggcaggcgtggcgctgggagtgccagggcctctggctgcacgatattaatagccataatcgttattaatagctttggttcgtggagggtgatttaatttttctaattattttcacatcaattatctcacttcaccatagagcaactcttcaaggtgggtgaagcaggtaccattttccccttgtccaaatgggcaaactgaggctcagagaatcagcagaaccccaagaaaaattctacctttttactagcctccattgcctgccctgatcacactgaggactcatctggaggtagtgaggggtggggttgaagggtccctgtgtgagaagtccatctgcaaagtggatttaccttactttttaaatgcacttacttaaaagcaaagaagcctccgagaaccaatatttgctatatttgctttctctctttcttgttcttaatttggttttgtgttgtattttgttttttgtttttgtttttgttttttgccttctagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacaggttaggaggggggactccaggtagaggtggtgccaaccctgggatggtgggtggaaggctgtcagtgggagaggaagaaatgtttcttctaaaacacactgagaacgtgcttaggacagcggctggcccatagtgaccagtccatgatgcacagctgctcatgttattattacaggaacaagaaacaaaggcagtggggaggcaagcaattcacttctggggaaataaatgaggtagatgggggtgtctaatcccaagagctcggttcaacttgccctatttctgcacatttttatggcttggcattgagctttaggctcaatgtccactttttctctagctgggctgtcagagaccggtgggctggatggctctcagagaaagggagaagaccttgaaatgtcagctgcatactacacaactacacaactgtgcataagtggagtcccaattatgtaaacagttatagctacatggacatgggaatatatggaaagaataaatggcaattaaatattaaaaatatttatctttgagtggtagaattgtgtttccttcattagtttttttttctatattttctaatttttaacaacaaacatatattgtgtcttacaataacactttaaaaggctatttgcaggatgtgagggctgggtttatctcatgctgtggtctctttaatttcagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactggtaaggaccgaccggacatgggactgggatggagatcattggagaaggggttagggagagtaattcctcctggaaggctaggctaggccacggaggggaactaccgtgcccaagaggagaaagatagagtgttaatttaagcaggaactcataagtttctatagtcaccactttacaaccttggtctctttctagacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggtaaggggaagaggctgtcgagtgggcatggaagtgtagaaaggagggaatagactagttcatgggagatagttttcagagagctcgaggagaggcaaccaattgcctttcctctttattgagcagagaccccaggggtgatgcactggaaagtgacctcttctctttgaccaggagttcatttcttccaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactggtaaggtcctggagacttcagtacaagtcacgattttgtagtttttagcagtaagcaataagggggtaaaaggctaagttcaggatcatttcttttaactctgtgtccttgttggttgcagataagccccctaaaccctctctgtcagcctggcccagcaccatgttcaagttagggaaggacatcacccttcagtgccgaggacccctgccaggtgttgaatttgtcctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcaggtaagagaataatctctccatggtcctggtgtgacacacctgggatcccagggacagtccccatggagacatcccaaatcaggagaatggaggagctttggagccagggacctgaagtgtgtcatctttctcctaaggatgatgaggaggtgggaccttaaatatatttgaagatagtgagtgggtttcttttcaggcctcttttccccaaggaaaggagggctgcttctgcttcagcataaactctgccactgcccaccccctctgtagtctgaacagatggctcccacgtgaaccctaaagaaggccagagtgtggggcaataccagatcaaggggaacatacacacgctaatctccatggcctcggtttctcctctttcatcaccacagggcctgttgctcaggagtgcactgtagggaacattgtccgaagtagcctaatcgtggtggttgttgtagccttgggggtagtgctagccatagagtggaagaagtggcctcgactgcgaaccaggtaaataaatgcctcattatggcccccttctgtgaaccaggtggtgctagaaaaacaatcatacaaatgctcccctagtatctgagccccaccgtgcaatctgttttcagtttctgggtcctcccttactcatgtctttttctttacatagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaactt

SEQ ID NO: 5026 - DNA, 1777 bp, human
ctggggacttcgctggagagatggcaccggcctgaggtcaaggagaaattgaactaaactctcctttgaagactgtaagtgacattggggaatactcagggagggacagtgggacctcacactactatgattcgcctgtgttctaatgtccaacaatttaggctgagtaataaatctctttatagagtttggccatttagggcttgtaagtaagggaatttggagtcatttttgctaggctggccactgagtctcgcaggtttctgggtacatgcttgaattgaaaagaaagtgacacacctaaaatacagcctagactcctggccctggggctctgtggatccgacacaaagtttacaaatagaaagctagcaaagggaaagatagtcggaagtaacaattttatctaaaaatagaaacttagaatctaacaccagagttactacttgcttttgaatttcaaagactacataggatggcctttaaaacaaaacttcagcatgtaagagccagccaagcaaattgttatacataatcaacgattaaaataaattagtctttaggcctaaaccgtttccaatcaaatctttcttgaatattggttaccttttctgccgtgtagtggttggaatcaaatgagaacatagctgagcagagtaccataaagtctacttctaatgctgctgttttcgagccttgtgatttttttttaagtgactttagtattcgctggtaaagtcaaggcggatctaccagacggtaaaagttctgtgtgtttgtcaggcacggctaagtaaaacgcactgcatctgaaagtctaagggtagtttgcatgcatctctcagcaaaatagcaagtggaagaaataccagcaaggagaataaactttctgggctgtttgatttcccctgcaacttctagtccagggatgtttggcgttctcccggtcgctagattattagcccgcaggttccgcaccggccagggagccgctcaagtcctagggccgggcggctggaggttgcaggtcggaggggcttctacgggtttgggggtgggacggtccgcggcagccgcgggcgggtaaggactgacgtcgcaggtttccagaggcccgttcccgaagccggagtcccgacccgaaaccgtccccggccggctcgctcgctcagcagggcgcggctccagcgccacccggctcgccccgaagaggtgggactttccccaccggaagtgatcccgtccagtctcggggaactggggcacctcagccagtgtgtcagggaaacccttccgggtgtgtgcttggtgggggtgggggtgggggtgggggtgggggtggggggtgggtgagaaaaaaaagaggtgggttcgcctggagtccctgcggccgccgcggaaggcccccgcttctttccccgcggcgagcagcagcgctggggcagcggagagacagaggagccagcgggtggccatggccttggcgtgacagagcctccccggcggccgggcgggtgcggacggcggggtaagcggcagtagcttgatccgggtgggagttgggggaggcggcggccggcgccgcaggttcggggcgggggtcagccgggtaatgtgcgtccttctccccttcacaggccggacgacccccgcgggagccggggcccagaaacccgcccgggcagcggtaactggaacggagccctcaggcctgagccggctgggctgcgcgagcaggaagcggggtccctgggcccctttgtgtgaagggcggggg

SEQ ID NO: 5027 - DNA, 14783 bp, human
cgctggagagatggcaccggcctgaggtcaaggagaaattgaactaaactctcctttgaagactgtaagtgacattggggaatactcagggagggacagtgggacctcacactactatgattcgcctgtgttctaatgtccaacaatttaggctgagtaataaatctctttatagagtttggccatttagggcttgtaagtaagggaatttggagtcatttttgctaggctggccactgagtctcgcaggtttctgggtacatgcttgaattgaaaagaaagtgacacacctaaaatacagcctagactcctggccctggggctctgtggatccgacacaaagtttacaaatagaaagctagcaaagggaaagatagtcggaagtaacaattttatctaaaaatagaaacttagaatctaacaccagagttactacttgcttttgaatttcaaagactacataggatggcctttaaaacaaaacttcagcatgtaagagccagccaagcaaattgttatacataatcaacgattaaaataaattagtctttaggcctaaaccgtttccaatcaaatctttcttgaatattggttaccttttctgccgtgtagtggttggaatcaaatgagaacatagctgagcagagtaccataaagtctacttctaatgctgctgttttcgagccttgtgatttttttttaagtgactttagtattcgctggtaaagtcaaggcggatctaccagacggtaaaagttctgtgtgtttgtcaggcacggctaagtaaaacgcactgcatctgaaagtctaagggtagtttgcatgcatctctcagcaaaatagcaagtggaagaaataccagcaaggagaataaactttctgggctgtttgatttcccctgcaacttctagtccagggatgtttggcgttctcccggtcgctagattattagcccgcaggttccgcaccggccagggagccgctcaagtcctagggccgggcggctggaggttgcaggtcggaggggcttctacgggtttgggggtgggacggtccgcggcagccgcgggcgggtaaggactgacgtcgcaggtttccagaggcccgttcccgaagccggagtcccgacccgaaaccgtccccggccggctcgctcgctcagcagggcgcggctccagcgccacccggctcgccccgaagaggtgggactttccccaccggaagtgatcccgtccagtctcggggaactggggcacctcagccagtgtgtcagggaaacccttccgggtgtgtgcttggtgggggtgggggtgggggtgggggtgggggtggggggtgggtgagaaaaaaaagaggtgggttcgcctggagtccctgcggccgccgcggaaggcccccgcttctttccccgcggcgagcagcagcgctggggcagcggagagacagaggagccagcgggtggccatggccttggcgtgacagagcctccccggcggccgggcgggtgcggacggcggggtaagcggcagtagcttgatccgggtgggagttgggggaggcggcggccggcgccgcaggttcggggcgggggtcagccgggtaatgtgcgtccttctccccttcacaggccggacgacccccgcgggagccggggcccagaaacccgcccgggcagcggtaactggaacggagccctcaggcctgagccggctgggctgcgcgagcaggaagcggggtccctgggcccctttgtgtgaagggcgggggaggagtgccgggcagccccgggctgcgggctcctccgacgtccgcctcgccgcagggtcccctcgccgcagcccccaccctttccctcccgggggcacgcgcctcctcgccaccctcgccgggcttttcccaggctcgccctcctccccacgccccctgctcgggctgcagttcctataggaagggcattaccatcccttccccaccctccccgactctacgctctttcccctccccctcctgtaacttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggtaaccaaaccaagtcttgtaatttgttagaagggggtgtggtaatccgacatcgacttctgggttgcttgaaccgtgcattaatgactgtgctttgcttttgaaagttagacatgacgcatttttgaggttactcctgccatggaagactatcgggttgtttctatagagcgtagtaaaaagtaacaagcgtcaacaaatattttaaagctatttttaagtgaaagaaaagtgaaaaagaaatgtcagtctgtgtatatttcgcctggaatataaccttctgaagttgcttgctcaattcaacaagtattgattaacttacacgacaaaacatctaacaaataatctcgggtaaatagagcactttgaaaaaattatttggagccgattatctgttgcacagataagtcctctgtgtctgtcccacccacaccttcccctcccaccccccaacaccccctcccgccgccctccccttctctctcaagtttctcaactagattcataaatcttagtgttgcaagacgaagaactcaagacctgccttctaggcattttacttaattacttggggcgtgtagtaggaagaaaagttactaatagaaaagactagtacctagaattaataaccaacaaaaatcaggaatgactctttttctgcagttgatccaaattgtttctggtaacattgcctgtatttacagaaaatacgtgggtctgggaacactgaacaagtgcagatttcttactccggctgggtggccaaactggatgtggtccaatctcttagaaaatctgtcctgtccttcactgggaaacagactgaaggtttaacgttattttaggatatgcaatgtatgtttctatttatcccttgaaaatgaataacctcatattgacccattatattgacctccattgatttaggaaatggatatattttttctgcatttaaaggtatgcacttaatgtagcttacttaagagaccttaagtgctttagccaatacaatgtgctaattccactttctttagtattttaaattaaagtactatagtgaactttcccagtaacctgatagaacaacttcagggattttttttttttaagatgataaattctggggaaataaatcaaagctattgagaccaaactaaattcattttatgtaggcataaattcccaaacaatagtatcataaaagcattttcccccagaaagtaccaaagtactgaaggtgctgtttgacaggcattttttccctaaaggatcctcaggagatttgttattctatcagcttactctctggaggctgagagtcttttgaagggtgtttcataagatttctgttatatccatttgtgttatagacatgaattgggagtgaaaaactgtgccgttatttcagtggaggtgtaaactcttttgagcccaaatgccctaagtttggattttcagctgaacttatgtttccataaagacaatgggaaataagcgtaacctagaaatctgagttgatatattatcaaaccaaattgatgcaaatatcaaataactatatttttatagattttcatagtcccttgcttttccgtaggcccacatgtgaatattctgtacttactatgacttccaattaagcatacattttctatttaaggcaaacttttaaaattatgaaatattaccgaaaatggtgatttttataattaagtctataatattgtattaaatcaatacttgcccccacctcccaaaactgatgctactggagaattgctaacgctcttatcttttgtaattcgttgtaactacttggaaaaagtaatacgcatggggaaacaagtagtaaaaacaaacacaggcaaaaaaaaaaaaaatgacttcttcccacccagactccccttgcactgtccttcccaggagttgctcactgttacagtagtttctagtgaatttaagtgtattgtaaggtgtttgattttactggaataaatgcataccattcaatttaaaataaaacatttaagtgtatccatctggttgtaactcttttattctaggcattacaaagtggttttttttcccacttaaaacactttcactcaagccctcttgctacatggctaggaatgcatagatgctgcaatcctgtgctaggataacaggtgttacaaggagtgatgacaagcaggcaggtttagggagatggccaaacatccttatgtacgaatggattaatcatttggaaacttgcttttttaatcagtatagactgggggtgggtaaaagtgattatatgagtcaaggttagtgtgcaacccatgttttatattcttgacaaacccagcaggtagggtctctggaaattatctagttcttacttcagtggacaaaatgatgacgatttctctgtttaggtgtgatttcattttggattcagctttgtatactcactgaggtatgactttttgtaatactgtaatatttctgttatggttatacaaacagcataatgtttttctttctctttgtgattgcttgaataggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcaggttagtttttgatggaactgtatgaatcaggtagtgttttgttttttgatcaagtaaaacaaaaagctggttagtgttaatacatatggcactgccttaaatttctttatttttaaaataacattttccatcacacaaaatagtcaacattcaatgaagaaaatttttttaaatgcagataagcaaagcggagataagaaattgcttatattcccatcaccaggattttaagtgagttattgttcttccttctctgctttattggtaatatttctttgggttgagttaaaccataatacactttttccctgttcttctgatttagcatccagaatgcacaggagagcactgagtaataatttcagaagttttgtggtattttctgtacttttatgtttttatgtcctgagcaagcaaattgctgcaattaaaatcaccaatttactaatcaccaagtgcttgattaacagtacaattatttaagcaaattcatctgtacctaacacttgagggacttaagtgacctctgataataacaaattatagtgccacagtgtaccctgacttcattataaatatacggtccaaaagataatctagttgaattatctgtgatgtgttagaaggaacagtttcatgcataaaaaaatttattcaatttaataaattatgagattaataggaacagtaacaaaccttcaggcctttcactgagttaaatgataacttacaagttttttttaatgaatgagtttttttttaaaactcatacttttttaaaagtaagattatgtaaaacttacgaagcatttaaaacaagattatttatgccatgatcttttagtctagattgtaattgagcaaatagtctcacttagacagtaacacttagataataagataaaacaaccaatattgtgaatgactgagaaaccgcagcaaatgccagactagcctgacagtatcaggaatgaaattgatcttcctgagccaaggctgacctcgagtctaggaggcagtgttgcaaatggcaacaggcatttcagattggagcaatgattcctaatcaagggtctggctttgtgtatgctccccggagaaaagactaacggtccctaatttatcttttcagacaaggtctcctgtcagatagtgtcatctttgaaaatgaaggatgacaacaatgctttatttaaaatgctttcactcatcagcctttagcataccagaatatgatgaaaactcatttattttcttatgtctagctacatctattattttataaagtcacttttcagaccatagtccagcttgtgtttggttgatagcattgtacttgcagtatagtcttttgaggaggggagaggcttatggatcaagtcccatattcttgctgctgtaatctctctccttaaattgtaagccagcttcacaattgaacaagttctgtgtggtgattgtgtctttactgttttgctctatttttctacctgacacttactgggcagataacgtaagtgtctatacacattttgtgttagttttatcatctttttaaaaattaaccaactcccacgaaatgttcccagttttccttccatcattagtgtagacagctataggaggttaactgaataaaattggtctcatacatgtagagagccagctctctcagccaaattggcaggtgaataatttctaaagctatttttgaacctcttcttctgaatcatttctgagtttatttcatttggtaactttttgtgatctgaattatttttaacctatttagttacctacaggaatgagtacatagattttttttagtatctcaagccaactatatttgtattttttgttaattaacatactaaaaatggaaattattaatacctatattcatttttatagtagtgggtcaagttctctgtgtaggtttttgtttgtttttgtaagcagaatatataaatgaagatattagccttgaaataaaatatccaataaactgaatttctaaaaatattaaggggaactccctgaccaagatcttttagaacaaagtgcactatatgcaggttttttttttttctgacatcaaataaaattgaactgattcccatatatgggaatctctaatctgaggctagtaaaatttgtggttgtccttgctcaccatttacctaagaagagaagaaaatagatggtggattttgaatcctatagcttgagtcatggagctttgaaatctgtcagacccagatctaaattgaatatcaaactttgacaggtaaagttgatttgagaaatgtttgtcgctaatatttagaagagtaccttgtccaagttagaaataataggatgtaaatcagaaacactgttattgttgttaattggttgtttttaactgagagggaaaatttattaatgctctaagaattgcttctgataattcctcacatttatgtcttaacatctttcaatttgggtcacaggcctcgtgcctaacacctgtttatctgcgtggctcccaggattgtttcctcaccttttaccctcccattggcagtaactttagtgtaagtttggaagcataaccagattccttatacgctgccatcatcctgatttctttactgatctgaggagcgtatgatcaagtgctttgaagggacttcttttgctgtatggcagcagtataatggaaacccgggtcagcattgtcaccctgttctggtttcattcactatatcatagctcttctgtgctggtataaattattggcagttcactgtttgggtatatttttgttgagaaggattgatgttttgttaataatctcatagtactataaaagaagtaaatcactgtcctgtgggagttcagggaaaggagagaccacaaccaactggaacagagtttcttaacattctgggatctttgctgtttggggctgtcctgtgcattgtcagatgtttaacagcatccctagcttttacccactagatgacagtagcatcttcctcatcccccattatgacaagaatatctccagaaattgccaaatgccccctggggacaaaaattgcccttggttaagcgccaccgagttagagatattgggagcaatagcatttgaatcaggctttgaagatggataggacttgaggggactggtggtaggggtggggggtgtcagtgttgaccttcaaacagaaagaatgccaagaaggagcataatcatatcctaaaatattctgttgattccctaatagtaagggggaagtgcagtaaaggtgtctcttaaatgtgacagtttgatatatccttttggcaaatagaatattttaaagatgatttttcaaggattcctttatgtcagtccagtattgatgaaagtgataaagaaagaaaatgggggaaaaggtgttattcactgtggtttgaaggtctcctgtaagattttataccatttttctcagtgtactgtggaacaggttctcccaactagagtaaatggtgcataagagtaccaaacacagggaagcaaactgaaaggacaaagatcattatttatgtcagccccagttcattatatatttcagcctgaagaaaaagggagattcttggttcaagactagcacgtcattttacatggcagcagaatgcctgggatgctaacaaaggctactgaaagactaaactctatttgaacatcattttagtctagctagacttactattcctaaatacagtggaattgataaacattttcagggttttttaaaataaaatatagaatcagaatggtttttaatttttttaacttttaattttagtttttaatttttatggtatgctgggggtttagcaaatgtgaggagaaaaatcctcaaatcacatcacatacttaaaatttcctatacaaggtaaatattaataatatcagtaaaatgctggggtggaattctgttgtagaagttatagttttgttagatagttctttttttcccactgctctatttgcatatcactttgaatggggaaaatggcttatttaaaatgctcatctgtcatccagttcacatggtgagtcaaagtggagcagaggagttgaatggaagaagaagcatgctttgggggtggtatgtaccataaaggccctcagcgaaccttgggtaaaagggaaaaacaaaaccaccttgccctttctactactcctaattctcccagaccttcactgaattcatagggttggttcatggtttgagacttgagagtggacaggtgcctagttagacctgctctggatgtggaggtgtctggtgattagaatgactctttgtatatctgttccctctttaattgcttccttttaacctcaagattaggcttttattgcataataaaatgcatatgagccattcagttttactccattacctctctggcttagaatgaactatcagtagaattaacaaaaattgcatcatagagttggagaattgccaccaaggaagtgttctagccatactacagaaaagattctccccatgggattacttctcagtagaattctacaattcagaagataatatcagtaagaaaaacttaagtcctgtcagctgttagaaaaacatatccaatcaaaaacatactcccaagtagttttaattagccaatcttagaaacatcaaattcagaaaaagcaatttagagttgaggggagtactaacttatctggtctaattcaaagctagcagctggaattgtatcattgggctcacactgttgtttattatcactggacttggttataatatgtgagatctcagaattgaactaatcatattaatttaaacattcagagattttaggtctagtacataagaaatatagctaatcccatcccttctaccctgggttcactataaacatttagtgagcttgctttccttcatgtgtgattccacctccattcaaggattctatgccataggttccgcttttgctctctgtgtttaatgggtgacagtgaacacgtttaaagatctagtcctcccactccaaccctagtaagcttcatgagtattatgcacattaggatagagaaacaaaacaaaagatatttaacaaaaacataacctgtatcagaggaattccagcctgaggccagatgcagtggctcatacctgtcatcccagcactttgggaagccgaggtggaaggatcacttgaggccaggagttcgagaccagcctgggctatgtaatgagaccccgactctacaaaaaataaaaataaaaaacttagctgggtatggtggtgtgtgcctgtagtactagcggttcaagaggctggggtaggaggatcccctgagcccaggaattccaggttgcagtaagccacaattgcactactgcactccagcctggatgacagagcaagatcctgtctctgaaattaaaattattattaaaataataattttaatgttttattaaaattattaaaataatttaatgttttattaaaattattactaaaataatttaatgttttattaaaatagcacttttgatgatttattaacatcattattaaaataacaatttattaaaattataattgcagcctgatgttttgctaatacaactaacttttaacttgtaaataaaatgctaattaaatatgaaaggaaattcattttcaaaaaaagtattttggttaaatcccaagaatatcatatccctaaaactagaaaaaaattaaaagtgattatgattacacactagtatttgtgagagagagagagagacaatgctagtaaataccattgtatttagataaggtaagtccagttaagctaaaaagacattcataaactgctaagcctttcaggagcctttgttaacataccaggcattctgctgccatgtgaaatgatgtgctagtcttgaatcaagaatcccctttttttcttcaggctgacataaataatgatctttgttccttttgttctgtgtttggtactctcgtataccaatttacccgacttgggagaccctatttatttcataatttcctgagcaaaagctttggattagtgtgtgtgtgtgtggttttttttttgtactttcctataatattgcattagtaaaaagctaaaaagtaaaaccaaacaattaagtaagagtttgaatagaagcttccagagataagatttgttgagtgtcttgctggaaacttgagagtgaggtcgaggataacttgtgttctatcttgaaagctgcaagttatacatttgcaacgtgcttgaatgtgatatcctgcaagttaaaaagtactgatttgaccagctgcttttaaaccttcagcgatttatttttacgtaaatgaaagtgttagtatattgaaaattttgctgtcactggggagcaagaacatttacacttgaaattctaacctgaaagagactgttgtttttgtttaatgcaagcattttacttcaggatttattactgcagataattataatttattactctcttgaaaagtagctagtattaatactttgtttgcttaaaggtatgcctaatgttaatattgtagagcctaactcaggatttatctatatctcttgatttcacaggagtattgtcatcctgtggatgtggatagaccaaatgttacccaggtttttagagggtaggaggtgattaatatatcatgttttattccatatagattatggttagtaaaatgatttgattattaatatttattttggctagaaataaataataactactttctcaatttgattttagagaatgcttgaagaggtctttaatatttaagagaaataattatttttgaaaatcccaacctctttataattgtttgatttaaaaaaggaaatgaaaatttatagcaaattcattaattcaaactaattgaaggaagtctttctaaattactaaaaagtattcataatgaataatttttattcataatactgcatatataatgaaatactgttgtgttcaagtaggtatagaaattccagctaggctaaaaaatataaagctccttagtctggatatcaaaattacaatcctggtagtctagaaatttataacatagttggaaatggaaaacaaatttacaacaaccctgtgaagaaagtatttttatccctttttcgatgatgaggaaaccggacttgccaaagcttaaataactggtgtcctaattaacaatttaatgcaaaatgtcttttaattggaagaatgtttctataataatttctaaagaggcagacttttgttctattttttcctaatgtgtttaggtagcagaatttcaataatgagcagagtgatgttctttaatagtaatcatttttatgatatagctgctaataaagcattatctcaggctctttgagcactaatagaagtgtagctgtcaaatgaaattaaaattatgcatttataaacattggtagagcccttaaatgattataaactggtttcccttggcattctttcatagttgctgttctacttttgtttctggctttatgataacattttttatctcatgcgttcaaaaacaaacataactctattcccctagaagctatttggtgattcagcacagttgaaggacgctctatctgtctgaacgatagattttttttccctagtattagctggaagggcagaaatctgtacgctataagagcagggaatgaggaatcccagtcataaaagaagatcccgtggttgggaggacatccccaaaaaagggcagacccaagtggaaaatgtgaactgctgctatcacctagcatctgaccttacctaggcacctagtaggtgctcaatatctagaccttgattgaatttccttccttccttcctccctccctccctctttcttctcttttcttttttcttttcctttcttttcttttttctttctgcagtcctcccaccttggcctcctagagtgctgggattacagacatgaaccactgtgcccggcctgaatgacgttttcttattttaatctctcaaaaaactaaatttaggaaaagtctaacatactgccaattaactcataattaacatgcatttgataacaataccatttccagttaaaatgtgaagagatcaagttcaaagtagaagcagcatttgcaacaacttttatactgtaagatcatttaaaccagtaaggacatttttaatattgcataagtataatacaagtacaaggcataataatattatagaaataagctagaatagctacacacacgcacacacacgcacacacaaagtacattatatccaatgcatcacttctgtgtttctatttttttttaatgacttatcaggacgagggaaaattaactttctactttaactgaagtttgttattcttgttaccacttctctgtgtatatagatctgttgtcagtgttctctttttaaactatgtatttctacatttttatgacatgtttatcttaattgcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacact
